United States Patent 8,781,750 (CELL-TYPE-SPECIFIC PATTERNS OF GENE EXPRESSION) - sequence listing, part 57

SEQ ID NO: 38524 - DNA, 172875 bp, Homo sapiens
gggcgtctccgccgcagctcggctcccgcgcgctcagcaccgccagcggcggccagatgcaggcggagcgaggagctcggggaggccgtgggcggcggccaggccgcggccggcctggcggagatcgccacagcgagcggcccggagccgcagcggcggtagccagaggcggcggcggaggcggcggcggggacggaggcggacgccggggccgtggccgtggccggggcttccgcggcgctcgcggaggccgaggaggaggaggcgccccgcgaggcagccgccgggagccgggaggctggggcgcaggggccagcgcgccggtaagaggcgacggctggtggggctgggaccgcgtgtaactggggcaagtggggccgaggccgccagtcaagagccgcaagagagcgtgccaggcgcgcgccagacgggcggcggcgccggcgcctgcgcgggacgggcggatggtggcgcgggggcgcgcctggtggcgggggcgcgcctgggtatgcgcttggccctcgtggcctcctggccgggctggcgcgagacagtgggggtaggagggcttcccagcctgccccagggtccgggttaggaacccagaggccaaggccgtgtgtcagggctgcaagtctcggcggcccgtgggccggctgggctgtctgtacgagtaccactatgggacggaggcgcggccacgacgtggtccctcggcagcctttacgggcacgctcctgttattaggagggaaaggattttttggtctgttttgttaactgtctgtgcaatgcctagtacacagtaggcgcataataaaaagtttgttgagtgaaagaatgacccctacgactggactctagtatttgggggcgggaccagatgcatagttctttgtaatagcgtagttctcttttattatgcctgtatgtgtagaaatcagcgagcactgggctttgtcgttttgaattttcaatttataaatgagcagtcaagttctgagttttaatagcaatatcatcagtcttattgacacattcatagaaggaagtttttggagattggagcaggggatgatatatatgggggcaaagctaaccatatctcagctaaaggagttagaggactgtctttttatgagttgttctgttaccttaacatctgtaggacaagaccatctttatattctgcattcttatgcacactgatttaaaaaattcttttttgcatgaggcaaaatttgctcttactgaagtatttacaatatcttgagggcatagcagataagatatccctaaagagagtagttgtatacagcaatacagagctggaaaaaaaagtataaaacttaaatttaaatgtaacaaacttaaatcttgttaggattaagataggtaataggcaaaacttgaatgagatataaaaacatttttagggtcagtttacctcgtgtaaactgacagaaactaaggtaaatgacagaaactaagaccaacctagtgcccactatatatcacattttgttcttataactctattatatatatataatatatatgtaatgtagaattatgtaatataatagtatgtaattatatattaactacaatgttatatattatttatatatccatatatagagagtaatctttatttttacaggttaactgacttgcctaagctttcacagctagtggcagagctgggatttatatcaagctgcccttgagtcaacagtattttatctcttactttttcgtgaaccagttaccactttattgagaacaaagtagatattccttagctgcagggatcgtgctttaagagtaattgtagtaatggtacatttggtgttaactatggtgtctggcgcacaggactttactaataagtgtctttaagttgaattgagtgagtgaaggtgcttctgttttgttaatctctgttgaattaaattgggtgaaatgatggtatatattttttttttttttttgagacggagttttactcttgttgcccaggctggagtgcaatggcatgatcttggcttgctgcaacctccgcctcccgggttcaagtgattctcctgcctcagcctcccaagtagctgggattacaggcatgagccaccttgcccggctaattttgtatttttaatagagatggggtttcaccatgttggtcaggctggtctcgaactcctgacctcaggtgatccacccgcctcggcctcccaaggtgctgggatatggattacaggtgtgacccactgcgcctggtcatgatggtatatcattaaaagaaagaataatacaagactttaaaaaatttaagatagtattgtaacacattctgttaaaattttaggctttttcttttgtcgagttggtcttatcccttcatcatcatgttttcagccaaagctggagggagggatgttgggcagattgttccttaattttggtttggattggtcatctctaagttccttccatttctcagattctgaagtactgtttgtatttagtcttgctaggacaccatttttggtgcttaaccattacatgagacaagattgattgactttcctgaagccttcttgttctcatatcccatggtgcatttgtgccccaaggagagagtaaccgaaatgatcaaaggaaaaaaaaatcataatagactcctagccatgtaaagaccagttgtccaccttcagaaaccaattttgtgtacacctttgctttctattttggaccactgcatacaaatggaaaacaaaatcaatctaaccaacttctacatagctatgtaatactccagggtaacttagttgagtactaagttgagtacatctcttagtctcttgctcttaaatcattccttctgtaaatggtctgagctctaagcttactgattatgggtgagcataattatcttcacggaatactcactagaagcattattgtactagatacaatcattaactttaaaaaaaaaacacaaaactggctgggtgtggtggctcgcgcttgtaatcccagcactttgggaggctgaggtgggtgggtcacttgagtctgggagttcgagaccagactgggcaacataacgagaccccctctctataaaaaaaatacaaaactgccgagcatggcggggtgcatctgtagtccctgctacaagggaggctgaagcagccggattgttttgagccccggaggtggaggctgcagtgagctgtgatcctgccactgcactccagcctgggcaatagagtgagactctgtctcaaataactaacttactaactaaatgaataaataatccccctatcactgcccccaatactaggattgtttagtatttatctttgtgatgggctgttagcagagaggaagacaaggccagctggtagtctttggaattttttttcttttttccttcctctagtaataacagtaattcacatttgtcgagtacttaatataagatgagacagctgaggcaccgttaaataactcacagttaggagaggtgaaataactttttaatatcactcaaccagaaaattgctgagcctggattccaccccagcattttcactccagagcctgttctttcgactgctgctctaaactgctcctggaatgactttgagatttgaaaaaggggtgtgtggaggactgttgagtgattctttcacatgcctgattatttttttaactgatatgttagtatggttataaggttttaaggtaacattggtaccatcttcagttattgtgggtgttaccagacctttgctttcttgctccatgtttatattgcagcttttcatattccttttaaaatgatttatattcaataaaagatgagacagctgtttatagttgtactaaaaagtagaatctggaggcatttaattctgatcaaacttttgctttgtaaacaaagcctgagtagtaattaatacccgatggcgttgacattttcatttcactgggtaaaaaggaaatctctaattttctattcaagtttagtgtgaacctggagggaagaaatggtgtcagatcagttacaggcaggtgtctaaggacttgctccttcattgttgctcagagtagccaccagccgcttgtcagccagctagagactgagagcctgttaaaagctcaaactgaaatgacagcctctagactttattttcctttttttccagaaagcctgaagcaaatttggttagaaactgaatgtgcttaagtgtcccaacagaagattgctttaagattagttcttggtaatccatgaaattgacctctcctcctgctgcaaaccattgcacacacactgtaattattttggcatccttatccttgttaacatattctgtttttaagttgcttttctcactgaccactatttcacttacatattttcaatatcaacacagacaactgaacttttttgcttgtattctgcctaaaaaaattttgggaaaccatgtacaatgtactttaaagtttatatctaacatttttatcaatggatcagagaatttcaaaatataaaatttccaacatattgtatatattgactttttaaataaaaacacaatttttataaattgattttttcttttcctttttttttttttttaaaaaagaaactgggtctcactttgttgctcacgctggagtgcagtagtgtgagcaaagctcactgctgccttcaactgctgtactcaagggatcctcccatctcagcctcctgagtaggtgggagtacaggcgtgaaccaccatacccaactaatatttttatattttgtagacatggtctcactgtcttgcccaggctggtctcaaactcctgggctcaagcagtcctcccgcctcagccacccaaagtgctggggttacagatgtgagtcaccacacttggctctggatggattttaaatactagagtgatttgatatttgcctttagccatttaaaaatcacattaataaattatttaggctgggcgcagtggctcatgcctgtaatcccagcactttgggaggctgaggtgggcagatcacaaggtcaagagattgagaccatcctggccaaaatggtgaaacccctctctactaaagatacaaaagttagctgggcatggtggcgcgcacctgtaatcccagctacttgggaggctgaggcgggagaatcgcttaaacttgggaggcggaggttgcagtgagccgaaattgcgccactgctctttaccctggagacagaatgagactccatctcaaaacaaaaaacaaaaaacaaaacccaactctttagtagtgtgaagatttccattgtttcttattcttttttacttgtattttaattccccatctcccacagaaccttattcaacagaatatatttcatacttgaaagttttttagtggttaccatttcatgtcttcctgtaataaatgttgacttaaaaaatgttatataactctacaggcttgggtgctactttttcttttagattgaattaagattacattgattaatatatacagttattttgatttgcaattttttttttttttttgagacggagcctcgctctgttacccaggctggagtgcagtggcacgatctcggctcactgcaatctccgcctcttgggttcaagcaattctcctgcctcagcctcctgagtagctgggactacaggtgcacaccgccacacccggctaattttttgtattttagtagagacgggatttcaccgtgttgctcaggctggttttgaactcctgaggtcaggcagtccgcccgcttctgcctcctgacgtgctaggattacagacatgagccaccgcgcccagccttgcagttattaaacataaaggtaaaacttcattgtgaatgagtctcattttccctagtgagtttgagtatccgtggatgaacattacttattgcctgcacgagataggattcagtgtcaattcttttcctaatttttgattttatagatgtaaggattgagaaacattgttcacataaataggtagatgggaatgttggagttttgccatatcaatgtcactcagttcattaaatatctctacttgtatgccaaaaagttatttttaaagtattttaagaatctgtcaagtgatgactgtattaggttctccatcactttgattgaaagcaaataattggaactacctgatttgcaaaaggacatattacatgttctttagagttacacatcctcaacatctatatttaaaattatcctattgttgaggcttggggaatacagccagattgagaatggctgaaaagcagttgtgctgtcttcaggtgccttctagggtagactgcttttgggaaagaccgtggatcttgaatatctggaagttgattccctgaaaaacatactgctcatatactccttggaaaatctttctgaacccctaggtatgtgcacactccgttttgaggacagctaagatcatagcccctttgtttcttagtaagatggttcattgcatgaattcattcagagcttttttgttttctggctatccatcatttgcagaatatggtttccaggttttgtcattcttaatagtgttactctctttgttttaaactgctgctaggatggaaaatagctcgctcataaatcgataccactggcatgtgttttctggaagagtaggtactaagtcattgttggttttcttattttttttccagaaaaagtagtgattactttttacagcactgggcaagtgacctctagagaggttacgtaggtcatttgatcctaaccacaccatagcatgacttaactagcctttttctagaaattaggtggttgcaaaggtgttttctattcagatgtcactatttcttgatgcactttgaagtatcaaagggagcaataaagaccatagtgacacatagtaatttctatttgatagaagctactgactaacttattacggcactggattagttctctttgattttttttttcttttgttagaagccctgtgtgtgtgtgtgtgtgcgtgtgcgcgcgtatgtgtgtgttgaggtgccagaaataagtactttaatactttttctcttggatggaaataattaacagctttgttagtctgaaaattttctacaaaggtgtcatggggcagtgcatggataatggttatggagaatatttcacttttgagtgggttttgtcagaggatgctgaaaagaaatacaaactgatgtgtgtgttttatcttgatgctgctaggatgctgttgttataatctgaccaacctgattttgtaagccttaaattgcttaaaaggcaattcctgtgaagaacaacactgccaaggatgctgtttcctaccgcccatatcacatcattggtgtgtgtgcaaacagcacaacaatccaaaaaaaaataggagattaatggaatgcattccctgttgtaaaaacttaattctacctttgagtcctcttgccattaaggactgatacgaatctgtctgatccatatttctttagtaccaagtcaaacttacattgagggatagcaaacattttaatattaacctaagcagtctgggcatggtggctcatgcccgtaatcccagcactttgggaggctgaggcaggcagatcacctgaggtcaggagttcgagaccagcctgaccaacatgatgaaaccctgtcgctattagaaatataaaaattagccaggcatggtggcatgcgcctgtaatcccagctactcgggaggctgagacaggagaatcgcttgaacccgggaggcggaggttgcagtgagctgagatcgcgccattgcattccagcctgggcaacaagagcaaaactcagtctcaaaaaaaaaaaaaaaaaaaaaaattaacctaagcaaagcataattgggataataggctgttacaaaaaaaaactcatatgtattcttttggcttattatcagtgttgtgattcctctatttttgtatttaactgtgtcaagttactgacaccaagagtttgttaatagatgtatattctgtgaaacgaacatagtcatctattttggatttctgtaatttctggcttgaaaagaccattcacagttacatttggggaaaattaaaaaatatttaggccaggtgtagtggctcatacctgtaatcccagcactttgggagggtgaggtggaaggactgcttaaggccaggagttcaagaccagcctgggcaacaaagcaagatccctgtcaacaacaacaacaaaaaatttagccaggcacggtggtgcacgcctgtattcccacctactcaggaggccgaggcaggaagatttttaacccaggagttggaggttgcagtgagctatgatcactccagcctggatgacagcccgagactctttctcaacaaaaccccccaaaccaggctgggcgtggtggctcacacctgtaatcccagcattttgggaggctgaggcgggtggatcacaaggtcagcctaacacaatgaaaccctgtctctactaaaaatacaaaaaaattagccgggcgaggtggcaggcagctgtagtcccagctacttgagaggctgaggcaggagaatggcatgaacctgggaggcggagcttgcagtgaagcgagattgcgccactgcactccagcctgggcgacagagcaagactccgtctcaaacaaaacaaaacaaaaaaccccccaaaacctagtattctcaaaaagtttcatgcaatgtgaattttattgacatagtggatttggaattcatagttctttttttgagatgaagtctcactcactctgtcacccaggctggaatgcagtggtgtgatctcagctccctgcaacctctgccttctgggttcaagagattctcctgcctcagcctcccgagtagctgggattacagacatgtgccaccatgcctggctaatttttgtatttttagtagagatggggtcgcaccatgttggccaggctgggctcgaactcctgacctcaagtgatccgcctgcctcggcctcccaaagtgctgggattacaagtgtgagtcaccatgctcggcttggaatttatagttctattgtgaatctagagttcacattctagtgagctggattcatgatattgaggactagaatgtttcaacatcattttttccttttactacaaggctgataataaaatagagtgtctctgttcaatatttgggctaattgaagattagtcttatattattaaagaagtcttaatccctattacagatacattacacttcaattccttccaaggaagttatgatttttctgggagcaaaccttgatgaaaaaatgagtattattctgaagacaaagcttggcttcctattttcccttggtgtccttcactccattcccaagtgttgtgttttgttttgctgcttcttttctttttaaagtcagtagtactatgaatatgtaaacaactcctaaagttttaaaaccatttccttttcaattttttttttttttttttttttttgtagaaatagggtctacctatgttgcccaggctggtcttgaactcctggactcaagtgatccccctgcctcggcttaccaaagtgctgggattacaggcatgagccaccttgcccggttcctaaaacttttttttccccctcttattctggtagtcagccaagggaattattgaattaagatgtggccaggtgttattttatgagcacgtattttacataccttggaaagaaaaattaaacatacatgttgaattgtttttcatttttacaatatggaagtaaacttaaagtagagggtttttagagttggcagtggcggtggtgggggtgatggagggttcaggtttgagcctcagctgttttctgtccctggatggagaggggaaggtgctgtggaagcctgagaatgaatgtctactctggtgggtagcatgaacgtctgcagaggggaatctctgaaaacttgaggattagaggtgaagagttgtggacaaatagtaattgttatttcaaggtagtaaataaatttatagacaaatgaataactaagatataacctctcaaaaccaagtaagtgttctgctttttgccttactttctctcccaatttttttttttctggcatctgtgtgtttttcctctttctttcaggtgaaggtacaatgtggtggccgatgatggtggtgtgttttgcagtctaacagactggttagaatcctatcttctcaccccccatgtgctagttgtaaaatctcaggaaagttactgaaacttcctgagcctcagtttcctcgcctgtgaaaggtgattaaggatatctaccttacacagctgttgtaaggactgacattagatgaacacaatatatttactatatttatagtcactttgccactttgctgtcctctctcattcagggtcttcttttttgttgttgttgttgtttgttttaagacaagatctcactttgttacccatgctggagtgcccatggcatgatgatagctcaccaaagccttgacctccttggcttaagtgatcctcccacctcagccttctgaatatggggaccaaatagatgtgtgccaccatgcttggctaatttttttatttttatagagacgggattttgccaggttgcacaggctgctctcgaactcctgggctcaagtgaaccacctgccttggcttcccaaagtgctgggactacaggtgtgagccactgcacctggccttctcttgttacagtgtgtaggtcagatgcaaactatatactcattcatacatacacatgaacatatgtgtatagaatatttagaatcttattatttatggaatatgtattatctttcttcattaaaaaattttttaaatggcttgaagcatgaagtctcccagcttttgctgagggggggtctctctgtgtgtggggtatgcttatgctttcagtgctctgctaggaaatttacacctctgccttagtgtttacttcctgcctgtgcagagccttaagggcagccagaggtgagatattagggccttctcagatcttttctgcgcatgaccacagccttggacatgtgtatatcttccagattcccagtaatgtcaacgttctacaatgccctcttgaacatcttgttcctcagttttttcctttaaggtttttgtcagtttttttttttttttttgagcctcacctgatccttgcctcaggtagctgtgattttaaacccttgttgctgattgtttttgacaaactctctggtaataggactgtttgcacagagtgaaatgagtctggtggataacgtcaaggcctgagaatggagtttttcacagagctgtcagggaggtcaaatggtgtcagcctcctgggaatggggcttttggcaaacttttctgccccttttagtggatccaaggatgctggttttcacagttaccatagttgtgaggctgttcgttttctttctttttttttttttgagacagagtctctctttgtcatccaggctggagtgcagtggtgcaatctcagctcactgcaacctctgccttccgggttcaagcgattctcctgcctcagcctcctgtgtagctgggattacaggtgcccaccaacacgcctggctgtttttttatttttattttttgtatttttagtagagacagagtttcgccatgttggccaggctggttttgaactcctgacctcaggtgatcagcctgcctcagcctcccaaagtgctaggattacaggtatgagccgaggctgttcattttcaaagcaactgcagaccagagtagagtggaatgggaatggggcacgttactgttcatactgagatttagctgttttaaataaacactccttggacttttgtgagtctttggctactttgcagagttttgaaagagtatatgttgacaatttttgtcagtgttcttgttgcttttgtagtagagtgggtttgcagaggtctttatcattctggaagtacttctattctattttttgaagcagccattgccactcttgggcatctctaattgttagaaacttcttcctttgggacaaaacacatcatgtcactctttaattctattatacgtaggccacagttctagtctttggaacaacagagtttttggctcagccaaagcacagaactctcttaaggttgaacaaaagaccgcaggggaagtttttaatatttaatgtgagcgacttactttttctgaaactgtcaatttggaattgatcacatatccatatcagtgtattaagaaggcaaaaactagtgatttagttacttagtgaaatgtgatagtctatcattttttttcctcttgtcctcagtgatccttgttctgattgtctatcttttcatgggcctgttttcatcattccttggaaaatttgagtacctgatttatagtttatattttttactacatcctgggtgacgtcagcttatatgtgattgacacacattacctcctgatttccttatatgatttcttcaattccaaactcatctcaagtatgacctttctcaacatatctccccttgtcatcaaaattaatccgtgtttcctttcctcccctttaatataaaaggttaaaagttatatcctaaggttaaaagttacaccctgaggttaaaagcttcatctattttgctgtcacatagtaggaaaaataccaagaagaaaataaaagtgccctttagtatcatcatccagaaataaccactgttaacatttgatgtatattcttttctcataaaactgggaagatgtcataagacttttaagtaaaaaaaaaatgacaatatgtggaaattataaggtatatgtatgcatttaaaactctgaaaagggtagaagaatatcaaacttaatctgtgtttggagtagagaaaatatagggattatgtagaactttgtctttcctttattcatattttttactgttgtgtattatcagaaacatagatatattccaatttgaaaagacgattctacaaatatattgtgattataaaaatagggaagacaggtaggcaagactgcacataaaaactgtaaggattatctctgggtggtgagattatgtggtattgtgtgtggtaagtgtaaacacgggctttgtggggcaagatgatcacttgagtttggacaggtccagtgcctgtctttttctccttcctccgctttacacatgcgcacacacacacaaacacacacacacacgcaaaaccaaaccaaaacaaaaacacacacacacaatttttttttcttctgaacctttgagcggtggatatgatgcgtctttacccctaaacacttcaatgtgtatttcctaaaagcaaggaaatcttttataaccattgcacaattatcaaaatcaggacattaacattgctacaattctatttaaccttacagaggtttcaccagatgacccaataacgtcctttattaggcttcgagtcttgagcaatgatgtatggatgaagggacacttaagagagtcttcactatggcagttaccatggcatcctaaccactctagtctacttctctgattgttcctgtggctgggttctcagctgcctgcttcctgctcattttttattcagcctatttctctaaacttcttgtcgattttataagctactagaaattcttttagtaaattccttttctacctaaattagccagagttggtttctatagtttgcaaccaaaactctagtaaattacatttccctcccacacttcatatttcagaatcttattcattttcacatgctcacctcaaatgccacccttttttttgagatggagtctcactccatcgcccagggtggagtgcagtggtgcgatctctgcttattgcatcctctgcctcccgggctcaaacgattctcctgcctcagcctcccaagtagctggattacaggctcctaccaccatgcccagctaatttttgtatttttagtagagacggggttctctactggtctcaaaatcctgacctcaggtaatccacctgccttggcctcccaaagtgctaggattacaggtgtgagccaccatgcccggcctcgccacctttctttctttttattttttccttttttttttgagaaggagtcttgctttgtcgcccaggctggagtgcaatggcacgatctcggctcactgcaacctctgcctcttgggttcaagctattctcctgcctcagcctcctgagtagctgggattacaggcgtgtgccaccatgcgtggctaatttttgtatttttttttttttttagtagagacggggtttcaccatgttggtcaggctggtctcgaactcctgacctcatgatccgcccgcctcggcctcccaaagtgctgggattacagatgtgagccactgtgcctggccttcctttttatttatagtaatttgtagttttaatttgatagttttccttaatgaatattctgtgagcaaagtgcttctttttttttttttttttttttgagacagggtctcattctgttgcccaggctggagggcagtggtgcagtcttggccttggcctcccaaaatgctgggattataggtgtaagccaccacgcccagccttcagaggtttcttcatagagattgccgcccatcactcttcatctcatacctactttattttgataccatttatcactacctgaagtgatggtgtcttatgtatttataatagcattataaagtattccttttttgttgtttgactcctctggtggaatgcaaacttcatgggtgcatggaattggtcttgttcactgctataatccaagcacactgactaatgcctggcatagtatcagctctcagtagatatttgttgtgtaattgaataaaggattttgtgtttaagcaagggattacttgcagtattctggaaacattcacatttattttctggtagcaggttttatgcttttcctgttacgattaaaaccagtgaagggagaagaggtttagcttacatctgaaatcaaatccactctctgggctcctctctggatagagtcctctattttgccatcaataaaaagagccagaatgagtttaaatttccctggccaaaaacgtggcatctgtcagaatttctaacacatgttttctttctttgatgcccttcacagcctgaaggtgtatagattaggtctttttagttgctagcagcacacaataagcagctgtttacttttaatatttaactgctcacctggccttttaagcctggcgtgattgaagggatggcaagcaacagaggcttacagagtaggggcaagaataggacagtgttccagaggtcagagagtttttttattttcttccatcttttgttagagtctgaaataaatggtgacacctaagaggaggttaagaaattgtgcactgaatctcaggttttgcaagaatgaatgaccaggctttctctaccctgacagcatcatcaagaggaaggtgagaggtgggctgcgcctgagctctggtgtgtatcggctatcattatgtgatgtggccaagagagatgctgccgcaacaactgttactaagattactagggaggactcggccaagatgaggttagcccaccacagcctatttcttttgctgatagcaaccaaactcagtgggcagattacctgaggactcagaaaagtaaagaaaagctggcagattgtgaagtgaaagcctggagtagcaacctgagtgggggatgagaggggtaagtttctcattgttcttttcctttttttttttctgagaccgagtctcgctctgttgccaggctggagcgcagtggcgcgatctcagttcactgcagcctctgcctgggttcaagcagttctgcctcagcctcctgagtagctgggactacaggcgcacaccaccacgccaggctaatttttgtgtttttagtagagatgggggtttcaccatgttggccaagctagtcttgaactcctgaccttgtgatccgcccgcctcggcctcccaaagtgctgggattacaggcgtgagccaccgcgcccggcctcattgttcttttctatctggctttgagccaaaggcaagctttcagcagagctgcagtggtggtacagaggtagcaaaaatccaagagaaatctcatccttccagccagaaggtcaggaaaatgtaagctggagagtgtgtgtgtgttgggggaatgctttccttttttaatcacagtgggcagaatccttggagtctttaaaattctgtgaagcagagagataatctcatacttatgcaaaaggtgtaaggcaaccataatgttagtattctaactccaagggaattttaccagcatgcagatgttcaggcttgcatgtcaggctgtggcccagcctcaaagtttgtgtacccttcctgctgcgtagtcctgatcctgggatttgcattttgttctgatggatggggagctttgagaaaatccacctttctctaatacaaggtaaaagctttctcccttctgtaggcgcctttgctgccctttcttttaattaaatattttttcctccctaatgttgggagagcttcctaaaggtcacaattgaaaagagctgcagaagggagatgcagattatagtagtattctgtcttgtcatggggaaaattgtcttgttaattgttctgcctctgaaaaatgttttcttatttctccattctggttaaaattgtcaggattggaaagaaggaatttttgctaacatggggccatgatgccattcatttgatgtctgaggagcaatagaaagcagttcagctagaaaagaagggcatgccagccaaacagctttcaaatgtcatgcattgtgtggcaggagtaggttttaaatataatgcatgtacttgtccttattgcaaacaatgccgtcttattccatctacaaaatatttgcacttgaattctctaagtacaaattttgcagtagttgtcatttgctttctatggactttaagaatgctgcttgcacaagtgctgtgggtgctcacttctttttcatgttaatgttgccatgtggaagtgctcttattttattttattttatttttatttttgagatggagtcttgcgctgtccacccaggctggagtgcagtggcgcaacctcggctcactgcaacctccacctcctgggttcaagtgattctcctgcctcagcctccccagtagctgggattacaggcacctgccaccatgtccagttaatttttgtatttttagtagagacggggtttcaccattttagccaggctggtctcaaactcctgacctcaaatgatctgcccaccttggcctcccaaagtgctgggattacaggcatgagccaccttacacggccatgtgtaagtgctcttaaagatacagaaaataagccaggcgcggtggctcacctgaggtcaggagttccagaccagcctgaccaacacggagaaaccccgtatatactaaaaatacaaacttagctgggcatggtggtgtgtgcctgaaatcccagctactcaggaggctgaggcaggagaatcacttgaacccgggaggcagaggttgtggtgagccaagatggcgccattgtactccagtctgggcaacaagagtgaaactccgtctcaaaaaaaaaaaagatacagaaaatattttttagctgagtggggtggtgtgtgcctgtagcctaagctacttgggaggcgacagagcaaaactccatctccaaaaaaagaaaaagaaaaagatgcaattttttcatagaaaaattcacccaggccacaaatgagaaaagataggcattttatagactcttcatcggggaagaactgaaaaggagaataaattcaaaagaggagcttcagatgctggaaagctagagaagcatacatgaaatcattttctgtcaggtaaagtgtatatgcagaaaaagacttttcagatgcatggcccagtgattcattcctcaccatttggtcagtgtgtgcatatagactgtctccatataaggtaggtgcttaaaaggaagagaattttggtaggtccatttgttttttaatacaaaatggcaaatcaaacagcttttactggttagggctggagtttggcccttttcttataaaaacaagtaaaaagttatgtggagattatatcttgtgtcttacgaaatttggcctaatttcatttacagcttttcatgacaaggagagtaaggtcgtaattcagtcaaggggcttgaatgatgtgatatgaggagcttttatgaaggcatacatagctttatgaagttacagctgcccatctgtaagtcagagcaagtactaatgaaagtgcagtgagaattgaaatccatttcagaattgtgaggtggtgtgagaagaggggatgttctgccagatgatggcattaaccctttagttaacaaggataggtgcttagaggcttaaaccagatgatctacatgctttaagagaaatagtattgtttcaaccaaatttctaatttgcctccttggatttatattgtgcaaccaacttgtaaaggcatcagtaagaaagttctaaaagcagaaaagaacactatccttttaaaacctctatttttttttcttttttttttgagatggagtctcgctcggtcacccaggctagagtgcagtggtgtgatctcagctaactgcaagctccgcctccctggttcacgccattctcctgcctcagcctcccgagtagctgggactacaggcacccaccaccacgcctggctaattttttgtatttttagtagagacggggtttcaccatgttagccaagatggtctcgatctcctgaccttgtgatccacccaccttggcctcccaaagtgctgggattacaggtgtgaaccactgcgcccagcctaaaacctctattttgaggcatggaaaaggtgtttaaaaaatcaagactcttttgaacttgttgtatgcattaaaatgtaattgcatacaaaagaactgcttaagactttgcaattctatttttctaagttttgctacaataaatagtcatgtattgcttaatggggatatagtctgagaaacatgtcgttaggtgacttgtcattgtgcaataccatagagggtacttacataaacctagatggtgtagcctactgtacacccaggcggtatggtataacatattgctcctgggctacaaacctgtacagcatgttacggtactggatactgtagacagttatatcacaatggtaagtatttgtgtgtctaaacataaaaaaggtacagtaaaattactgtgtataggatgagaaatggtaaacctgtatggggtgctttccatgaatggagcttgcaggactgaaagttgctctgagtgagtcagtgagtgagtggtgagtgaataggaaggcctaggacattactgtacactactatagactttataaacactgtacacttaggctacactaaacttatgctttttttaaataattagccctagtttactgtaattttcttactttataaacttttaaatatttttacctttttgactcttgtaataacacttagcttaaaacaaacacattgtacagctgtaccaaaatatatctttataagcttttgttttctattttaaaaatacttttctacttttaaaagatttttcttaaaaatgaagacacaaacaattacatccattagcctaggcctacacagggtcaggatcatcaatagtaagcggtgaagccagctggacttactgggttgagtggggacttggagaacttttctgtctagctagaggattgtaaatgcaccaatcagcactctgtgtctagctaaaggattgaaaatgcaccaatcagcactctgtaaaaaaaacgcaccaatcagcgctctgtgtctagttagattgtagatgcaccaatgagcactctgtaaaaacacaccaatcagcactctgtgtctagctgaaggattgtaaaaaacaccaatcagcactctgtaaaaatgcaccaatcagcactctgtgtttagctaaaggattataaatgcactgatcagcactctgtaaaaatgcaccaatcagtggtctgtgtctagctaaatgattgtaaatgcaccaatcagcactctgtaaatggaccaattagcactctgtaaaatggaccaatcagtaggacgtgggcagggccaaataagggaataaaagctggtcaccccagccagcagcagcaacccactggagtccctttccattctgtggaagctttgttctttcactcttcacaataagtcttgctgctgcacactctttgggtctgcactacctttatgagctgtaacactcaccacgagggtctgcggcttcattcctgaagtcagcgagaccacgaacccaccgggagaaacaaacaactctggacgcactacctttaaaaactgtaacactcactgcgaaggtatgtggcttcacttctgaagtcagggagaccacgaacccaccggaaggaagaaactcgacacatctgaacatctgaaggaacaaactctggacacaccatctttaagaactgtaacacaccgcgacggtctgcggcttcattcttgaagttagtgagaccgagaacccacaagaaggaataaattccggacacaatatcactgtcttccacctccacatcttgtaccactggaaggactttagggtcagcaaaatgcatggagctgtcatctcctatgtaacaatgccttcttttggaatagctcctgaaggacctgcttgaggcttacagttagcttttttaagaagtaagtagaatgactgtactctaaaataatggtaaaaagtataatatagtaaatacataaaccatttagtatcattgtcagtattatgtagtgtacataattgtatgtgctggacttttatatgactggtaatgtagtaggtttgtttacatcagtatcgccacagacctgtgaataatgctgtgcactatgacattattttcagctccattataaccttatgggaccactgttgtaaatatggtccattgttgaccaaaatggtatgtggtgcattacttagttgctagacaatggagtttttaataattttagaaccttaggcttactggccaggctcagtggctcaatcctgtaatcccagcactttgggaggctgaggtgggtggatcacttgaggtcaggagttcgagacctgcctggccaacatggtgaaaccctgtctctactaaaaatacaaaaattagctgggtgtggtggcatgcacctgtagtcacagctacttgagagactcaggcaggagaattgcttgaactgggagatggaggttgcaataagctgatcgcagtactgcactccggcctggatgacatagcaagaccctgtctcaaaaaaaaaaaaaaaacaaaaaaaaaatcatactgaaatcacttatcttggttaattggcatcttacgagaatgggtagttatgtggggatagggacattacctgaaaaatcttaggtgattgatattttctcttttgaaatgtcattctttggggaatctgcttaactttatggaacagggatgagatctccatgctgtttaaaatggggtggtggtgtttgctttgctttgtttcattttgtatgagagctcagttctaggcttttggatgaattgttaataggtgaacagagtgggtggatttgagacgggtggttggattcattgtaggtgagaagctttgtcaaatgatacctttttttttcccccttgagacagagtctcattctgtcatccaggaatgcagtggcataatcacagctcattacagccttgacctccccaggctgaggtgatcctcccacctcagcctcctgagtagcttggactacagggatgtgccaccatgcctggctaatttttggtacttttttgtagagatggggttttgccatgttgtccgggctgatcttgaattcctgggctctagtaatccacccaccttggcctcccaaagtgctgcaattacaggcgtgtgccaccacacgtgggtgttggcaagtgatattttggtgaacctgagttatttagaaggtaatggtctagaactctgaatgtgaagaagaaacaaaccttttgtttttgaccaaacggttacgctggtttaaaatggaccactcaccagagaagggaattctctgagtatttaatttgtttctgattacatactccatagcatacaagcaggcagagacacttggctttagttagtggagaaaagtttgttgactggatcaaaaactcctgttggtaatattttttaaagattcaggttacattttgtagcccaggagataaatattgctgagatacttttgactgaagtgtggtatgaagggaaagggggaaatttgtaagaaaaaagagtcatgtggccacatgcagagaatcaagtaccaggaagcagataattgaccaggtgagatggagaggtcagtacccatgcgagcccaactcagtgtctattagtattgtaagtttactacataataagatttttaaaagtctgttgttttgttgatctgatagtactgtgcacttcattctaatgcagaacctaggagagataagttgctttccggttttgtttttgtttttgttttttgagatggagttttgctcttgttgcccaggctggagtgcaatggcacgatcttggctcactgtaaccgagtagctggaattacaggcgtgcaccaccatgcccagctaattttgtatttttagtagagacggggtttctccatgttggtcaggctggtctcgaactcctgacctcaggcgatccgcccaccttggcctcccaaagtgctgggattacaggcatgagccaccgcgcccagccgctttccagttttatgtcacataatggttactgttcagatctgagggtgtattatttgaaggaaagttaagagtgcatctaaggagccaggaatgtactgtctccaattgttgattctgctaacgaatggtaattactctttcatgcctctcatttttatcattttatctttgaaataaaataacacctatgagaaagatataaggacttggagaaggaaagggatggagtgaagatccgtgtgagacgtgtcattgaacattagctttgtgggttggtttacctttttgtctgttagagtctctctacccacttttttttccctcatgtgttgctgtttctgagcaagactgagagctgacaactgttacttttttattcttagctcctaaagaccgagggtggaatttttagttagtttaatttcccaaattatcctaaaacagtgagattgtattataataaaacatttttggatattttgtggaatttttttatttttttttattttttgagatggagtctcgctctgtcacccaggctggagtgcagtggtgcgatctcggctcactgcaagctccgcctcccgggttcacgctattctcctgcctcagcctcccgagtagctggactacaggtgcccgccaccgcacctggctaattttttgtatttttagtagaggtggggtttcactgtgttagccaagatggtctcgatctcctgacctcgtgacccgcctgccttggcctccgaaagtgctgggattacaggcgtgagccactgcgcccggcctattttgtggaattttttaaaaagtgctcctttgttatctttttccttatgataacagctttgaatgggatttgactgtgatcctttgttgttgctcatcttcatggaaagccagttttcccagcttttagaagggagacacactgttaaggacagcttttcaggcttcaggactctagagtaccagaagtcttctgttgtcttgaagtgattaaaaagatggtccctgcttctcaaatccggcacccctcaccccctgtatctgacccttcctttctgtttatcttttattattcctcttctgctcaatttgaattctgcccccaggagtttttcttcagagtggagttttgtctggcaaaagagcttttggccagttagttttgagaggtcaaggggccacattctcagctccttcagccttagctgcaaattccttgaactcaccagctgttggagtagacccaacatatttagccgctgttcccagatgggcccgctgaactttccagttgagtgcctgttgtttgttttgggatgcccaggtctgtcagatgctgcattgatcccatctctgcttcctctcacagacactggtacctaccttacaggtcttgtgactattggtgatttgtacctgttcatctttgggactttgtggagatactttgtcacctaggcttttgtggctgtttcccatggatttttgattttgttaccctagttgctctttgtattttttatcaggggacctgggaaaaccatactgctgctgctgccatcttcccagaatcctcaaacgtggtttttgtttttgtttttttttttttttttaatgagatggagtttcgctcttgttgcttaagctggagtgcaatggcacaatcttggctcactgtaatctctgcctcctgggttcaagcaatcctcctgcctcagcctcccaagtagctggggttacaggtgcgtgccaccacgcctggctaatttttcatatttttagtagagatggggttttgccatgttggccaggctggtctcaaattcctgacctcaggtgatccgcccatgttggcctcccagagtgctgggattgcaggcgtgagccactgtgcccagctaaatgtgtttttcttttttaaaatttcccattgttgatctccccgggttttgttttgaacagctgttatctcttggttagaagcacgttctttgctaataccaaggcaggggataatgtgagttccctctgttcttgaggttgggaagagtcagcaggcggaagatagcagccgttccttcagtaggctcatctcaggccgtgagtctacatctagagcagaactgtttctcgctcatgggtcctcgtacatactcttccctcagcctgtgatgtcatcctcctgcttcccactggctcacaagcctggtcctgaagatgtcccccattcccccttctcccccattggtgatgttttttctgtgcttccgtaacatcttgtgaatgttttatagtagctgatatcacactatatatgtttacttctccgtgtttcccacagcactgtgagttcttgaggcctgggcccttggcttattggtctttgtattcccaatgcctgatccagtgctggaagtcagtaactactcaggaaacactgttaaatgaatattggcaatttagtggtgcaaggagcaaaagtagctctctgtggacatattgcaggacagacaaatgtaacaataagtgccacttagagttgtacttaaagaaataagtttatcctgggaaggaactatcaaggtgactgtttttattttcattttatttaaaacatttggccaggcccagtggctcacacttgtaatcctagcactttgggaggccaaggcagatggattacttgagatcaggagtttgagaccagcctggccaacatggtgaaaccccacctctgctaaaaatacaaatattagctgggcgtggtggcgcgcgcctgtaatcccagctactcaggaggctgagacatgagaatcgcttgaacccaggaggcagaggttgcagtgagccaagattgcgccattgcactccagccggggcgacagagtgagactctgtctcaaaaaacaaacaaacaaacaaaaaaaccactgtgataggaggagacactggtcaggtccttagtatgctacattcattttgattataaccattaaaaaagctggtggggaatttaggaaatttaaaacagaccatgacaatgattaagaaattggaaatttgtgcttataaaggaaaaaataatggttaacttaggtgaagagtaaacataaccccagaacctagccgtaggacagactggtgcaatgtgatttctgcatgttcttgcttgagggcagaggcttgacctatctaggttccttctagttcagtaatgctttacttgttaaagttctcttcctctggcgacttgagagtttggaaaatatcttcaagtgggccagaagacagctatttaatggtctgatttttctggaaagtggaatgtgatgacattaaaacctgagtgactaaggaaaccagacttacgctggtagataagagagttgaaaatttaactgagacagagacaaaagaaaatctggccatttgcagcattaagcatatgcagtgaaatcccagcaaaaatggaacagagaggcagatgtacctgaagcatccctttccgccttcagaaaaacagtaaatggtcagtggcaatggttcaggtaaatatattttgcacaccaagatcacccagaaatgctcagggtatttatataaagatattttttatacagatgacctttaatcatatgatttaacaaaggaaatgttttacttataggccttctagttgtgtcactacttattgtgtgtgtctgtggattaaatagattggcaaagcaaaacggtatcttttctctcagatcataaccacgtcaagaagcaaattgtctttatataggaccatttaatgccttctttactagaaaagttgttgatggtaatctagctcatagactttacctgggagttgggacttgcaaaatggcttaatttggtaatttccaaaccttgttaaaaagcttcagaagtcccaaattcttataagaagctcattttttaaagcagataaaatgaaactgattctattgccatttcccccttcctttctacaaggactccctaaaaggacctccacaaactgtagtttaaaatcactaattagtccaataaaagttactccagtctaatttcccaaattatccttaagtcattgaagcatagaactcgcaaggtcttgactttgagaaatcccatagtctgtccctggtgtgggctgcctacagatgcaaattaccttcctgtgccttccagttttagccgacttggaagcaaaatgacacacatgagaaagatataaggacttagggaaagagagagatggaatgagaggcctgtgagatgagtggttgaacagctgcactgagggttgagttcccattttcttggttgtgggatgcctctctcctcccttcccctctgctttttccatatactgaccacaaggaaggacagctgtatatacttcttttgctagagaaacagttgaatttgactatcatgtggatcattttattcccattcttaatggccacagtattttggagcccaattatttattattatgtacattgttctgggatcaagagataattcacatatatgccatatactgcatttattaattttttcaaatatgatcatgcatatcttatttaatatacaacatatattttatttaatacacaaagacaaatggaaacgcccttttttgtatatccgtatccttttttattcaatgttttattgaaatttcacttcttgaaagaattgtttttgctagcgtagttccccctgcctttttttcctttttcgtataggcctagtaaacaaagttttttttgagacagagtcttgctctgtcacccaggctggagtgcagtggcatgatcatagcttactgcagccttgagctcttgggctcaagtaatcctcttgcctaggcctcccaaagtgcaggtattataggaatgagccaccatgcccggccctagcacacttttcaaatatcgaaaactgtcattgaattctttaattatgatggtttatgagtttttctattgttaaaaagataatgttttttaatagtgaaaaaagtagtgtaagttgttgcttatggtccaaatgattatataagataaaaatgaccttaataggtttacaaatataaaagttggcaattaactattaatcagttatatattttaaagctcagtaacattaaacattttgaaatgggctgaattagtattatttttcagttatacacattgtaaaattttaattgagaatatttgacattagtaatcactgtgattagtttttggtgacttttttgttggagggtttccttaaatgtgttctttctcatttctttctattctacctattcacctctatgatataatttaccttttgtgaggaacataggaggtgggtgaaaaatggtgtgaatgtttttgaactccttactagcttcaaaacaggaaagccttttctatacctttttgctccagaagaaagtagaaccagggacctgcaaaaactaggttcttaaacataaaaggctttaaataggatctgttgtctggttgttatatgttattagtattaataacttctgaaattttactggctcatctgaaggctcttggtgatagagataatctgtaagtattctcttggcaacttcttttatttatttatttattttggaaagaaaaggtaggatatttaatgaataaggttgtccaaatatactgttcataggtgggccagttaaattaagcagattataaattaatgtaaattattgtttatttattgtaagttaaataggatggtagcttcagtaagtaaatctttttattgtttctgttaagcatatggttccttttgtctagtcagtctaatccatattaaaggtaggggcttgaagtttctaactattattgttaaactttctattctcccttctattctgtcagtttttgcttcatatattgtgaagctgtgttcctaggagcatatgtttatatgttcataattattatgtttcttttttttcttttaagagacagggtttcactccattgcccaggctggagtacagtgtcatgatcatagctcactgtaacttcaaactcttgggctcaagtgctaggactacaggttcatgccaccatgctcagctaattttttatttttatttttgtagcaatgctctctatgttgctcaggctgatctcaaactcctggcctcaagcgaccctccctaccttggcctcccaaagcattgggattacaggcatgaaccactgtgcctggccctattgttatatctttttgattgacctttttattattatgtaacagccttcttggtctttataacgatttttgttttaaagtctattttgtctgatatttatgtagtcatgctagctctttagtgtttgcatagaatttttttatgctttttctttattttactgctacttgtatctttgaatctaaagtgaatctcctgtagacagctgtagttggatattgattttttaaaaaaatctatgttataggcccagcaatacaattatacacatattgttttatagaattgcttttaaaatcagtaaagggaagacaagagaagaaatatgcatttatgtgatattttatagttacataattactggttttttcatgtggatttgtttttttcatgtggatttgaattgctgtttaggaccacttgtttttagtttgaagaactttgttagtgtatcttgtaaggtgggcctgttagagcaaattttcttacgttttgtttatctgggaatgtctttttttcaccctcacttttgaaagatagcttttttgtatgtaggattcttggctgacagtttattttttttcctagcaacactttgaatatgttatattattgccttctggcttccgttgattctgatgagaagttagccattaattttctttgggttgccttgtgatgagttggtttttcctttttcttgattttcagtgttttctcgatggtctgtgtgtgtgtgtgtgtgtgtgcgcgcgcgcacgtgtgagtgtgtgttttaattttatcttaacaaaatggagtgggtctgcagaatccttgtttttggcttttagcttttttattatgtatctatgaatctctttgcatatacactagaagttcattgagcttcttggatgtataaaggtttttcatcggctaggcacggtggctcacgcctgtaatcccatcactttgggaggctgaagcgggcagatcacgaggtcaggagattgagactatcctggctaacacggtgaaaccctgtctctactataaatacaaaaaattagcctgccatggtggcacacgcctgtggtcccagctacttgggaagctgaggcagaagaatgacttgaacccgggaggcggaggttgcagcgagccgagattgtgccactgcactccagcctgggtgacagagcaagactctgtctcaaaaaaaaaaaaaaaaaaaaaaaggtttttcatcaactttgggaagttttcaggcattatttttcttctttttttttttctttttaagagacacggtcttgctctgtcccccaggcttcagtgcagtggcacaatcacagctcactgcagcctcaaactcctgggtcagctgatcctatcacctcagcctcctgagtagctgggacaacagaggtacaccaccatacctggctaatttttatctttttcgtggagatagggtcttgctatgttgcctaggctggtcttgaactcctggcctcaagcaatccttctgccttggcttcccaaagtgctgggattacagaagtgagccatggtgccaggcccacccattattttcgactatttttttctcctgtgataggtgattttttcttccaagaattttgataggtttaaattctaatctgcagtacctctgagtgtgatcttatttggaaataggttgtttgcagatgtaatcaaagataaagtaaggtcttacttgattaaggtaggccctaatccagtataactcatgtcctcataagaatggagaagatgcacacccatagaggagaaaatgccatgtgaaaatggcaaaggaaggaatgctaaggttgccagcaaccactagaagctggagaaggtcatggaatagattctccctcagaacttccagaaagagccaaccctaccaatacccagatttcagatttctagcctccagaactgagagagaaaaacatttctgtggttttaagccatctaatttgtgatactttgttatggcagctgtaggaaagtaatacggtaccaggaaatggggtgttgctctaaccaatacctaaaagtgtggaagtggctttggaattgtgtagtgagtaaaagctggaagaattttaaggtgcatgatagaagcagcctacgttgtcttgaagatactgttggtagaaatatggacattaaaggcgactctgggtaggtctcagatggaaatgaggaacatgttaatggacactagaggaaaagcgtgcctggtttgaaagtggcagagaatttggctgaattatgttctgtacagttctaatatgaatatgtaaggggccgtcggctcttctgtttggagaatgacatggagttatcatgacaattcttattattagaaagttgattcatttttttatttcattttttcattttcattctgcagagcaggtgaggtcaaaaatgacccttgcctattggaaaagctgcaaaacattaagctactctttctagttgaaaatctcaatttgttttaaatggatttgtgtgtgtgtgtcattggacaagataatagctcggcagtagtttgattatataataggtcttcagcttattaatctaaatggattcctgttaatctctgaacaatgcaaccagtgaccgatgtccaggtatgaactattacagtgaaaaccaccagactaattttgtaacaatatttatatgaaaatgatgcctttatctttatagttttcaccttgttttctgatcagtattttatttgctctgttctttttctccatattgaggctttgcatatttttattttgtctcacatctttgcacaatgaacctataaaacctctagtttttaagatacatctttcagttacatcaaatgtcttctaaacttttttattattatattacttcttactactctcttgtgaatgaaggctaatgacaactctgtctctgcatttgtgtaggggtaatgagatccttgttcagtggttcttctaatttggggactggtgagttattcatatgcataaggatcagcctattataaacacttggcaggaccattaattcggtttaggtctcccactttccatttcagtgcttgtttcactgcattaatcgttccttaggtgttttagatcataatcctcttttagatcaaggtaattattttgcccagatttacatttttgccatgtgttacagctgtgttcagaggttttataggttttatactgactggagaagcctctctgaactctgttcacccaatgggccaacaaaagaatattgaattttcccagacaaaaccctgctggtgttttcagctctagttctgtcccgcaaattctcatcagttacaaggctgttttttttttttttgagacggagtctcgctctgttgcccgggctggattgcaatggcgtgatcttgactcactgcaaactccgcctcctggattcacgccattctcctgcctcagcctcctgagtagctgggactacaggtgcccgccaccatgcccagttaattttttgtatttttagtagagatggggtttcaccatgttagccaggatggtctcgatctcctcaccttgtgatctgccctcctcggcctcccaaagtgttgggattacaggtgtgagccaccgtgcctggccaaggctattttctgtagaatgttcctggtatttgttatttacatagcagattctattatatctctttaatctgccagcatcttttggttctgagaaacttgcaggaatgctctagttttcaggcagtctttgcagtccctagatcataatgtagaacgccatctttttgttttgacagggaggcttatgatgatatttgtgggctgaacgtgatcttgaaaggccaattagtctatttcatgaaagtgtatgaaagttgattcaggtgaggattattgactagtgttaaatttgttaagtgaatggttggggaactagaaatttacagtggatcaaataacactgcacaaacaatttcctcgatgaaagagggaagacatatctgtacagtgggtgagtggatcagacttcattatccaaaccctgtggtccatcttagttattatatatagtgcttatgtttgttcagccatcttatgtgctgtaacaaagggttcaaagcagcatctgtattttagccaaaaatatttagcttgactccattgagcacttacatttttaagattagtttatagataatattggagataaaaaaaatctgtaaataataccatgaggaagcaaacagacctagcctggccttgtcaataagtcagggtcgtaaaaatagggactgtgctagattcaaagagacttaaggaataaacaattagatacaattcctggtcctggattggatactgtcttggaaaaaccagctgtataggacattttttgggttacggaaatttggaactagcctggatgttatatgaaatgaaatttattaagtggagagatgaagaatattttttaaaaatctagtgaccaaaaagaagtatatataaatatatacatagaaaaagatctggaagtatgtgtactgaggggttagtggtactctgtgggtgagggaatttggggtttttatatattttagttttgcttgtcttttcctcctaattttctccagtgcatatgtcctgcttctgtgttaataaaagctcattattttttttaagtccacactaacccatcctatacagatgagttgttttaataattttactcatttttttcttgataaggattttgtaatgtttgggacacatctttgaaccatgtctttagattctacatgcatctctgttttaaaaatttaatattctattatgaaaaaatttaaatacatgcaaaagtagatagaataataatacagtgattttccatgtacccatcatccagcttcagcaattaccaattaagtatagtatatttcatgtctatccaccattcctctccacccactattttggagcaaacctcacatgtcctatcttttcatccataaagagttcagtgtttatatctaaaagttaacaacactttaaaaaattgcaataccagtattataacaaacaaacaataaattagtggtatttccttaatataatcaaatatccagtcattatttactttttcccagttgtctcatagtcattattttctctagattgttcaaatcagtacaaataagttccctacattacaactgattatgccttaagctcttttggtttataggtttctccatcctctcccaccatttttttctctttcagtttatttattgaagaaactgggttccttatcttctagaattgttcacattgtgcatctttctgcatgctctcttaacctttcagtgcccaatactggaaactgttctctagcatgcatctgagcagggttcctatttaaaaatctatacaacatagtcagttgtaatacagggaacttttttatacccaagcttttctattgaattaagattttgtgctagcttttttctaggagcattgtgtatgtgtgtgtgtccacatgtatacaactagttgctcacacagacgctacctgaacaatcacacaggcaagttgtagaaattgagcctggagagtgctaagagagtacctgagagggcactcacagaaggctatcaagggcaaatgaagtggccttgactttgtcagtaatttgtctcctctcaatatttaaaaatagatttgagtcaatatataacatcagaatgttcattaatcacctatctggatggttctggtcataacatgtatttatttcaaactcaagttgttaataagaagtactaaaacaaatgtagatgtggaatggttttcattattctagagtatggaatcttatgtataaatgtagtaccatgtaaattcacactccatttcacaagtcattgtccctcactatatgtaatagtgttttcctagtaatatatgtttaagttaaatagttttaaataatgtcatactttcattgctctaaaaaattaaataaagcttttaaacatgtttatggaatgtgtttgtaaaatccatatccataaattgaaagggagagttgatttccatcctgaagtcctttgagtttaagatgcttacagccttgattatttcaactggatgaagcaactattgaaataggatacatagggataaattttagagatcagctacacaaatgtttaggcagctgcttgctagatttccttttcaatgattactggaaagttcaccctaaaagaacactctggtatagtgtgattctcttaaaataatatttaatatcttcagacagcttggtctattgctttttattgttatgtccatgtacttttttgttttactgggaagtctactaaggtcaggatttccactgcttacttattgatttgtctctaatgattgcaggttgaagatgacagcgatgcagagacctatggagaagagaatgatgaacagggaaattattctaaaagaaagattgtctctaactgggatcgatatcaagatattgaaaaagaggtcaataatgaaagtggagagtcacagaggggaacagatttcagtgtcctccttagctctgcaggtatgaattccagttgcatgcatactgtttagtgctctgaaagttgcacagacattttatatatgtttttaaattctacttttataactagcaatttatcctttgttctttggatttttaattcaagtaaaggacagtgtttctaatggcttgtaagggaaaaaaatgagtttaagtggaagtaagggtttccatgtaccgatgtagaatgactaaagtctttgcgatagataaaaggctttctataagtggaaaaagctgagccatgctgctgtaaatttgatagtctgagaaacataaatgttttctttgatattggaggaaacattccttatatttgtaggaagcattataaagtttctagaatatatgttctcttttttttcctttttttaagtagccaggtatatacatagtagtggatatgcacatattggagctatatgcacttgaacaccaagtttttgtttttgcttttggatagtcttctctgtcaataaagtgaaaaacccagcctttccgtgatcagctgtaatctaagattgattgcaccttgagtgatgtgatgctggagagcagtaacagggaagaatggaggagtgctgggtgtacagatggctgcagggtccctactgaggtgtggcgtaagagtttaaagaataactggaagatagattagtgatttccaggtgttggggatgggagggtgggaggcggatgtgcttataaaggggcagcgtgacagatccctgggatgctgacactgattagtatcttgactgcggtggcagatacacgaacctacgcaggtgataaaattgtgtagaacttaatatacacacgtgtgcacaaatgagtatgaataaatttgaataagattggcagattgtatcagtttcagtgtcagtcttctggttgtgatattatattatggttttgcaaaatgttatcattggggtaaactgggcaatgtgtacaagagatctttctgtattatttctttataactgtgtgtgaatctgcaattacgtcgctaaataattattgccaggttaaaaagatataaaggatgcagatgtgagaagcagggaagtaaaacaaaaataatactttgggactgctttgaattttttcttcctcatgactttgatgttgctgtttagttctacctttcttctttatctgcctgtatttttgaatgctggcaccagactaagaacaataaagtgatgcattctcttctaacttaatagaatgtgcttttccgagcaggaaagaagtagatcataaaattgtgagtcaggagcacaggattcgtcattaccgtagatgattcaaatagcataacttctttaggtttgtggattgctctcaactcattgactgttcaagaactggtaacactaaataatttttcctgtaaaatgagtgcttccctcttggtacctatattttggccaattatgggtttataagcacttttcttcaaggtgggagaaggggaatgaaggtaaaatatgagctggttagttttaattctcaacagctgttctgccagaagatctagggggagaaaattgaagtaatacaatgaaattaacttgtggactaaagtagatttaattcaatcagttgtgtagtcagttactagtatctgtcaaaaaaaagatacttcataaatgttggaaggcagttaaaaattctagtccaggctgggcatggtggctcacgcctgtaatcccagcactttgggaggccgaggcaggtagattgcctgaggtcaggagttcgagaccatcctggccaacatagtgaaaccccgtttctactaaaaacacaaaaaattagctgggcgtggtggcgggcacctgtaatcccagctactagggaggctgaggcaggagaattgcttcagcctgggaggtgggggttgtagtgagctgagatcgtaccactgcactccagcctgggcaacaagagcaaaactccgtctcaaaaaaaaaaaaaaaaaattctagtccaacctagcaggcctgtcctctggtttatgattttggttatttattttagcattttatatataattaaaaacctggcatggattgagtctctcatgtatttttcttgtagtctctttgcttactgatttcttctgaagtggcttgtttatctgtgattggttttggtttttttggtaattgcagctgtcttgtcttttgatatgtgcttacatttctttcccactctgttgctgatttatcagtttcttctcaggatagcataagactgagaagagcttccatgctttcttcatactcagtgttttggtgctatattggtttactttcgagaggtcaacttcattctctgataataaaaattctagagtatgcagtgttttctaggtaagctgaccatactccttgaaacaattctgctttctagtgtactatccttgtttgtataaataaatagacaactgagaaaaaatattgttggttccttaggtgtgcaatcataaacttttctagatattgccaaattgctttccacggtaaagatgagagagttcctggtgttcgtcatctctgcaaatagctagtactgttggacttttaaattgtgaccagttgattgaatggtatctagtgtagttaattcaacagatatttaagtacccattgttccagctattggcttagaggctggacatagagtggtgaacagaacagatatagacacctgtctcacagagttgactttctagagggtagagacaaacaagaagagtatataaaatgttaaatgctataattgcttagaatagaaataaaatgaggaagggctgttaaccagttttagaagtagccaggggtcttactgagaatataacatttgagcaaagatctgaggagggtgagggagcaagtgaggatatctatgggaaaagtgtcccaggcaaagggaatagcaagctcaaaggctttgagataggaggatagggaatcgcaaggaaggccagtgtggcagaagcaacgtgagcgaatatgcgatggggtcagaaaggcattatccagccagatcgcgtagtattgtagaccattgtaaagatgttttcttttattctgagtgagatgaaaaaccagcggagggtttgaagagaagagtgatataacactcctgtgttaacaggatcactctgctgtgttggaaggaactgaagactggcaagaggggagcgggtagactagttaggaagccactgctactactagtagcaggtagactagttaggaagccactaataataatccaggtaagcagcggtggtggttgctgggtccagaggagagcagtggaggtggtgaaaagtggttgggttagatctacgtagagagaagagcagagagcacttgcaaatgctgggtatgagagaaaaagatacgtaaggatgacactaggttttgggtctgaacagtgagaagaagggagttgcccttaactgaggtgtgtaagttataggaggtaccagtgttgcatgtattaaaagtgagatgtcactttgatacctgttgcagtcagaattccttaataaatggctggcacactcaatataattgaacactttgacaaaggaatcatttacaaaggtatgtgtagagtctaatgaaagcactgaggtagtgctgtgttgagagggcaagtagcggcagagatgttaccaccctagttactggaaatttgaagggagtcatagagagttggccttgggagaatgaatcaccttcggtgaggggactcagccagtgaagatgaccccactctgagagagtcagaggaataaacattctcttcctccctctgccaaggcttccataagtctaacctactggaagccagaagacaagggaagttgtaatccatattggtcaaccttctagggtagaacaggttggagaagggtggaggataaatctgcattggcacatggaagagacccagcacaacatctaataggcgacatggagcaggctgctggatagaggaatgtggggttcaggatccaggcctgggttggcaataatacatttgggtgatgccagcctatagatgatatttaaagtcgtgagaatgtatgagatgacagggggagttattacctagagaagtactgattcccaggcaccacagtgtctagagtttaggggaaagagaagagaccagcaaaggagactgagcatgagtggtagaagaaagaaccagagagtgtagtgtctttaagtgttttgaagcaggaggagagatctgtatcaaatgcagttgatgacaatgaagaattgactgttaaatttaacaggaaggttattggtgatcttcacaagtgcagttttgttggagtggtggcataaattttttcttgaatttaaaaagaatgtgggaagagatgtttgagacagcaggtataaatgacttaattttaaggagttttgttataaaggaaaggagaataatgggctggtgggagaagtgagtcaagactttttaattttttctttttttggcatttcttttgtagtgacagggtcttcttatgttgcttaggctggtctcgaattcctgggctcaaacaatcctgccttggcttcccaaagtcctgggattactgatgtcagccactatgcttggccagttaagacatttttttaaaggtgggagaaataactacatgtttacttgttgatagatccagaaaaggggacaaaaatcataaggggaggggtgagaattcctggatctgtgttctttagtagatatgagcttgataggatctattgtgcaggtggagggatggcccattgctggggcttgggcagttttccaactgtaattggaggaaaggcagaatatatgggcatagatatgggtagatgggtagatgtcatggaggcttgaggaagtggtctaagaaaaccatggataagtgttgtggaggaggtactggaagtggaaggagagagcagaaggtaagaaatagttgtcaaggaagtgggaaagtatagtttcctattttccaagtaggaaaatgtggtatagatgttgggtgacaataggggcccacatgaagttggtattcataaatttaaggtgagaacaggtatacttttccctgactcatattgtgctgtatgggtgcaggcccagaaagaccggacggaagggtaggacttaatcatgattacagtttagcagagcaaatgcaatgaaatgagagagggaaaaggagatgattagaatgattgaaatgaatttaagtgggataaggaaataagtgaagatatgagagaagatgaggggcagtaaaaagatattgggatcacaggactacagattttttcagggcagaaggattattgaccttcttgagaaagtgtgagttggagaggtgggaagtggtggctgtagattagaatgtttgacgttgagatttggtggggcagggggttgcggatgacggtaatgatatagtcttatataaaaatacgggtgtgcctggctgtgagttggtgtggagacctcgtctttggagtttttagtttacatttccttagttattactgaggttgaacatctttgtatttgtggtgcttgctttctttgtgaactgctgctcacattctttgaccatttggctattttgtttcttattgatttgtgggttaaaaaaaaagtagtcttgatacttatcttttgatatttgtgtttgcaggtatctcctgatatgagattcacttctatagtgtgtctttcagtgcattgttttaaattttagttgaatttatcaattttctatcctactgtttatgctgttttatgcctttagaaatccatctttctcccaaggttaaagatgttctcctatattttctagaagttctaattttgctttttttcctgaagaatgttacattttattgtttgctacattcttgtgccatggttttcagccccatcgggtaatttaaggtcttctctacgctgtttattctagttagccattcatctaatcttttttcaagctttttagcttccttgcgatgggttcgaacagcctcctttagctgggagaagtttgttattaccagccttccgaagcctacttctgtcagctcatcaaagtcattctccatccagctttgttctcttgctagcgaggagctgcgttcctttggaggacaagaggcgctctggtttttagaattttcagcttttctgctctggtttctccccatctttgtggttttatctacctttggtctttgatgctggtgacctacagatggggttttggtgtggatgtcctttttgttgatgttgatgctattcctttctgtttgttagttttccttctaacagtcaggtccctcagctgcaggtctgttggagtttgtgggaggtccactccaggccctgtttgcctgggtatcaccagcggaggctgcagaacagcaaatattgcaggacagcaaatgttgctgcctgatccttcctctggaagcttcgtcccagaggggcacccgcctgtatgaggtgtcagtcggcccctactgggagttgtctcccagttaggctacatggggttcagggacccacttgaggaggcagtctgtcggttctcagaactcaaacactgtgctgggagaaccacacctctcttcagagctgtcagacagggacgtttaagtctgcagaagtttctgctgccgtttgtccagctatgccctgcccccaggggtggggtctacagaggcagcaggccttgctaagctgcagtgggctctgtccacttcaagcttccccagccacaatgtttacctactcgagtctcagcaatggcagacgcccctccccctgccaggctgctgcctcacaggtctatctcagactgctgcgctagcagtgagcaaggctgtgtgggtgtgggacccacctagccatgtgtgggatatactcctggtgtgccatttgctaagactgttggaaaagcgcagtatttgggcggaagtgtccagattttccaggtacagtctgtcatggcttcccttggctaggaaagggaaatcccctgaccccttgcgcttccagggtgaggcagcgccccgccccgcttcagctcgccctccgtggcctgcacccactgtccaaccagtccgaatgagatgaaccaggtacctcagttggaaatgcagaaatcactgtcttctgcattgatcacgctgggagctgcagcagcattttaaaaacccaaatgatataatgtcccactaatggcttatgacctgcagtttggtgtggtctgaagcatctgattcatttagtcatttcagtaacttcgaaaaatgtctgagcagaaactctttagtttaattaggtcccacctgtcaatttttggttttgttgcaattgcttttgaggacttaaggactcaaaagttttcccttggtatccaagagggatggtttcaggacgcctgtggataccaaaatctaggaatgctaagtctctgatataaaatggcaaaatatttgcatataacctatgcaaaaagtatagataccttcctttatatactttaaatcatctttaaatcacttataatatctaatgcaatgtaagtgctatgtaaagttatactgtattattttttatttgtatttttattgttgtattgttattttaaaataattttctttattcatttatttttagagagacagggttttcctctgtcacccaggctggagtgcagtggcatgatcatagctcactgcagccttgacctcctgggctcaagcaatcctcctgccccagcctcctgagtaggtgggactatagaggtgtgccacccacacctggctgatttcttcatttttttgtagagacaggaccttgctgtgttgcccaggctggtcttgaattcctggtctcaagtgatcctctctctttggcctcccaaagtgctgagattacaggtgtgagccactgtgcctggccagtattattattttttatttttaaaaaatatttttgatctatggttggttaaatctaccaatgtggatggttgcctgtatgttatttttttcttcccaaattagctggacctctggtccaattctcaaatgttatttggaagatagacctttatctaagagtacacctttatctaagagtagagaatatagaacttcaagagtagagaatatagcttaacatatattctctaagtagatttccattgtaacagtgaatttttgaagacttgtaattaaaaagtgaatttctatttcacacacactgtatgtatatgtcgatgctcactttggaagatagtttgccattttctgataaaactgaagatctagcactttcacccttaaaggatactctagagcagaggtccccaacctttttggcaccagggaccggttttgtggaagacaatttttccacagaccagggtgaggatgacggtttcaggatgattcaagcgtgttacatttattatgtgctttatttctattattattacattgtgatatgtagtgaaataattatacaactcaccataatgtagactcaatgggagtcctaagcttgttttcttgcaactggatggtcccatctgggaatgatgggagactgacagatcatcaggccttagattctcataaggagcgtgcaacctggatcccttgcatgtgcagttcacaatagggtttggctcctatgagaatcgaatgctgctgctgatctgacaggaggtggcgctcaggcactaatgcaagcagtagggagtggctgtaaatagagaagaatctgctcacttgcccaccactcacctcctgctatgcagcccggttcctaacaagccacagaccggtactgatccatggtctgggggtgggggaccccctgttctagagaaactccagcacgtgtgtgcccaaatgttcacagctgtatgttcagaagagcctcagatggaagcaacgcaaatattcattaatagtggaatgaatacttaaataagtggatgaatcttttcaacatagcatgaagtaaaagaaacatgcccacagaattcgttagtatgattctattatataaagttcaaacacaggaaaaaaaaaccctattttttaaggatgtatatttaaatactaaagtgacaatcaaggaaatgattattccagatatcatgattgcggtcacctctagtggggagatgaggtgtaatgattgaggagggcccggtagcaggtgtggtgttggcagtattctatttcctggcctggatgattgttatttatgttggtttaataattattctataagctcatatgtattatcaattttttattttacagatctctttataaaaggaataaaactctttaaaagtggatttctaatggtaaaatttctgttaccaccatagaggtgggaaccatttttggagaggcagccctttccagcctgcctccttccacttgtgccacacgggcattgcctgctctgtttgtttctgaccactgacagtgacactctcatttttattagtggtggatatgggaaaggggacggttgttcaaagtcatactttttctggtaagattgtgagtctttaggtgtctttgtagaactctttctgttagtctctgaaagagataatcatgcctttggcttttctttttgaacagtattcttggcagttctaagttacgtttcaagagctttgaaaatggcaccccactcttaccttcaaacgtaaaaagtaagatctatgagaaatttcttctgcccttcattttttttccccaaaagtcaaatcattgaattcatgcaatatgcattgtctgttcctttcaagatgtcacagatagccagagttagaaaaatgtttaacagtgtgagcagaatgcactggatcaatattgaagaaaacgtggggaaaatattatgtgcaagtctgtaaacactatttttagagatacaaataaaaacgaaataaccagactgcagtttggtcagtatagttgttgtctgtgcatatttttgcttaaaactattatatattttcttcaatttaattttatgaaaagctattttgggtaggaaattttaattgtaatgacattggaatttcttccctcctctgttccttgtgccaacaattagactgaagggaaaagaaaggatattactctagcagcctgtacttttaaattaaacctcgaaccttttctttccatgaggcaacaagacagttttatttgtcctcattgattcagctcatttttttccctcttcttgtatggtatatagtttgtgccaatatagtctcatattacaaaggcaatatagtagaagaagattcttccctttgatatttaaaacatctgaaataacacaaacagaactataaattaaaaaatttgttctggctgacagggctaaaaaaattttcaattggataaccaaaaaaataaaaacaaggaaaactccgataacaaaaaaacttttccttgtagctgaatattgaatattgggcctaatttgattttcttttttctttttttttgagacggagtcctgatctgtcgcgcaggctggagtgcagtggcgcaatctcggctcactgcaagctccgccccccgggctgacgccattctcctccctcagcctcccgagtagctgggactacaggtgcccgccaccacgcccagctaactgttttgtatttttttagtagagacggggtttcaccttgttagccaggatggtctcaaatcttctgacttcgtgatccccctgccttggcctcccagagtgctgggattacaggcgtgaaccatcgcgcccggcctgattttctttttaaaaaccttcaaaagataagagcagaatttgtgtgctaaactgctagtctccagcgccattttgtgttttctgttgttttgaagcaattctttgtttttgctggtccagctgcatcattttcatcatcctgaactatcattttcctgccctgaagttgtgcatttcctttagcagatccagcctaggcagctttatttccctttctttttcctttaaatctatgaccttttgattctcatttgtttagagattcttggtgattttgcatgagtttttttcagtgtttctttttctacctttctgtctagtaatttccacatctcttccttgtttcttagtcataggttacaattgctggctgcttctgctttatttagtgtttctttagcttttttcttacatagaattaatctctcttttgctctactgataaagtgtatccattttatttccccatgatttgagaaaaggatatgtgggtgctttctacaggtcacattatctaagtcatcccaaaatttcagcaaacattcaatctagacatttcatttgagcatcctcagcacttctgtttttttttttttaaagtttatttttgtgggtccgtagtagatatatatatttactgggtatatgagatattttggtacaggtatgccatgcataataatcacatcatggaaaattgggtatccatcctctcaagcatttatcttttgcagcacttccatttttcttcttgctcttgcttagctctgaatttagtttatactttgttttgcttcattcttgttttgcaaaataatcctccttgaaaagtgttagaaggtctgtatttttataccagggttcagggccagggtctctataaactttttattggatttaataccgtcaaacactgcacgtgttgattgcttaaatgctttgtgtaatgtttttctcatttgaatatttagtgcttgtcctttatcttctaatctttaaaagattagacataaaataattatgtcatcaggagttgcatccattgggaagcctttcatatgaatggatctggttttacatcatttttttctactcatcagttgccagagggacattttgtactaatcagagggaggtttgtttggaaaaatcttctgattttagttttatctgtattttcattagttctgcctttgatttgttcagtgcttctattatattaaaatctgttgttaggtaatttaacctgttgaattttgttatttccagaggtatccagctttcatccaatttagtctgttccttttaaaaattcgtcttacggcaaattaaagtcatcaaaatgatacttgatttgatggtggtaggtttcggtccccagagcagccattgttttcactatcaccatttttggctgctgtggttatctttccggtcccaggcccccagagccgagccataggatcgctagcagagactgtactttcaagttcacatgaaggactgtttatttttaaatgtttattattagataatttaagctagttatactggacatggcttaatgagagaacgttagtgaatcttttctgagtttaagttgtattccagatactcttctggttatcaaatgacttatattccagttactcttcagttagacaactggctgcatcatcaaatcatctgggtactacattcttttcttttcttttttttttcagacagggtctcactctgtcgcccatgctggagggcagtggcgtgatctcggctcactgcagcctctgcctcccaggttctagcgattctcctgccttagcctcctgagtagctgggactataggcacgcacctcaacgcctggctaagttttttttgttttgttttgtttttttttgagacggagtctcaccctgttgcccagtctggattgcaacgatgcaatctcggctcactgcaacctctgcctcccaggttcaagtgattctcctgcctcagcctcctgagtagctgggattataggcgcccaccaccacgcccggctaattttgtgtatttttagtagagacggggtttcaccatgttggccaggctggtctcaactcctgacctcaagtgatcctcctgctttggcctcccaaagtgctgggattagaggtgagccactgaacccggcctcatctgggtaccacgttctaatagcatctagtgtatccgtctcaattgctattgtctcttctttgtatgattatcttttagactcatacctctccttaaaaaaattaagataattttaggtgggttttgggaaggagagcaaataaatgcttctgatcaatgtcatatttaattggaagttgataaattctctttacttgatctggaaagataataaaaggttatttttgataaagtccttaaagaaaatcagggtagaagctcttctaaaataaaacacatgaaacatgaattcagagactatgaaaagggacggctgtagtgttagtattgtggtaggaaaggcatcttttcagtagtgtgcctgaagtgtagtatatgtgtttaggtggtggaatagaaggaacacttggtgggcgtcaggggatcttagttttggttttggttgtcttagaaccttttttttttttttaaactccaaacaaaaccagctgttagaaataatacctccttgctttaatctaggggtagttgtgacgatcatgtggaattattttacaaattataaagttctatacaaaagctaagaattactttttaggtgaagagaaacaaactgttgggttagaatatactgtgggtcatatttgaaattaggtcattaacacggggctgtcatgaaaatatccaagcatggtactaacatatatatgtaattagaaaaataaatgatcattaactcatcttctcttttatttagcttttttgtgtgtgtttgtgtgggatttgttgaactattttaacttctgcaactatagaggtgatacagggaacttgaaagatgattaaaaataagaaaaaacaggatttatgatgaaaggtttaggatgctaagcaaaagaagcctgagaaatggtttaataatttgtgttttccaagctgtaaagacaaaggaaaaaaaaatcaaatgtgcttaaactaaaatacaggggatttagattagccatttgtgttatgagtgttaactgggcatccaagggatagttgggaaatcacctttactgaaaatctttcaaaatggatttggtttcatttaatggaaatgggttcaacaatggtccttcttgctgcatgggatagagcaaggtcatttatcaaggagttttttcaaccctgtaattctgttctcttgtcttttaattttgcgataattctacagtgttttacttgtgtgttaagtgagcacacccagtgtcctcagaagggttaggcttcataaataggcaagacgtgtgtgtgtaaatgagccctgtggccactagtgaccctgcaaccacaggtgaccttaagctaacaagctgatggcggtcatcagtgctgtcatttcctgaaacctaccagttgcaggctgtgtgtgagatgtgttacacgggcacattctctatttcattaaatcctaactttaacttaatagggtaggtttcattatctctattctatacatgtagaaactaagccttagaaataaagttcaacaatttgtacaaaattctcatatctcttaggtagcagaatcaggattcaaacttaagtatgcctggcttcaaggttggaattttttgcacttgatactgttcattaaaatcgaaatatattgttgattatctgaaactaaaaaaaactatgtttattgtatatcactgtctaagatacacattttttgtttctgcaaaaaaagaagctgtgttgtttacacttggtctgcagcttcagagaaggtttgtggttggttaagaagctgcctttgggctggaggcaggcacctggacagaagccccaaggcttgggagctgcagccaggcctcagggcactgcactgtgaggctcccagttgtgttggagggtgagtcttttggcctatggaagttggtcaggtggttttccttcttgatgcatttcacctccttgtgtagacagtcacagagaatgtgggtctgtgtggccataacccagggcatgcagacccagcaggacctggttagggttttccatggggccagaaagcttcctaggcatccagggtgtgatcccactcatcttggggcagcttctgcatgcagcgctgattatgaatcttctaggcatgcttgtttgccaacttgtagcagaagtggttcctgccttctggggccacactgttgcagttgaaacaaaagcccaaagagagaaagagagagataaatagaggaggcctgcagatgcaggtggaccaagcagctggcagcagccttgacctcagtggaataattctggtagatttgggagctcatggttggagaaaaaaaccattgttcgctggcctgagaagaaggggatgggcaaagagatggtcccagaggctgcagctggggaggagagtggagcgtaatctgaggctggagtagggaagaccttgagtctgtgggtttattccatcctaacactgtggaggcaagagactgtctggtggctgtccattgtttttctcttttcctttcctggcctttccctttcccttccccttttgttaaataaaaagcaagccagcataataaatgaatttgatcttagtttatcaaatgaaaaaaccttcaaatgtaccttttccaacagaaaggtgacatatgcaaaagaataaagcacatatgggatactgcattgtacattcttagtcactgtcatatgtggagtgggatggaaagaatatcctcacataatttgttgtgagaatactgcactggtctcagaattttcagtgacctgagaatggaattaatgctaatgaattatgaatatatactgtttaatttagaggcattgagtggtgaggatgtcaacatactgcttttcataacctgtggtgagaattcctcttggaaaagtaaatctatattttatctgtttatttagcacttgaaaagaacctgggctgggcgcggtggctcatgcctgtaatcccagcactttgggaggccgaggtgggcggatcacgaggtcaggagatcgagaccatcctggctaacatggtgaaaccccatctctactaaaaatacaaaacaattagctgggcatggtggcacgtgcctgtagtcccagctactcgggcggctgacacaggagaatcgcttgaacctgggaggcggaggttgcagtgagccaagattgcgccactgcattcaagcctaggtgacagagtgagactctgtctcaaaaaaaacaaaaacaaaaacctgatatagagccttatggtcatgatctattatatcctgtgtattgcacatgaaggaaaatattgtctttaataatattactgctggtttttaaaaaatcattaagtttcagaaagcttgctttctttacctcttactttctagctaagtagataattaatgtggttttatatttacctttaaaattctgtagttgtagagtcttctgccttgtgtttatacagagtttataaaaatttacagtgggccgggcgcggtggcttacgcctgtaatcccagcactttgggaggccgaggtgggtggatcacgaggtcaggagatcgagaccatcctggctaacatggtgaaaccccgtttctactaaaaatacaaaaataaattagccaggcgtggtggcaggtgcctgtagtcccagctactcgggaggctgaggcaggagaatggcgtgaacccgggaggcagagcttgcagtgagccgagatggcgccactgcactccagcctgggcgacagagcgagagtccatctcaaaaaacaaaaaacaaaaaacaaaaaaaaaaatttacagtgaaatgtgaggttttcacaaataaccctgagaaacaaaaatcaacttaatagaatcctaaatttgttatgccatcatgaatttctgcctccatgggggaatgctatgtgagttagatctgtcagagagatatcaggcacctgggctttctggcattctgcccttgagagaatcatgaacctttcagtattagagaagaatccttagagatagttttttcactgaacatttcttgaacttctatttttgaacatttcctagaaattaatagaatgaagcttaaaaagattaagtgactgcgtacatggccacagaattgggaacagtagtctttggcttcaaactcaagatttctagcttataggtacttacttaccaaacactaaggaatcaggtgtatcatgcatcatgtcaggtgctgagggtacagaaatgcctacaacacagtgcctgcctttcagaatattgttgggagagctgaattgcagtggcccagactgctcctgatgggtatgtcaagaatgcaaggctctgactgctctttgtctgaatttctcatagttgtgtttccagcaagcaaccctgagggatgaggtaatatctcccccagggttgcttctacttactcaaggaacttactcttactgaaaaaggaacactgagctgagggcatgcactcagctcagtgttcctttctggtaacaaaggaacactcagctcagtgttccttccctgtaataaagcccacagcatgtacaggactctttgaattaccactctgagacgggggcaatgaggaaccaacaaaaattaacatgaagtttgactactccttttgccagagacaccttttgtctctggcccaggtgtctcatgtcttctgctagcacccatgaaacagtaacaggctaacctgttagcttacagataaggtggaatctcagaccctgcatagttattggcaaatatctcttgtgaggtgatatagatgtgaggaaaccaacaaatacagttcagtgtgacaggtacagagtgctgtgggatacagaatgctgtgggataacccaggaaaggttcagctggtcaaggtcaaggaggcttttctgattccactgctcttgaggtgaaaatattggttggttcatctcttgagggtagatcttttcattgttagtgtatgacacaggacatggcacatggttcatgatgacagagcttgctgaatgagtgaatgaactgttatttgtggttattgggtgtgatttactgcatcaaaggtccctatgtttgctactaacgtttgtctcatttttaaagaccgaagtcctgggaagatgtttgttcttcaatgaaaagcaactcatatagaaacctactatgaataggctgggtgcagtgcctcacacctgtaatccgagcactttgggaggccaagacgggtggatcacctgaggtcaggagtttgagaccagcttgaccaacatggagaaaccctgtctctactgaaaatacaaaattagccgggtgtgatggagcatgcctgtaatctgagctacgcgggaggctgaggcaggagaattgcttgaaccagggaggtggaggttgcagtgagccgagatcatgccattgcactccagcctgagcaacaagagtgaaactctgtctcaaaaaaaaaaaaccctaccatcaatctattctaacaggtgaggaaagtgactgagtttgcagaatatcttgtatgtagattaacttaataaaatgacattaaggtccaattacttattttgtaaactttttattttctaatactttttagatttttcagaagagttacaaagataatacagtgaatttccgtgtactttctacccagcttcccttaatattattattttatataaccatggtatctttatcaaaactaagaaattaacattggtataccacagactttatttgcatttctccaattttttccactgatgtcctttttctcttctaactcaggataccacattacatttattctttgtatttccttagtctcttcttatttgtgacagtttctcagtcttttctgaaattgacacttttgaagagtagaccatattgtagaatgtcccttaatttgggtttttctgatttttttttttttcatgatgaggctgagattatggattctgggggagaataccctaagatgatgtacctttcttgttggatcatgtcagtggacacaaaatatttataggacttactgctgatgatgttaactctgatcacttagttactcttagttaccacttagaaacctccgtcaggtttctccctgtaaactccctgtttttccctttccatttattgttcactagcagcgagtcactaagtcctgctcacactcaagacgatgcgagtaagcttcatccatggaaggaggaatttctgggcatgtgttaaaaacaatgacagtaaataatgttttgaggctatgcaaagatactgtttttccttaaaagttcaggggaactagttctctctgaagccaagaattgccttggacaagaggtcaagttataatgactaaatacttgccctttttatttatgctttactgcagatctatctgtattataaatggtgctattcttgtgtcattgacccttctgtcaatttctttgaagaatggaagcgtttatgttaactgaatggggttaatgagggtacgtttgtaaaacaaggtgaaacatcaataattgattttaatttcttcctcattaatcagttacaaaaagcttattttatcttttgtcatttgttggttaccaagaagccatatatatgtgtgtgtgtgtatgtgtgtgtatatatatgtatatatatatatacacacacatacacacacgtgtgtatatatacacacacacatacacacacacacacacacacacacacacacagagtatggacatatatgtatatggttagctatatcccaagtgatttatatatccacgtctaaaatccgttgctcagaaaaacctgccttaatgttgtgcttcttgtgcaagagacagtcatggtccatgcagttaagaggtgcagtctttcaaaaattatcccaacaggagttgatgggtaggaaggaggcatgtcccagtgatccaacagtcatcccaggacatgctaaccatttgactgatctccctcagaagttgggataattctaaggtagcctttgttgctttaggggtgttgtccagatgggctggtccagagagagagagagaatgtggttgatgtgtttttcgattcataaggggaaaacatcatggggaaagcatcatggtatttggatgtacaacataactacattctttactgctgttcttggaaatgccataacctaaacaaattcttgtttccattactaaattcaaaaattttgagtcagtgcagtggtagatatgggtaaacatttatagcatttaaaaaaaattgtaaaatcttaaaaaaggatcaagatttggcagtgctgagttaatagcagtcaatcaaattgaatttgaccattgggactgagatttggcctcttaaccatatgttattgctttgctccagaaaatattttagtagtattatcagaaatacttccatttatttttttccttttttaatttttatttttggcagagcatagcatttggtaattcttggggtcattactagggtttggattgggatgggagagggtgtgatcttataggaatttgaaattgagaaggcagcactgctgaaaaatgcattagggccaacctctgaattagattggcttaatttgttgggggcagagctgcagatgcagctctacatctgcagagatgtaggtgttaacaaatgtgttaaaataactcttatttagtgctgggtgtggtggttcatgcctgtaatcccagcactttgggaggctgaggcgggtggatcatctgaggtcaggagttcaagaccagcctggccagtgtggtgaaatcttgtctctactaataaaaaaaaaaagaaaaaatacaaaaattagcagggcatggtggcatgtacctgtagtcccagctactagggaggctgaggcaggaggattgcttgaacttgggaggtggaggttgcagtgagctgaggttggagtgagccaagatcgcgccactgcactccagcctgggcaacagagtgagactccgtttcaaaaacaaaaaaacaaaacttgtttatagagtacctggctagatatttggtattttgtatacattttgtttaaattcaaaatagcccttcagtgttagtattagacaattttatagatgagataaattaagctcaaagaagttaggtaacaaggatcacataactagtgtgtaatggaactgcagtgtgaattcctttcaatctgattccaaaacccatgactattctttatattgcactctcgccccctgtggtatgcatacagttggctatgcagcagtaggcccttttggtgtattgtatagaaaatgagccatttcattgtttgggaaacttgtgtttcctccccttccccccatttttagtatctgttaaaagaagaaagcttttggctacttaaaaaaacttggttatgtttagtttggtgccttttgatctggtcatgacaatgggagcaatactcttatgcttgctacttgtttcatttaaactgaaaagtccggaaaaaatatattagtacgcaggagtgctaacttgcaaatgagtttttcttgactgctaataactcaagcaaaaagataattatgtgttataaactgtgcatgcggaaagtgaaatgaaattcatccgcttcatattttttaggaaaattgataaggcatcgctgttaatatttttcacattaccttttggatttcttaattcagatattttctctccacaattttgagagaaaattaagaggggttgctgtccaaaactggggagtcttggaatcaagttgtgattgtatgtttatataaaaactcagtgtgacctcagcaagtcacagcattttttcaatttgatgatctctattttaaagtgagaaagtttttacttgcagagtgtttctgaatcctatgttaatcttttttaagttctgattggaggctctagtgatacgatttttagggcaggctacatttagctgtattttttccattatattttgaagtcagaatggtattgcaagttagtaattttcatactcttgttgataatgttttgcatatggtacacatgggatttgggaactagttaaggtccttgcctacactctgcttagagcaagaagtaatttggggttctccgtgtacagataatgataaatgggccaagttgtggggcaggtttcactttagaccttgcctctcttttctgtgtgtcactcccttttctttcttatgtgcatgactacctactgtagtgcccaaggctttaatatactcattgatgccttttgcctgatctcccaggatacccatacatgtatatttaatattcgtagtttgtgctcatgtcatatatggccatcagcccacaacaagagaaatcagaggacgtgttgcctgggaggcagcacgtttggagagttcatgtgtgggacggtactataacagccttgcgtaagtaatgcaacaggtaaggtggaatcacgttagagcaggctgttgcactgaggtcttgtcaagttaagacattaccagtgcgatgattcttgaaaggtgtgctgctgacaaaaagatgttattaaatctagtctgtgtgggagtgtgcatgtctgtcagctatacagtataattcctaaataagaacttgctgctcctgacatacttacatactttaatgtgtcttcagctctacatgtttaggttccttgtacctatttcttctgtgcctagttgctctgagtcatactagtttactatgagataatgttaaacaatatcatggattcaaccaggatgtcttaaatcttctcccttgttattctcattcttttttttcctttacaatcatagtgaaaaagtgagctgattattttttaaaacccagaaaccagagatttaacaaattcatagctagaacaagttagtgttcacctgaatggttttctctaataccaatcttgaatctcttggattgctcatgctattctaattaaccagcagttgataaaagaaaaatatataagcatatatgcattgcatttttcttgaccactggagctccttagtgtttctctacatgtgtcctttacgattcctgaggatgcctaacgaacttctcttagtttagtaaagctgacatgttatgaaccattggtgtcttttttctcactcttcaggaacattatagaatgttcattctgaaaacagataacatttggtccaaatctttcattttttaaaggaggaaaccgaggctcataaaggttgaggtttaacttaaggccatacaagtatttgtgggagatgaattgctcagataagagtgttttctgtaggttcataaatagtgcagttttatttgcttgcttgtttttgagacagggtcttgctttgttgcccaggctggagtgcagcctcaacctcctgggctcatgtgatccttccacctcagcctcctgagtagctgggattacagccacaccctagcatgcccggctaatttttgtatatggttttgccatattgcccaggctgatctcaaactcttgggctcaagcaatccttcctccttggcctcccaaagtgctgggattgcaggcatgggacaccgtgcctggccaaccgtgcagtctttaaataatagcctagatacccatttaaattccaatttttattttgaagaggggtttacgaggtgactcttctgtggttgtgtcctttggagtaagctataatcaaattgatatgcagagaggaagtaaacggttctttattagagtagacttaaaatgtggaatattctcaagtatgtcaacctttctaaacaggatgaaaaagaaacctggagcattatatgagccagtaggtcccatttattgtctgtttttttatttatcttgttctgctacccctactccttacttttgcctggcatggacatacatctctttcctctgtccatttttcacatgtttgttcttgttagacttgggacttcagggtgaaagtgaacattattctctggtttcttctaagtttgtggtttattaatatatccttctaatatttcttgggtgtaggaaccaggggaaagggaaaaagtaaggccgaattctgtttttctcaaatgcctggggacgaatttgtacaccttaattttatttatttttatttttatttatttatttatttattttgaaacagagtctcactctgtcacccaggctggcatgcagtggcgtaatcttggctaattgcaacctctgcctcccaggttcaagccattctcctgtcttagcctcccaagtagctggcattataggtgcctgccaccatgccggctaatttttgtatttttagtagagacagggtttcaccatgttgatcaggctggttttgaactcctgacctcaggtgatcctcccacctcgggctcctaaagtgctgggattacaggcgtgagccatcgtgcccggcctgtacgctttaattttcatttgatgttttatttccaattattaaatgtactcccccactctgtttttctcactcaagagacttcctgtgtctacagtgggtttgctgtagtctagtaccacacatgttcagaggatgctcaggaaatattagtaatacgtgtcactttgttcagaacggccagtctgcattggttctgcctagagagaaatttcctctttcttcatgtacttggatcgctaaggttttctggttgaatttctatgtttttaaaatagttttatatagacatagtgacttttgaaatggtcctccctccctccctacctctctcgcttcctcctccatccttccatccctccctccctccctcccttcctctcttccttttcttcctttctttttccttttctctttctctttcttttcttttcttttttctctgttttgacagggctcgttctgtcacccaggctggagtgcagtggcgtgttcacagcttgctgcggctttgacctcctgggctcaagcaatcctcctgccttggcctccaaagtgttagaattacacgggtgaactaccacacctggcctgaaatagtcctttctaattcaaacctggctgttttgccagggaggacttacttgctctgagaccatattattggaaacttagagtgtaatagagaacgtttgattcttcacttgtagaaatagtcagaatttcaaggttcaaaatttcacagacatagacatagggctgtaatgagaaggaaaatatgtatgtaccatcctttcttccaaagtgtccttggaggagagcaagcataagaatggtgctcagtgaggccacgaggctgggatacaacaccctgaatcaaagcacgctgtcatagcctcctaacaaaagagaatgtcaaggtttgaaaccggaattcattataatatgcagtattttatgtacttgtaaataaaagtaagggagtataggaggagatgataaggggaggatttgttttgaatctgtctcatcttctgctttgttgaagtgctaatcagatgatctttctatcctaccaatatatgagaaaaagtgtcttagagtaagagtattggagcttgttcttgttatcctaaaggcaagcttccctgtctcatgtaagaactccagctttttgtgttccctttaaatgtatattttgtgttttttgttcattttgttgctaaaaaaggtagtgcggattttgttagtgaggagacagcctttcaaccttcctatctccttggtaccaatttaagccaaaaattatttttttctatacaagatattaaccttgccataactaattcatgccattgtgaccatgagtttagctatctcttttctatataaggaatcactgctgggaattggtttccttcccaagggaccctgtaattttgattattttacttccatccaggatgtcactataccacaggaggctggctgactcagggatgggaagaaaaggcatagaaaaataaagtagcttatgtttctatgcctaggatgtttgtttcaaaagttcagctggggatctgagacaggaaaggtacaataaatttatgttaaaaatttcagctggtcatctgagacaggagaggtacaatacatttatgttaaattttttttttgtttctgtcttgctgtttacatttatttaaaatattttaaatggagatataccattatgcctgcagaaggtcctattcctgatacttaaaaagcctaaataaagatatataaattttaaccagttcctaatacacttacagaataaaagtgtgttgtctactggagtttttcttcccagatccatttatggagaggccataaaaaatctgatgcgggcatggcagaaatttatattaaagctgtgtaataagtccatgggtattggttgttggtttaaaataactctacttaaaattgaatctcaagaatatatttgaaaatattttaaagtattttagagaaaaaagcgacattactcacttaggagattgacttcaaagcaggaatcatttgagattttggatgaatagttatgagaattccttagtgaacaggacagtgctggagatgatcactgaatgcaaatgaatacattgtaatataaatagtatgtcataataattgaaacatggcttttttagatggaagatcatatttcctcttttaaaagttgattttatccaatatatcctgctggttgtaatatttagttatatatggaggttcaagcttaaatacttgagccccatctcacttgcaaaagcaagtaaattgcagagttcacaaacctggaaacaactcaggacaactccagtgtttggtataatgttgttaggtgaaataatactagaatattatgcaagggacctggtatttctttcttttcttttcttcttttgagacatagtcactctgtcacccaggctggagtgcagtggcacaatctaggctcactgtaacctccgctgcccgggttcaagggattcttctgcctcagcctcccgagtagctgggactacaggcatgtgccaccacgcccggctaatttttgtattctcagtagagatgggatttcaccatgttggtcaggctggtcttgaactcctgacctcatgattcacctgcctcggcctcccaaagtgctgggattacaggcgtgagccaccgtgcccagctgggacctggtatttctaacaaattctgttgttttctcacactgaattctgagttctattatgacaaattctcactttttgtttctatgctttcttgattgcaaataattttttgagattttgttaattttagttacttctggaatattccaacccaaattatagatgtttagtcctttttaaaatcaacttataatttatttgaatcctaggtcttagttgcttgatcaatgtttaggcagcagaataattgagtagcattccgcatagctaagtagcactgtttcgcaacctgtgccctcttgctctagaaaatactattgcttgacatataccaggagttttaggttagagtatttggcagtgtctatatggaatcaaaaacttgcattaaaatggagaagaatatctttgtgaatcctctagatggcagaacaattacaacaaacatatcttagaaggtgtccaagaagcgtgtggaggagagagtgtagaagagatggggtgagaaggggacctgcgggctctaagctttctgtctcaacccaaccagggcagatctgctcttatatgtcttatatcttgatattttatctaagatggtgtttgaaagaaggaacatggctaaaaacatgataggatgtcaaaactcaaaatctgttgttctttttttccttcaggatagagtttcgcccttgttgctcaggctggagcgtaatggtgcaatcttggctcactgcaagctccacctcctgggttcaagcgattctccggccccagcctccaagtagcggggattacaggcatgcaccaccacacccggctaatttttgtatttttattagaaacggggtttcaacatgttggccaggctggtctcaaacccctgacctcaggtgatccacctgcctcggcctcccaaagtgctgggattacaggcgtgagccactgtgcccggcccaaagctcaaaatcttaagttgtgcacgccaacatcaaatcacagatttctgtgaggacgtacacatgcattattcatgtaccctgagcatcttcagactatagctgcccccaccccaacacacatgttgatgaattctagagtgatgctggcctacttcaacactctgctactttaatttctatcataggggttgaggcacagcatagtcttttagcctttgtccctgcttttaaagaaatcaccattgttggtatattgtatgttggcataaggagaagagatgacttggggagatataacataggtaacttgcaaagattcattcctcacagagagtgaaagagggagagggggcaggtagagcatccaacagaataaatgtaagattttaagtgtgtcactttctccactcatctttgaatagaaagatgactgtagtatctcttcaatttcatttgcaaagtacttattcaaattcccctgaagtcactttttaatagcaagaccaatttagatccttttggattatcgatgaaattctagatctagtagtatagcaaacgtgatttccatatgtcaaatagagcaaaagcataagggataaatttgctatcctgtatttgcatacctcataatatcatatactatccctaacagatattatctccttatagctattatttcagtataaactactttaaaagactccttcattagacttttctgcagttacctacttgcctattatcagtgaaatgcagctgaggtatattttaggatcactattcttctggctgtctgagattgtacctgagaatgcattaagatacattttcacattcatttaacacatctgctgattaactagtcctgagcttaccttgggaatagacagataaattagatgtggtctttactcttaaggccctcaaccatgaaaaatgcaatttcgtatgtcagacaactatataaatagattttcttatttttttaacttttagatttttttatagagatggagtcttgctgtgttgcctaggtgggtctcgaactcctggcctcaagcgatcctccagctttggcctcccagagtgctgggattacaggttgcgcttggccataaataggttttcaatggaatctaacaaggtgttatgaaagaagtatcctcaaagtgttggggaagttcctaggcatgagaagctcttctgtaggtattaccagaagttacccagaagttactgcatgtagaggactgtctttgcaacacaaatgaagggaaggtatacagttgatgaaatattaagagttgtactatgttatatactgagcctgatagatttacaccaacagctttctaggttactgtaccaaaaaattctataaatagctaaggatttttagttgataactgaactggaaatcatctctggcttttgcttcttaaagaacacattattcagtgctacatttctatagtgataatcaggaaataagaaggcccacgtagtctgatgatgacaacagtgtgacgtcaaacaatgtctataaaagtggtaatgttttctgattggtccagattcttgagttatttcactaataatttcaatacaaaaaatggagaatgtcagatctttaaacaactgctgaataacccattggttgtaatgaaccagtacataggactgaataaatgctttaagaattctctacacaccactggatcaagcaatctgtgtaactgtagataatgagacttcagcttgacttgtaattatgcgtggagtagttaactgtattttttacacatcatctttgtataggctctgagtctaggagggtcagtcacaaatgactgatactctgaatcagggtattgccactaatcaaaggacagactgcacatgtgttcagtgtggaaggattagttggtctgctttgtcttttggctactgttgcaaacaaagattacaaaaagaggtctgtatatgcctatgtgtttgtaaaaggagctttcatttttgtttccttaattgaaccctaactcctgatttatttttatttattttttacaaatatttgttgaagactttcagagaacacagaagttttgctaattcaagacagtcctttgtttttttgtttttgtttttgtttttgttttctgttgttgtttttgttttttaacaaatccatgctgttttagaaaggtgttaaccagccccctccctgccctcatactagtccatgtgtcagatactaattaatctatgtcatgggatcactttataatctatatttagggatctctttctcattcagagacaccgtctttctcattttgggtgttttggtaatttttcaattttctgagtagcatcagtatttctgcttgaaccaaggtgaaattttgcatctatttctcagttctctaggggcctctttcatgactgtctgcttgcttactggtattttccttactcccgttttatcatggtctgtgaatttaaccaacatgatgtttactcccgcttttgaattattaatgagaaaactgtgagatggtacttttatctttaatagttgatgctgaaaaagtgacaaatgcaataaaagcatctttctctaattcagttcctgtcatgcatctctttagtgtcttggtgatatgacttgaaataatagtgcttacatctctcttttagctagttcacactgaaagcatataatcatctgtttgatatcagagccacttcccagtcacagattgtgatgtcacaaaccaaagattgttctctctcagcaggaagaagctggagaggagatgatcttcatggtgaactacatccttattcaaatttggtcacttcataaggaaaattaaccataataaggaacaaatatattggctagttgaaatgcccagttgaattaagcttgaaacacggtgccattataatggaatgaaaaaaattccttatgaaaacttaaagttataataatgaagatataagtaaatatatatttaatgcatttaaaaatattatgcaatgtccctttaagttgaatgctaacacagaaaaatgaattttaggtatgtttctaattttatatacaaaattatgttgcttggtatttcagacaaaaattactttttaagattgttatgtcaacatacacgaaatggatgtgttcattttgacctagatgccatttttattttatcatagtttaaataaaaagcttatagcttttggataatttaaaatgaccagaatttaaggatatagcaataggtattattataaggatatggcagccaaaatatttgctccatttctatgaaaggaactaatgatacacaatcacattacttttacaatataatacttttatataatatgtgtgaatgaaatacattctaaattgcagaaacaagtaggcaggtcattgactacatcccaagactgttcagaatctctttaattgttaaatctatcaataacagggaaaagttgttataaataaaccaaatcttcaggtactagcataaaatccctcatccatttgtacccatgagatgtaaacttgaagcagttttcaatttttttttcaccctacatgaagaaaatacagattattccaaattgctgtagggtatttttttgaaagctgttaccaaaacttcagtaatcacttttctgaatgggttattatagagcaaagccttgatttggaaaggaaagaaagtgaaaattcactgggattgatgctgacaaggaccaaattggggtggagcaaggtagtattcatttgcccagccattgtcattagaaggtgagttatagaaacaaagcccccaaattagtgggatatgagtctctgtttacattacaatgagtaaataaaatccagaacacttaaggaatattgttatctgccccctttaattccatttattggaagcaaattgagcatagtagaaatttcatacttttgtccaagttaattaaaaaatctttaattataatttaaaatattgattaatattcttcatttaaaatatctacatatttttgaatcatgtctgtttacaaactgtaataccataataaggagggaacagatgaaaagaacccttaagggttcagctgtttctcagtgtaggtaaacaacaacaataccacccttaacttttagttatgtctggtatgcataagaagtattttgagatttctaaataaacatttttttctctgaaacaaattgttgtattagataatcactacttgtattaaattgctgctttcctttggtactggaaaatgacaggtaagtttctgtaatgacttcagatgtaaaagacttatgatatttaaggttatttatagactgtcttgaaaagcctgaagggatcatataatttactcccttaactaaaatttgaaaaaaggaaagaattcagtgaaatggaagagaatttctaatttgactacttttagacaagtattgaatacttacttctgataactttatgtatattaccacaagatctccgtagttaggtgtgatatgctcttgtttccctgtctcctctcttctaagataatataaatattatttgttgtaggacttctttatgataaggtgctttggacctaagttttccaatgaaactcatgaaaaccaatgtggttgggatttctgctaaatgataacgttttgttgtttttacataagattgtcactctagaagtctcattatgcagtgatttctagggaatttcttaaaggcactgtatcttttaaaatcctttgatggcttcactagtgctttgcattttacagtttggaccactgacctgagtcaaagcttttgaggttttaaggtaccagacatctttcatctttttatcctcttgttgaatcagaaaaatgtcttcatttagtctgttataaaaatgtctagtatctttaggataaattagccctatcctacaagagtgttatacctcgatttagtagagattatttttctttagtatgaatgaaatgacatcacagcttttttttcttagtaacaatagaaatcagtcattgagcttttgttcctttatatgaataaaaatatttaaaatgcttattaatttttctttgttttatcaagtactctgggaaactaagttcatttgaatattgttggtaaacattatctgtgaatggctcttatgcaccattcagggctctcttcatgcatttttttcaagctattaaataaaacaaaattgggataaaaataaagacaaagatgagacaaattcaatgaaaaatgaatgggagttttggatgctttattatctagttctgagtgacttgtttatgcagcataagtaaaaacaagcgtttacctcagcttaaatctgcaaaagcttaaggaagggttgcaagaaattcaaatccactatctcattcacagcacgagcagatttaatttcagtagacaagatataaattaaggttataaaattaaatcttacctggcagtggtttgtttgaagctcagtaatttgaactctggctggaaatagtaagcttcgagacccaaaatgccttctctactttcctttcatgttttattttgccagtgttttatttcttgcagtgtctttatatctgtattcctgataatcctgtagcattagttaggatagtatgcggtagatgaagactccatttggataggattatagaaccagaagggtgagttttgcctttatctggtaacagcagttgatctgatcacaaacaatctgagtgttgagaacttattaaagattcattgaatgcttcagcaatgagaaatcctggttgttcctatatgcatttgaccccctggaaaagttctgcttgttcgtatttcagaattacacacgcttccaaatcaagctgctttaaaaaacattatctggactagaagcatggatgttcttgcactcttgctttcctttctccatacgaacttttcagtccatcagcttcctttctgtagaagatgaaggcatttcttctgtcctcctcatgcttttgtaacccatgcttctggtaccctgttttttgaatagtgaggtaaaaatccagaaggaagtacggctttatcatgtctctggacggtgagcgtacttggcatgaatgaagagctgataggagctattcaaaccagacagcaaactgatgggatgacgctgccatacataaaaaactcattaattacttcccctgctggacagcagtatatcctgaaaggaagaaagaaaggagcagatgatgatattcgttttgataggtgttctctgtttgaacagcttgtcattgagaagagaatccaggaaaagctgcagcttcagagtgtgatcaggtagaatgggcaagagttatttgacagacagttaagtgacgtattttgggaggaaaaagagggcttagcatggaggtagctggaataaggttccaaaatgcttttgaaaatgttcattttttcctgttagtctttttggctagaagcttttttttttttttttttttttttttaagctttgctaggcattattcacagacatgttgctgagttattttctcatatggttttccctaaagatggaaaataatttttaaaagtctttgagatagaaagagtatactgtgagttttaaatatttgtagcagagaaaaggctgccttttttttttttcctaaatgtatgcctgtttttatacatcttttgggcatatgcgttttgttgctttggagtaaagcattataagtcctcatttgatacaaacttttaacagggtcttcattaaagcttttccttaagttagatgaaatccatattagctgtataaaagaatagatttttaaatgtcaatttcataatttttgcacttcagtttttaaatttaaaattcaaatttttaaaactgcacttcagtttaaaatttaaattttaaatttaaacgttttttccctgcctgagttctttatgagtgtatctagacaatataatgtttttaaattttaaaaaattattatggaacatttcaaacttacacaaaactctgaaaaataatacaaaaataatacatgaacctccagaaactcattaccaagattcaacaattgtcagattcaattctttgctaaaatattttaaagcaaatctcatttcacctatttgtactttagtatgtatatttttaaagtatggacactttttcacatgaccctgtgccattatcacacctaacacattggctataatcctctggagtcatataatatccagttcattttaaattccttgtgtctcagaaactatgtctttatgtaggttttttctgagtgagaatccagacaaagtatacactttaattgttagccaatagaattttaaacactgacagatgaacatgtatgagaaagaagtgaattttagttttatagtggtctttgacacacatttgtaataggaatatttatgcaagagaacatatctttagaatattttcttgaacttttcccacttaacattgcatgatactgaaaaggattgtaatttcatatggtaatgattggtcattatatactggtcacttctataataaataccccaagttttaagccactgattattaagccatttcaatgattgaatgtgacttagagttcagtggagatccaaaatgagagaagtaaaaatctatcaaatggggccattgtgtttatgaggatcgatgactataatattatatatgtttttcattaatgtcaaggtttcttcccaatggattttaatttttctatgaagtttgaactcctagctcctttctggtaaagcataacatttggctgtccacttaacttttccaagaatacaatagcatgaggtcctgaaaataacttgtgtgccacaccctcacctgtcgaaattcattctcattcaggttctctgtctcttctcactcttatctcatctttcaaattggctggatgaaagagaatgggggtggtgaatatggggagccattaaaggggtgtagatggaaattataattttctgtttccatctaagctcaaagccactgctgaggaccgtgctcccattttttatggagggcaatagaatacttctctcccaaggtgctcactcttgagtatctcttgtcatacgtcatgttatggcatgaacatttgggagctttgtgttacactttatgttctcaaattataccttgtcctttaaatcttgctgaataaggactatatgtgccaatcactttttgaaagcttagtaaatagttactgattatcaccatttaatacagataagctgaatgggaaaaggtgagcaaaaatgcttccattctctttccaagttgtctctgaaatttttctcagtcatttataatacaatgtcaacataggagaacactttgcaaatatgcaggttctgctggagaactttgtagggtgggtgaaaaagtggttatagagggaactggaataatagattatgagtgtattttgggtgcaaatatttcatatcattatctctcagtactttagctataaactgaattaatggaaaaacattgacttaagtactggcctgtacagttccaaattatacttcagccattgtggaaagtaattttctccaagactttgctcttggtattcctgatgttgttctttttttttaataaaaagctgtatttatttttactttctacaggatgaactttctgctttgaagcaaggagttgtctacatgaactgtattgttcagagatctaataggttgagtagctagttgggtggatggcttgtttttccaccctaaatatgaggaggaggaggaaagtcttagggatatggacttttatgttttctttgatacatataataaagcacatttttcttttgttcagatgtctcaactctcatctccctttttacaactctatgtattctcatatttaaactgaactctcccattgcccactgtaaagttggctaaacaacttcagaggcatcacagactttcaaatgaatttatgtataagataaatgattttttcttttacaaggtccttttttgctagaacatttggtccatacctagagttatgctcatagctgtttacaaaattataaatacttttataaagaaaaaaagtctctcctttatgctctccagtttttagatgagtaggatttgtggttaatgatttcttccatggcaacggcttccttttagggcatttcaatatgtataatctcaattgagtgtgattatttttcagttaataaatgaagagaaaaagttgcattttaagagagtattgtggacttatggaagctgtttctaaaataaatatgcttttaaattcttgttgaagaaatcaaacctttgttgacttacgtgagtcatgccatgccatttttagcacattaattgtaataataaacatttattgactccttacttggtacaagaccagtgcacttggttctttggatttataatgcataatttttaacagctctgaggcagactgttatcattcatcttctataaagaaggaaactgaggtacaccaaggttaagtaacttgttcaagtttaccctgttattaagatgttgaactgtggtatgaacccagcctaggtggttttaaagtccagtaagattgcctactgagaataaccatcattcaacttaagcgtgagactcccagtataatgttgaaagagtggcgtctctccagcatgactaacattctacaaaaatgaaatctgcagtttcttggagatcttagataacctggagagttgactgtctttaatatatagggaatgtgttcttcttgtttctatgtcttgaatttataaagggtgatttatttttctttccaaaattgtattatggcctctcaaatagcaatgtgttttaaaatactattcatttatgttctattaaatttttttttaaaactaagtagtggtatgaggggggatatgaactagagtggttgtactttgcaatacagttgattattaggaaacagttgctgtcttcatatgtattacattcgggtaaaacgattgcattttttttcttttggcatcagtttgttggagaaaaaaagattgcatttttatcttctaatttagacactttaaatgaatctttcatttttaaacttctttagtttattcctctaccatagcacccacttttttcactcatctcaggccttaacctgtgacctattatttggctctttcctaatttgtcatccttaatattttgaccttatactgaactgcagacaaccactagaggtctccagaccacactttagaaagctctgattttacaaccataccctagtaagtggaacagatacgttcggggggagattgggtactaatattcctcattaagtatttgtgaaatgcttcctatattccaggttctagaactatgctatgtcctggcggtagactttttttttttttaagtaaggacttagaccctaagaaccctgtaggctagtggggacactaacatttgaacgtgtggtcacaagatgtcacgttaggcacacccacatcacatccttttagatcctaatgactggagtcttttagatttctaagtttgtgaatgccccactaatactctctgtagcgagatcattcctgctttcttgatgagccctgatactgcatcaatctggcaaggagccattctctgggggcaaataggattatttggatgggctttggggtttttttgtttgttcgttttctttttttttttttttttgagacagagtctcgctctgtcgcccaggctggaatgcagtggtgcgatctcggctcactgcaacctctgcctcccaggttcaagcaattctcctgcttcagcctcctgagtagctgggattataggcgcccaccatcatgcctgtctaatttttgtacttttagtagagatggggtttcaccatgttagccagactggtctcaaactcctgacctcaagtgatccgcctgccttggcctcccaaagtgctaggattataggcgtgagccaccgcgcccggctgggttctggtgttttactttctgatacccttctcagcagctctggcatctgatctttagggaagcacttcatacaaaagccagccactgcctgtctcagtgaacaaggcagaccccacagagattttagaccttccatttccattttgctttatatcagataaattttaaagaaaggatctatcttcctcttggatctcttgtctgttagggctgtttaaatagacaggtatctcatagaaacagtcttagggacatattctgattaacccatgcaaagcacctagcacagtgcctggcacagagagggcagatgcttagtagatgtcaagagttgtcataattattatggaatttaatttaattttactgctggaagggactgtagagataatttagtcctgccatccattttacacaataaattttagtgctctttttccttctcatataggcatctaactgttaggagttgttctcttcagttatcccatgttaggaaggccacaattttgatttagtcattatccgcttaatgattatacttctgtatgagaattttttttttttttttttttttttttttttttttttttgagaacgagtttcgctgtgtcgcccaggctggagtgcagtggcgcgatctcggctcactgcaagctccgcctcctgggttcacaccattctcctgcctcagcctcccaagtagctgtgactacatgtatgtgccttcatgcctggctacatacacattttagtgggaacatgaataaatgaaaatgatcttgatcataattgtatgctatgcagaagataaggggggaattatagacagacagatattatgcagggaaatttagtgatttgttatgtttttaaaggatttgagtctgatgtggcatgttaaaaaatttaggaattagcaagaggttatgatgatgatccagggaaaatatgatgattccttagactaaggtaataatagatggaaagaaagggacagattacaggaatatacagaggtataaatgatagtttgctgatgaattaggtatctaggtatgatggggagagaagtgttgagaatgaccctgagaactctggcttgagtaactgtggctggagatgcaatatgctgaaattggggaagctggatgaggaacaggtttgggaaagggaaatcaagagagaatattgaacaagatgggctgtggatctggtaattcttaccttctgaaatacttgaggcatgtgaaggaatactttacaattgacatatgtgagaagcaatacactgttacatgttatttttttaaataggtccttttttcccccattcctttgtttttcattacggtttttaaccttactttgttttttcctgtctctgccacttacatgtaacaccaatcataacttctctccgtgcaagtatttcagtgagataggaaaggaattaatgaatcaatctttctgtgtggggtgtggttggaaatagccactctaggaataaatatgctgtgctctgccccccaaacctggttgaaaataatttctttaaaatcatctatgaatgatttttgatatggaacatttctttaattttctaaaaagatttcttggttatactggttcataggaacacactctcctcagatgatcaggcacttcgttttcttttttttttttttttttttttttttgagacagagtctcactctgtcgcccaggctggagtgcagtggcgcgatctcggctcactgcaagctccgcctcccgggttcacgccattctcctgcctcagcctcccgagtagctgggactacaggtgcccgccaccacgcccggctaattttttgtgtttttagtagagacggggtttcaccgtgttagccagaatggtctcgatctcctgacctcgtgattcgcccaccttggcctcccaaagtgctgggattacaggcatgagccacctcacccagtgcagacactttattttctagatgagaatgctgagcatctcagaggttggcattcacccaaggatgcagatcttgtaactagttaaaagtcgatacgttagaacagtagaaccttaagaatcaaaattctagccaataattcctcctatgagacataccatttacttatcagtttctttaataagagaaattcttatgcataatgagaaatgaaatatattttatggctgggcatggtggctcacgcctgtaatcccagcaggtgtgagatttaggaggctgaggcaggagaattgcttgagctcaggagttcgagaccagcctgggcaacatagtgagactctgtctctgtaaaatatcaaaaaattgtccaggcatgatggtgtgtacctgtaatcccagctactcggaaggctgaggcaggaggattgcttgaacccaggaggtcgaggcttcagtgagccaagttctcaccagtgcactctagcctggacagcagagcaagactctgtctcaaaagaaaaaagaaaaagaaatatttttaccagaaatacatttgataaggtaaaaatagttacattatttatgtaaagacttcatatttaaaatttgataagattggtactttagtcctcagttgaacaaacagtttagcacctaaaacatgtgcattgttctagacactggatatatgagcatgactaagggataaactctgctcccacacagctgaatggaccgcggaagacaagcatatcaaggaataatgttatctttatgttatactcaagtcgctatacagcagaagataaaatggggctcacatgaaggaggaaatagctagtttaatctggagatgtcagggaggtatgttaagctgtgtcagctgtagacattggttaggtgctctttgaaccccttcaaaagagttcattttatttttattttttaagaagttcttttttttaatcccaaagcattaataagatacttatgtgctaagtgatgaatgtagttctgagattaaatataaaacatttttaaaatatttctagtggaagtggcaacaaaatctctctctctctctctcacacacacaacacacacacacacgagacacagactctcttcctcattttaacctaagtattctagttgccataacaacctgattgtggtagtgcatttgctgctatggttgaggttgtgtcagcagttccattataagctgcaattttcaggatcctaaaattcaatgtcacattcacagacgtgacatttaaaattctatttattaatttgattttgcctcatgcttaaatctccaaaaggcattgacctctccccctgtgctgaaagaggttcgtgtatctggtttgtaggcttctgcttttgttaatttgtattttatttctaaaagaaacctccatatctgatcacggtcccttattttataaagaggaagttgaggctctgaagggtcatccgacaaggcccttgccttgccttttcacccttaggcaagtcatccgacacgaatccagtagttatacactactgcacagatgttggagttcagtggcatcttctgcttagtgatgtttttgatttttggttaaatctcaccatgacatgcctttcatttttttgcatatgtgtctctttgtgtatttgatatatatcctttctgctgtaataggattcattctgttgtcacattccatgttgtagaaattggtttatatgtctttctgatctccactaaacgtttctccagggtagacaccatgctttactccttataatgtctccagcatttgctgagaaggaccagctctgcctcctcttcttcctcgttctcattccagttcacctggtgtctgacctttcttgttgcttattcttagtgcttgaacctaatgacctgtctttagaggggttggggagtgggcactggtgtggagagaggagggggcctccctctgcccctaggtagagtctgggggttcaagagtgtggtgctcggagggctatggctatgactgaagtgtagggagtagtgagagaggttaaagaggcattaaggggcctgaaggtagacttggattggacttcctgctgaggaatctgaactttgtttagtagacaagagggacctattgaaaggtcataagcagggaagtgatatgaagagattacctaaaactgctgcacattcaggtccttgaagactgaaattcgtatttaaaaaagtatggcataaacaggtaattattctatctagtaggaaaatgtaaggtcagagaggagagtaattaattctgccttgggtttgatgacaggaagctttcacaaatgaggtgatgtttcaactggatactaaagggtagctaggattgcaccatgcagggaagttgggaagatggaattttagacgtgagaagcagcttgagtgaagaatcagaggcaagcatatgcttggcatattgggaaaatcttgaccctgctgatgttgatgtggtgccaggtctgaggagaccaatggcttgagaggagactggataggatgggctgaaagcaggtcaccaaaggtttttggtgccccactatggagtgaagattttatgctctagatagaggggagctgtgagctttaaaaaagcagctaaaagacacgagcacacctatggcatagagaaatagctctagcagtttagaggatgaattggaaaatgagagctggatgctattctaccagaccaggtaaaataaacaaaggtgcctgttgaactaggatggtgggattagaaagagtataaatagaggattaggaatgaagaagaggcatgtttcaaaggttaatttagcagatgtgattggctgtatggggaaaagtgtataaagaagttttctttcttttcttttcctttttttttttttcttgagatagggtcttgctgtcttgcccaggctggagtgcagtggcatgatctgggctcactgtaacctctgcctcctgagttcaagtgattctcctccctcagccacctgagtagctgggattacagatgtgtgctaccatgcctggctgatttttttgttgttgttgtatttttagtagagatggggtttcgccatgttggccaggccagtcttgaactcctggccttaagcgatccacccacctctgcctcccaaagggctgggactgcaggcgtgagccacagtgcatggcgagaagaagttttcttattattcaagcgtctaggtgaattattttgcaatttatcaaggtaaggaaaacaggaggagaagacagatttggttaaagataatattttgaaaagttcatccacattttaaaatttggggtataatttacatataaaatgctcaaatcttaacagtttgataagctttgacaatttatgtacacctgtgtaaccacttctacaaacaagttatagaatagtggttcttaatatttagtgtgcattagaaacacctggatggcttgacggaccgtaagttgctactcccactcagagtttcagatttagtagatctggggtgaggactgagaattcaactttctaacaattcccaagtgccactgggttcagggaccacactttggaaactgctgatataaaataccactgtcactccagaaaggccctcttcaccctttttgcctctctccccaggcaatcacagttctgatttctagcactgtgattagtttgcctattcctggactgcacaaatggaattattcagtattcgcttatgtctggcttttttttttttcatacaatataatgattttgagattcccctatgttgttgcatggggtttattcctttttacccgctgactagcattccatcatgtgactagatcacaatttgtttatcatttctcctgttgacagacatttgatttagtttcaattttgggatattataaataaaacttccgtgaatattaatatacaagtctttttgtggttatatgttttcatttctcttgggtaaatacgtaggagtaggattgttgggtcctagggtaaatttatgcttaattttataagaaactgccaaaatagttttccatagtggttgtaatgtagtcaaattgtgattaaatttttattgactctagtgaagatcctagacattgactagactgaaggactttttgtcaaagaagaaaggtctctaatggacaaggaagcttggcagtgttaccctttgggatatacgtgtggctaaataacagtgaccgtggaactcttccaaatcctaagagaattgaaatctatgtttagatttaaaaaatgtagttcattattcattcaaagaacagttaataagcacttaccatatattagccatagaagggcacgtggctcccagtactgttcctgaggagctcacaggtaaaacaaattattaaactttaagaaggtgcaaggcagtgccttaaatctaaactatcttactcctagtttatctgaatgttatttttccagaaattctaaatatcagacaatgaggacataaaccaaaaaacccaaaaaaaactcccgaacatttcacatcactggggaaaaagatggatttgtcaggaaaatggtgttggtccaagtggagttcaccatctgggaaaaaaattggtattcaaacctcgtatcaggatgatgtcaacatgtgccaaagagtttaatgcaaaacaaaaacttaatgtaataaaaatattagaacaaattatagacatactcttttctaatgtcagaatagggaaggtgttttaaaatattggacaaaatccagaaatacaaggctgttaaatctgattatctaaaagtgacgaatttctgcatggcaaaacccaccataaccaaggccaaaagataaatgattatgtgtgtgtgggcaggggagataggatggtgactcattacagagaactagtttccaatatatatgatgtgttttaacaaccctattaaaactgggcaaaggctatgagcagactgttcacagaaaatgaaatgcaaatggctcttaaacatgtgaaaagatgctcaatgcactcataggagagatgcaaattaattacactgaaatacatattttcagttatcagattgacagatcagaaagtttgattagactttgcactggcaagagtgaggatgcgcagtgttggagaagaagggcatttcaagttgaggggaattggaggagcggggagatggaaatgggaaaggtagggccagcacattagagcaggacaggtgagctaatgtaggggcaggcgtgttgactttagcaaggagcgacagctggcgctctagtgtcatgggagaagcagggaaactagatagctacacgcaataactacaaatgctggtcaccgcggaggcagacggccctacagataacagcccgagggagtcacttaccccaaaaggtcacattattcccagcattttccatttaaggaagcattaaaatagaatttttaatggaatgaaaatttaacactcttaacaaattatagtttaaagatatattcttcagttgtcttaaatttaatttttggagaatatatatgaagatgctgaatacatgaaacacatctctactggtttagctgcttattgctgtttgtagcttttcttatggtgaattacgttacatcactgaatgcttaggacaaaaatgtgcagtcatgcttgtgtctccctttggttgcaaaggtagcataagtaactgattcggagagagattaactattagtgtttaattttggaaaagcaagtaatgcatgtaatttaacagaatggtgcttttctttttaattcccatccccccgacatttcttatcttcctatgacttctgcctcatcactcattttattttcagaattctaaaattcataatactctttaaaatgaaactatcatttttcctgactagcttagtattggaggtaaatagataactgcttgagataccttttggtctaggacgttataattctgtgtggtacattatagttttaagcgttgtacgttgtggattatgcctgcagatttatacatattaggggcaaatagagcaccaaatatttaatgatattcttgtttgcttacattcctaaagaagaatgtaattacatgttcaaaccaacaagttaacttgatttacattttccttctcactcacaatttggttgctatctagatttttttttaaaattcaaccctatgcccaaatatatttcaatagttccttgagtcactaagacaaaagattaagggaaaaaagtacacctaatagaatactttgaatattgaccagcaaagattgtatagtattttctgacacttaaggttatagattacattttaaaaaaattaaaacaaaaaagacaatactgtggtgtcagatagatagtattctttatggtatctgaaaagcaagcttattttatattgaattcttgtacagatgggcattatccaaaatgtcctgtactcactccagtgcaaagctgtagaaagatagccatttggtaccttccagtggccctttcaaggacttttctgggtagaaaatctaatgattgagaaaatgttgatattgataactcagatattatttatcttagttaagaagagttgagtttgtgggactagatgcagattgaaaagtctttattatactttaagttctagggtacatgtgcacaacgtacagatttgttacatatgtatacatgtgccatgttggtgtgctgcacccattaactcgtcgtttacattaggtatatctcctaatgctattccctcccccctccccccaccccatgacaggccctggggtgtgatgttccccaccctgtgtccaagtgttctcattgttcaattccctcctatgagtgagaacatatggtgtttggttttctgtccttgtgatagtttgctcagaatgatggtttccagcttcatccatgtccctgcaaaggacatgaactcatccttttttctggctgcatagtattccatgatgtatatgtgccacattttcttcatccagtctatcattgatggacatttgggttggttccaagtctttgctattgtgaatagtgccacaataaacatacgtgtgcatgtgtctttatagtagcatgatttataatcctttgggtatatacccagtaatgggatcgctgggtcaaatggtatttctagttctagatccttgaggaatagccacactgtcttccgcaatggttgaacttgtttacactcctgccaacagtgtaaaagcgttcctatttttccacatcctctccagcatctgttgtttcctgactttttaatgatcgccattctaactggcgtgagatggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgattttttcttgaaaatttaagttctcgaaagtttaagttctttgtagattctggatattagccctttgccagatgggtaaattgcaaaaattttcttccattgtataggttgcctgttcactctgatggtagtttcttttgctgtgcagaagccgtttagtttaattagatcccatttgtctgttttggcttttgttgccattgctattggtgttttagtcatgaagtccttgcctatgcttatgtcctgaatggtaatgcctaggttttcttttagggtttttatggttttaggtctaacatttaagtctttaatccatcttgaaataatttttgtataaagtataaggaagggatccagtttcagctttctacatatggctagccagttttaccagcaccatttattacatagggaatcctttccccattgcttgtttttgtcaggtttgtcaaagatcagatggttgtggatgtgtggtgttatttctgaggcctctgttctgttccattggtctatatctctgttttggtaccagtaccatgctgttttggttactgtagccttgtagtatagtttgaagtcaggtagcgtgatgcctccagctttgttctttttgcatagaattgtcttggcaatgtgggctcttttttggttccatatgaactttaaagtagttttttttttaattctgtgaagaaagtcattggtagcttgatggggatggcattgaatctatagattaccttgggcagtatggtcattttcatgatattgattcttcctatccatgagcatggaatgttcttccacttgtttgtgtcctctttatttcgtagagcagtggtttgtagttctccttgaagaggtccttcacatcccttgtaagttgtattcctaggtattttattctctttgtagcatttgtgaatgggagttcactcatgatttggctctcttgtctgttattggtgtataagaatgcttgtgatttttgcacactgattttgtatcctgagacgaaaagtcttattttctaatataaatgttgggatgcttagggatctatgtgttgttgaaatgaagtgtttttttttttttttctctttagcctcttatggacaagggtgtatggcctgtccaacttggtgttttgggcatatgtagatgtcttcgtatagtgccctattaggcattcagacatacttattggttgattggtaaattcttgtccatgctgttttcctcagttggatagtttcagttccacatctagttcaacaatctcagaagattaggtaaagttgtgtagttattacaaaaaatgcatatttaatatctattttttcatttatgctgttttgggagccagtttttaaaaaagacgtaatactctttcattatttatgcggtttcctatctttttggagaatcattgtaattttattgccattgagtatgttggtatctgactcagaaagggaagaaatactgaaattacagtggatgagacttaatttctcatttcctgcaaccaagttactacaggtgtcccaattatggataagcatctatctagacagataaagtaggatagatttaggagtcatcttctaatagtttggggaataggttgcaaggtatattgctctctttgctaatgctttgcctcctccaactccctctatctatacctttgaacctggagtgattttttttcccctttttgatgtggaagacaggctgacttatcttgctattgaagataatatcatttccacctgtttgtgagctgctgttatctatatatccaccttggcgcagatttatttctaaagctagaccagacagaattttgttctaaaatatatcttttgttactgcagccacataaaccctgaataatctatacatcttgctattgaaatcaaatggatttttgagctctagagctctgcttacttgggtggggatggtacattgtgtatagtaagtatttaggaaattaatgtttggccttggtcttatccagctttccagatggagttgagagtgatttctctgagaaatagaagcatcttctcagtaaagatacatttttactttgagtctatttatcaaactttcctctgtgctagtatggtctttcctaaacaatttcttcttatcattattttatattcattatatatatggtattgtgttaatagacatggttctgtaacttataaagtagcctttacctccatcttctaccttatttgccttcaaggagacaggtttgacaaaaatggaagagtgtgggctaaggtataatgagatttgttagaggagggaaaggggaatgaaagaaggaattttttttttttggatggcaaattgcatcttttttttttttttattatactttaagttctagggtacatgtgcacaacgtgcaggtttgttacatatgtatacatgtgctgtgttggtttgctgcacccattaactcgtcatttacattaggtatttctcctaatgctatccctcctccctcccccaccccttgacaggccccggtgtatgaaatgaaggaatttttgaaggctggtttagactttttggttctgggaataatgtctagaagtattaaattgacatggtcaaactattaattgttaataaattactttagaaatactgtgaggaatgttttgaaggaagcgtacctgagagactaaaaaatacttaacttccctcccacgcacaggcctttataaacgttttggtgctgcgcataggaatgctacacaggctttttaacatctggccttggctgaagtctcctgccacctctcacaagttcacccttgtgggtttgttttcttcctccccccactcgcctcttccctcctctccccttcctcccaccctctctcccttcctttccttccttctctttcttttctttcttgacagggtatcactctattgcccaggctgcagtgcagtggtgcaatcatagctcactgcagcctcagagctcctgggctcaagtgatcctcctgcctcagcctcgcgagtagctgggactacaagcatcagccaccctgccttgctaattattattattttctgtagaggcagggtctcattatgttgcccaggctggctttgaactgctggcttcaagctgttctcctgccttggcctcccaaagtgctgagattacaggtgtgagccactgaacccagccagaagttactttagaaatactctgaagaatgttttgaagcaagtggagccaaggagactaaaaattatttacctccctcccacatgcaggcctttataaagcctttggtgctgtaggtaggaatgccacacaggctcttcaagatcttgctttggctttagtttccttccacctctcacaagttcacccttgtgggttttttccttgatgtctttctttttttcctctcagcttattgaggtatagttgacatataaaaattgtatctatttaaggtgtacaatgtaatgatttgatatttgtatacacagtgtaatgatcaccaatcaaattaacacacctttcactacacatggttgccctgtatgtgtgtggtgagaatactaagaacaactcttagaaaattgtaagagagtaatattaattatagtcactatgctgtttgttagatctccagaacttactcataactgaaagtttgtaccctttgaccagcatctccccatttccctcacactccagcctctggcaaccactgttctactctctgcttctgtggatttgactcttagtccacatataagtgagatcatacaatatttgtcttgctgtgcctggcttatttcacttattataatgtcctccaggttcatccacattgttgcaaatagcaggctttccttctttttttatggctaaataatattccatggtatatatatatcacattttctttatccattcatcccttgatagacacttaggttgattctgtatcttggctatcgtgaatagtgctgcagtgaacatgggagtgcaggtatcttttcgagatactgatttcattttggccgtatacccagaagtgggattgctggatcatatggtagttcccattttaatattttgaggaacctccatctgtttcccataatagctgtaccaattatcttttggcttatttttaaaaacagctttattgagatataatttacatatcattaaatttactcattttaagagtataattcagtgatttcttcgtaaattcagaaaatcatgcaacatctccccagtctaattttacaatgtttccatcacccagaaaagaaacctcgtgtccatttgcagtcacttccccttcccacacccagcctcaggcaacgactaatccacttaaaaaatttatgcataataattatacatatttatggaatatacttgatattttgatgcatacaatgaataatgatcaaatcagggtaattaggatatccatcacctcaaacattaagaatttctttgtatagagaacatcccaaatcttatagatattttgaaatatagcgtaaattaacgataactatagaccccctactgtgctgttgaacattagacttatttggctgggcgcggtggctcacgcctgtaatcccagccgaggctgaggcgggcggatcatgaggtcaggagattgagaccatcctggctaacacggtgaaatcctgtctctactaaaaaaaatgcaaaaaattagccgggcgtggtggcgggtgcctgtagtcccagctactcgggaggctgaggcaggagaatcgcctgaacctgggaagcggaggttgcagtgaggcaagatcacgccattgcactctagcctgggcaacaagggcaaaactccgtctcaaaaaaagaagaactgtttgttgaaatgagttgaattgaattgtcatatttaaaaaccttcaaaagtcagccaggcacggtggctcacgcctgtaatcccagcactttgggaggccaaggtgggcggatcccttgaggtcaggagtttgagaccagcctggccatcatgatgaatcccctgtctcgataaaaatacaaaagttagccagacgtggtgatgggcacctgtaatcacagctacttgggaggctgagacaggagaatcacttgaacccaggaggtagaggttccagtgagctgagattgtgccactgcactccagcctgggcgacagagtgagactctgtcttaaaaacaaataaacaaacaccttcaaaaaccataccttattttatcctttatcctgtgcatccttgggttctcaaactcctgctgtagtgttcgtgagtgacacagtgatgacttctttgtcttacatttttagtatctttatttaggtatctaaatatttagatatttattaaaagatactaacacttattaaaaagtattgttactttatttttatgcttccttgcatctttaaaatactgatgatctttagacacttagatatttaaattttacttttaaaatataaaaaataggctgggcgtggtggctcacgcctgtaatcccagcactttgggaggccgagccgggtggatcacaaggtcaggagttcaagaccagcctggccaagatagtgaaaccccgtctctactaaaaatacaaaaatcagctgggcgtggtggcgggtgcctgtaattccagctactcaggagggcgaggcagagaattgcttgaacttgggaggcggaggttgcagtgagccgagatcatgccactgcactccagcctgggagacagagcgagactccatctcaaaaaaaaaaaaaagaaaagaaaaatagacattgtttgatactctcataaatatgttggatgttttcagagatagcatgtggtctcagatgaagatctaattgtatatatacttgagtgtgtttacacttacagtttgaaaagatttttaatgccattcttaaaaacctttaaagcagaattgttcatgtattttctacctagcagaaatctattgctgtaatattttccatccattacagacatggcatagccataatttttgtttcaaatgactttcaaagggagtctgagggatgataccactcagttaaattgcttatttaattacagttgaccctctgtatctgaaggttctgcatccacagattcagccaacagcagattaaaaatatttttaaaaactcaaaagataaaaataatataaaaaaatagtaaaactatttacatagcatttatgttatattaattattataagtaatctagaggtgatttgaagtgtacaggaggatgttgtatgttatatccaaatacttcaccattttgtgtcagggacttgagcatccacagattttggtatcctcaggggttctggaaccaacctctccctccctggccccctgcctcctatatggtgggatgactggatgtggtccccaaacgcatctacgtattacagatgtttctattttgcttatctttttctttcagtctctcatgatggttttttacttttcctattcattggttggggtttacctctcagttttcaaggaattaaaacactaggagcaccccgtttggcttttctcttcctcatgctgggagcattcgttgtttggtttttgcccacaccaatctgcaacagaggcatatgagtctgtctggaagccagcattttctgtccgtggtgtcccagagttagatgggaaaggagtcttggagaggctggagtcttgcgcttgactttggacaccctctactttatcttcctgtttccagtggagccccctccacctcttccaccagttatgcttggggtccctgcatccagagttcctctaattccatggccctaacctgtctacagatgagaaccacctggggaaattgtgaaactgctgacaaccagccacacctcataccaatcaaacttcaaatcagaaactctggtgggactcttgagtgttttaaagctctccaggtgagtccagtgtgcagctgagcagaggaatcattgctcagattgctcctcctgtgaccgagcccgcactacatctgtgacttctctgctgcccttttactcttgcctaaccgctccccgcaaccgcagctactttgctgtaccctctttaattatgcgtccatcctgaggtatgtgcacctgctgctctctgtctggagggctgtttcccttgtcctgtgcatcactcacttctccttccttttagatctctgctctgtagcaaaaactgccccacgcttcctacccaccggcctgcttcctcttgcgccatagcagtcatgacatctgagctaacacagatcctcctgcttgtggttccccaatagaatgtaagttccatgagggcaggactaagctttgttcccttggagatttctgggcatctagaactgagcctggcatccaggaattgcttgcccgattatcagttgaatgcatttctctagagattttctgctggtgttggaaggagtgttggttatgtgatttattgtgttggacaggagatgagggggagtgactaactgctctttctgagatttttcagccctacctctgcctcctttgcctgagcctttattttgggctgtttttctaaggttcacattactagggctgccaagtcagttttggccactgtcatatcttctctttgtccttacagatttatgcttccagatatatatatctttaatacttatttgagtatttgggaggaagtacaggtaacatttgtattccatccactctgtttaaccagaagctgggcccttcattacttcctcctcagttcacacacagattaatttcttccatgaatttattgaatactgactatgtgccagacactaagaataaaatatacagttcctgctctcactgaggttagtaaacggtgaatttggatgaaaagaatcaggagttctttttattattcttgcaatatttctgtaagtttgaaattatttaaaaataaacattttcgggccaggggaggtggctcacgcttgtaatcccagcactttgggaggccaaggtgggcggatcatgaggtcaggagatcgagactatcctggccaacatagcgaaaccccgtctctacgaaaatacaaaaaaattagccaggcgtggtggtgtgcacctgtagtcccagctactcaggaggctgaggcaggggactcgcttgaactcgggaggtggaggttgcagtgagctgagattgcgcgactgcactccagcctggtgacagagcgagactccatttcaaaaaaaaaccaaaacaaaacattttctaagagtgcaccaagcagacccacaaaatcatgaagagctcctgtgccatgccagagatcctgaaggctctgtgaaccattaaaggttttaagcaggggagtactataaattttggaattgagaaaaattaactctgagtagaaactaggatgggttcagggcatcaagactggaggaaggcataccaggtaggaggctttgcaataatccagaaatgatgaaggcctcagatgagacacttacggtggagaaaagcagcttttcccataatgcccattttaccagattctcttggaggtaaagctgtttctgtggtgacataaccagccattattaagggaagtgggcttgttcttataagcgaaatgtctcttgtggttgtacccagagacaaagtagtaggatctatgacaagattgacattgcaataaataaagagacccactagaaagtagcttgggttattgccattcagggaacagctctgtgtgattacagacattgctcagaactgaattcatctggtctggtggatgcaatgctggaatctgtactaataaattttttgtagttatctcacccataaattttctatttcattggatagcctgtgctcattgctgtggagagtccgtgcctggtatgccaagctaacatgtaccttaaggactttctatatatctgctttaatggaaaggcatttctatcatttttacttcaaggttttctctttttacaaaagaacttttggtgggttttttttttttcgagactgagtctcactctgtcgcccaggctggagtgcaggagcgcgatctcggctcactgcaagttccgcctcccgagttcatgccattctcctgcctcagcctcccgagtagctgggactacaggcgccggccaccacgcccggctaattttttgtatttttaatagagacggggtttcaccatgttagccaggatggtcttcatctcctgacctcgtgatccacccgcctcggcctcccaaagtgctgggattacaggcgtgagccgtgcctggcctggttgagtgtttttaaaaaaatttatgttgatttccattccacacgcaggtattgttctttgtgcttaacatggaaactttgtccagagaaacttgtctggagaagtccactttcctcctacaatttagcaggtaattaaggagaactgtgaaattgatcaattcactggacacgttatagttgccggcactgaactaggtcttgtgggtttctctgatctgctcagggacagggatcatggcctaattaatttctatattcttcttcagttaccacagtatagttgcttgtttcataaatgtttgttgaattgagcaggggatgtgagagaagtaaaggcgttgttcagtgaccacattcagactcgtgtgggtcttctgggcaactttattcagtaggttcctgttggatgttgggaaaatatagtactatcagtcttacttgaagagttgagacaaatgaattaatcaaaaacatttttaaaaattgtgactaggccaggtgtggtggttcatgcgtgtaatcctggccctttatgaggctgaggagaaagaatcacttgagcccaggagttcgagaccagacagggcaacatagcaagaccctgtttctaaaaataaagaagtatataaaataaattgtgattaaagaaaaacatataatttaccatggtaacaacttttttttttttttttttttttttttaaagacggagtcttgctctgtcacccaggctggagtgcagtagtagtcttaagtcacagcaatctctgcctcctgagttcaagtgactcttctgccgcagcttcccaagtagctgggattataggcgtgcgccaccacacctagctaattttttgtattttagtttcaccatgttggccaggctagtctcaaactcctgacctcaagtgatccacccgccttggccttccaaagtgttgggattacaggcgtgtgcccagcctattgtaacaatttttaattgtacagttccatagggttaagtctagaatttgttcatcttgcatatcagaaactctgtattatacactatctcccttgtttgccctccctcccagcccctgacagccttcattgtactttctatttttatgaatttgactactttagatgcttcatataaatggaataatatagtatttgtcttttagtgactggcttatttcacttggtaataatgtcctcaaggttcatccatgttgtagcatgtgacaggatttccttccttttgaaggctgaataatgttccatagtgtatatataccacattttgtttatccattcaacagacacttgggttgcccctacctcttggctattgtgaattgtgctcctatgaacatgagtagccaaatacctcttcaagatcctgcttccaactcttttggataaatatccagaagcaggattgctggatcatatggtagctctattttggatttcttgaggaacttccttactgttttctatagcagttgcaccattttacagccccagtaacagtgcactttctttatgttcttgccaacattcacttttatttttctgttaaaaaatgtgttacggtgttgaatctacattctgtatgaatgttaaaggtaaaacagaaggctccaaataaatcatgatttttgtggcagatcctctaatgaaaggaatatagaacttttgataagtcctgaatgataaaagaaatcctcaggatattgtaattgagaagaattcatgcacatatatagagataaaaaaactttggctgggcacggtggctcacgcctgtaatcccagcactttgggaggctgaggtgggtggatcatgaagtcaggagatcgagaccatcctggctaacactgtgaaaccccgtctctactaaaaatacaaaaatattagccgggcatggtggcgggtgcctgtagtcccagctacttgggaggctgaggcaggagaatggcgtgaatccggggggcggagcttgcagtgagcagagatcgcaccactgcactccagcctgggcaacagagcgagactccatctcaaaagaaaagaaaaaaaaaagataaaaaacttcctctcaaagcggcatgttaccaagtacaacttcatttaaatacttagtaccacggttgttgagtagacagacgtcttgaattatgtcaataatgtaagactttctgaaagtgatacattttgaatgggagcttgaagggagatggtgtgaactgacagcaagaggagtgggcattaatatataaaaaaatgtgatcttaaaattatacaaacatagaatttgacaacaggagctaagattcaatgctttttcttctctatttagtaatagctgtaattggaaatagtaactgagtttatttaatgaggacagattaatttttttgtgattttcattgagatttgacagtaagtcttcaagtgctgtaacgatttgtgtcacacaatccctagaaaggattcaaagcttacttgataaacaccattttgttatctaacctcctaggactgagtgtttttgttgtttgtaatttagggcaggctgtccctttattttctttgttgttgacatggctacatgtacaaaagaacacttactatcaagaaagcaaacactggaaagctgaagtgtgtaaatagctaacaatgtgttctacttgtacaagtattgcctatcctctgcaaatctaagtcaaccttcaagcaatgacgttttccatatgaatgaggagtgtaagactattgtcccataagttctatttttttttgtttttaatagattttcttctttcataggatatgtcttaaggcttgtccatctttagtttttatttcccttattttgctggtaatttaaattattctcactttgtattttaattaacttttgcttaaaagtttatttttgtttttaatgtaaattgtgcggttcccaaactgaaactagaacaaccagacaagatataagttatactgtgacaggataatagcagtttacatacttggaccagacagctggtggtagtttctgtcacatgtgaccatattctttgattggtaggtttcagttgcgtgtgtcaggaggaaagtcttactgttcgtttaaccttaaatagttggatgttggaaaattaatatttagaaatagataaatgattctttgaatggtacagtgtcagaagcaaaacaaaaaaaaaacagtttcagtttagctatgtgaatttaatctaataacaaattttcagcaaaagattttactcaagtaccttccaaagtgagttccttggaataccagttttatagggtattagtaaacattctgtgaagaaagggtgttaacagtcacatgggttgagaaaccctagattaaacagtagaaatcagatttcttaactctggggcttctcaaagcctttaatgtttgaatgttcattgtgaattgattaggaatgagggataacctgtagtgtttctgaaacatttgtagaattcttttttcttcgagcatcttgtagaactaatactctgtaaagaaaccgtggaacaatggattaggaagcatttagagcaagaggtttgttggaagttacaggaggtatgtatggttcagatgaggttgaatccctattcagcctaagcgataagaatttcatatcgtggctgggtgtggtggctcacatctgtaatcccagcactttgggaggccaaagtgggtggatcacgtggtcaagagtttgagaccagcctggccaacatggtgaaaccccatctctactaaaaatacaaaaattatctgggcgtggtgtcaggtgcctgttgtcccagctactcgggaggctgaggcaggagaatcgcttgaacccgagaggcggaggttgcagtgagctgagatcgtgccattgcactccagcctgggcaacagagcgagactctgtctcaaaaaaaaaaaggaatttcacatcttgcaaagacatttcaactaaactttatgtgtgcaacctgcttcccagttttataggtatgaccggcatactttcataggtacttggcgacgcagtactggggatgagctggcctgctaactagtaattcataatattgtatttgcacttcacaacttagggaagagctgaaaggttgagaagaggaaaaagcaaatttgttttattgaaatatttggcattactctattttggaaagttaatagctgccttaatgattttttaagattgttagaaggaaactgagctgcagacttacattacttgttcagtccaaattacactttccccatctgtttaacaaaaaatgcgtcatagcttaggctgctataacaaaatacttaaactgggtggcttaaatgacaaaatttatttctcataattctgcaggctgggaggttcaagatgaaggcaccggcagattcctcctgctgagggcctgcttcatggttcctcgagagtatctttttgctctgtctttacctggtagagaaaggaagcaagctctctcagaactagtagaaggaatgtaaatatacttaacactactgaactgtaaacttaaaaatggttgagatggtaaatttaacgttgtatgttttctaccacaatagaaaaagtaaaaagagggatattaatttcattcatgagggcttctccctcatgacttcttctaatcctaactacttcccgatggccccatctcctaagaccattacattagggggtagtgtttcaacaaatgagttttgggggaacacaagcattcagtctataacagaaggcttatagaattttagagctgtagcaacgtttagcaatcatcctatttttaagatgagaaagctaaacacgagggatagtatgtaacttgctttaattcacagctattttgaaagcagggtttagattagaatccagatctcctggttcgtagtttgataatttccactgcactttgcaaccctctattgtggcagtgagttgtctttctctgttgctcattatctgtctctctgtaaatatattttattgtttctttagattttacctctgtaggggattttgcctttagcatattttcttcagttgtacgtgttactccgtaagtaacaagcgatactgatttctagcctatgctcctgtctcctaaaatggttccatttgatactctggcagtttatgaattgtaattaattaatgaaattggtttaaatactattgaacacattgtaaattcagtgacaatttgtatagaagtgaagaagagggaagactgaggttcttcctccctccctgtggtctcaaggctttagtgactggtagaatggcagtgccgttgaaagaaataggtgtggccgggcgtggtggctcatgcctgtaatcccagcactttgggaggctgaagcgggcgaatcacgaagtcaggagttcgagaccagcctggccaacatggtgaaaccctgtctctactaaaaataccaaaaattagccgggcgtaatggtgggcacctgtaatcccagcttctttggaggctgagacaggagaattacttgaactcagaaggcagaggttgcagtgagccgagatggcgccattgcattccagcctcggcaacaagagtgaaactctgccccccgccaatcccccacaaaaaaaaaggaagaaagaaataggtgtatctgatcctgtcggtttggtagggagcatgatgtttgtggttagacatctggagtttttaaatttataactttatcatttattctggttacataactaatgcattctctgttttaaaaatttgaccagtttggcattttgatgaataaggtgctgctaagaggttaggtatgaatgtccagcaagtagttgagatttgtagttctttgtgtattctagaatgagttgttaatttttggttggttacatgtatgcaaatatttttctcccagtcaatggcctgttttttactttgtctgtggtgtctgttgttgaacataggttttaaattttattttttatttttatttttatttttttcaagacggagtcttgctctgtcacccaggctggagtgcagtggcgcgatctcggctcactgcaagctccgcctcctgggttcacgccattctcctgcctcagcctccctagtagctggtactacaggtgcccaccaccacgcccggctaattttttgtatttttagtagagacggggtttcaccgtgttagccaggatggtctcgatctcctgacctcgtgatccgcccacctcggcctcccaaagtaatgggattacaggcgtgagccaccgcgactggccaggttttaaattttatagtaatcatatttgtccacatttccctttattatttcagacctgttgctccaagaaatctttctttccccctaagatattatgattatgattcctttattttaaatagtttatgattttatgttatgattattattcctttattttaaatggttgatttttcatatttagtactttaattggaattctttttctctttcttttttttttttttttttttttttttggtcaagtagggatttgtattagttcaggctgctgtaaataccatatactggatgacttaaacaacagaaatttattttctcacagttctggagactggaagtctatgatcaaggtaccagaagggttgttgtctggtgagagctctctcatttggtttgcagacagcttacattctccctgtgctcacagggcagaaatagtgaggaaactctctggtgtcttttcttataaggccattaatcccattgtgaaggccctgtcctcatgacttggtctaaatctgattacctcccaaaggccccatgtctaaatactatcacattggggggttagggcttcaacatataaattttggggggataccatttagtccgtagaaggatttattttttttttttgagatggagtctcgctctgtcgcccaggctggagtgcagtggcgtgatctcggctcactgcaagctccgcctcccaggttcatgccgttctcctgcctcagcctcccgagtagctgggcctacaggcgcctgccaccacgcccggctaattttttgtatttttagtagagatgggtttcaccgtgttagccaggatggtctcaatctcctgacctcatgatccgcccgcctcggcctcccaaagtgctgggattacaggcgtgagccaccgtgcccggccctgatttaatttttaaaatgttgctaacagttgccccagcatctaattgaatcagctgtctttttcccactgatttacaatgatagagtgtctgtttttggtctttttttttttttttttttgagttgaagtctcgctctgtcgcccaggctgaagggcagtggcgcgatctcggctcactgcaagcaccgcctcctgggttcacgccattctcctgcctcagcctcccgagtggctgggactacaggcgcccgccaccatgcccggctaattttttgcatttttagtagagatggggtttcactgtgttagccaggatggtctcgatctcctgacctcgtgatccgcccgcctcggcctcccaaagtgttgggattacaggcgtgagccactgcgcctggccctgtttttggtcttaattttgatcactgctttgtctttaattctaccaatagtacggtcttaattattaaagttatacaataaatcttaatatctgagatggtaaaactcctaatttgttattcttcaaaattgtcttgggtattagtggccctttcttctctcatgtgaattttaggagaagttgattaaatcactcatgcacacaccacagacacacacaaaacaagacaaaagtccccaaatgtatagattttgtttgtatttacattgttatgaatgatctggggagaactgacttctttacaatattgtgttttctcagccatgatcatggcaaatttccccatttatttattctgttcttttatattgtagaataatatgttgttattgtttccatgagtctttgacatattttattatattctcaggtactttatagtttttttggtataacgcaaggattgcttatcaattatgctttctagtcatcagaggaacacatctgatccagtaaccttagtgaactctcatattaatccttgcagtttgtctgcagatgcttttgcatttttccatgtagtctgctgtgttgtctgtatgcagagttagttttgtttctccctttctactactgatctttttcttatcgattttgcatgatgctgaatagaggcagtgatagaggccatccttgttgttttttttttctttagtgggaatgcctttaaaatctcaccatgatatgtaatgtttgctgttggtttttatagctgttaccagtttaagaaagttcccttccattcgtatttttgcttttttaaatcttgaaatcgattcattttatgattgttttctggaaattaaaaggttattctttggtgtatttcttgccttaagtacactattacaaaactaaatgaatgagcctatatgtaactgagggtaactttaaaaaattaaaataataaaggagtcctctcggtcttaaacatttataatccagtatagaaaatttggaaaatagtcaaagcacattaaaagaagtaaaaattagtcataatcaccctatttaagatgttttcttctgttgataccttatgaagtatagagataggctgcctcaatctctactttccgctaggttaccacttaaacaattcatacacattgctgctaccttttttctcttgcactttccatgtagtcagcatacaaaaagaaagtagactaatgaaatatttatctatacacatatataacctttatagaaatctccaagtgggatcatgccatatatatatacacacacatatatatacacatatatatactcacacacatatatacatatatatacacatatatacacaaatatatatagcagcttttctaatgcaacaatatttaattgacattttctgagttcaaaaaaatgctacttagatccttatgtgaattacaaaccacattacaaacattctccagtttgggactattgcaataattgtgaatacacatgtatatacatcttcaactacttgtgctagctagcatttttgtgtgatagagtcctagaaaaaggcctgagatgcctcgaattttccacgtcttgaaaatcatttttatgacgacctgtggaaagagatgttttcaattaagtgtctcaggattttcagtttgtatattgtggttcaaaataggagaaagtggagccatcagaatacattagtcatgtctacacatcagtcccatggactcatagcacttggatggatcgttccaccccgggaaagagccttagtgatcatctgtttggatccttcttttcatagatgaataagctgaaaatctggaagattttcaaagtaaataatacttgagacttataatatgccaggcagtgtgctatctcctttacttacatcgtttcatttaattcttgaagtaggaattctcatttacccttcacagttgaggaaacaggttagaatttaggcagacaacttcctcaaggtcacacaattggaaagtgatagagctcaggtttggagacatatctacctgattctgtagcccatatacttttcactaagttacttccattctgagagagcgtaaccaggatacaaggtaaatacatgatactcagattgtttctgtaatgctttgatttcacgacgtgaagagttaaacatagtcctcatctaccacttagtcatccttcctagcaaggacattagagtgctgcagagactccacttcacagagtttgcagtggaggaaactagcccttatgtttgtgtggctcaggatagctgtccaaggtgagatagatcagaataaaaacacaaaacaaatgagaaattaacttggaaatagataacactttgtgtgatatttcccctcctcccttgcaaattcttttctcttcttttggttgctagaagaattgcttggtctctaattgctgaagattttgttttttgagactaggtttcattgtgtcactcagattggagtacagtggcatattcatagcttactgcagcctcaaactcctgggctcaaggagtcccccacctcagcctcctgagtagctgggactatggatatggctaatttttttttttttttgtagagatggggtcttgctatgttgcctaggctggtcttgaactcctggcttcaagccatcctcctgccttgacttcccaaatgctagaattacaggcatgagccaccacacctggtcctgaagatctttttaatcataatatcttaatttgagtatataatagattgagcctcagcaatgagaacagagggatttcttgagcaaagaaaattcctgtttcaaaccagtcgtttttgtatgtgtctgtgtgtgagacagagtctcattccatcacccaaaccagagtgcagtggtgcaatcttggctcactgcaacctctgcctccccagttcaagcaattcttgtgcctcagccacctgagtagctgggattacaggtgtgtgtcaccactcctggctaatttttgtatttttagcagagacagggttttgccatgttggccaggctggtcttgaactcccggcctcaggtgatctgcctgcctcatcctcccaaagtgctgggattataggcatgtgccactgcacccggctgagactatttttctaactcagtttgtacaggccctagcatggtgcgtgggtatgagagaaaaagagactggagctccaatggaggatgcctcagttctctctctctctctctctctctctctctctctctctctctctctctctctctctctgtgtgtgtgtgtgtgtgtgtgtgtgtgtgtgtgattgttggaggccaggcctggcttacttcctgagcctaattcaattggagtgtttccatagagagggggagataccatctagtccagtttagcatccacattcatttctctccatctccatatggagctgaacagatcactcaggtctaaccaagttccctgagagttttacaaccttgttactgctttggaaagaccattatactccagctttgtgtagaacagagagagacaagggctgtcttttgaatatattccactcttatctaacgacacagagttgtcgtaacctacctataataataacctttgtgatactggagctgccagcgtgtgaggagggacattctttcaggtgtcccttcatcttcatctctgattagtatattctgtttgtaaaggcaatgcttgagccagtagctttcaaacatttttgaatgggatccaaataggaaatacagtttgttttgctacccttctcccacatataccagaaacaaaagattcatgaaataaatcttgcatttactgcatgcagtgttgtgttctattatttatttcatctaaaaatgctgacacccactatattgatttaacaaaccactgatgtgtcaagatctacaatttttatttatttatttatttatttatttgtttgtttattttgtgatggagtcttgctcttgtcacccaggctggagtgcaatggcacgatctcggctcactgcaacctccatctctagggttcaagcaattctcctgcctcagcctcctgagtagctgggattacaggcgccggccaccacacctagctaatttttgtatttttagtagagacagggtttcatcatgttggctaggctggtcttgaactcctgacctcatgatccctccacctcagccttccaaagtgctgggattacaggcgtgagccaccgcgcccagcccagacctacaatttaaaagtaacgctggcttaaggagaccatttcttattcttcttcataactgtgtattattcttgttacagtttaacttcctcatagagttaatcttgcaaaaacgtgtacctagtaatgtcagtgtacatagagttgtcctgggaactatgtctgtcttcatggcactgtccacggagtacacacttagaactgacaagatcactgtatgacttgttaacatgtgaatcactggtggacatggagactcttgctgttttgttgatttggaaatggtagttctgaacttgccaaattgggtatatgttatttagtataagttacaaaaaaagaccaaaggttttcagaatgtgtgtttattcttcaaggttctgctcatttcttttagcattgtagtttgattgtagtttctgatgctgctcttagtggtctgcaatcttcacctcataagatgctctaaattttctgacttttacatgctggaagtctgttcaaaccagccttatagaatgctggataatactgcttattgtgatttacttccctggagatcaagctcatcttagaatcaagcctttccacatgaatgtgaggattctggatgctttattctttctctcatctctgtctctcttccatcagggggatggttttgactgatgagctatttttcccaattgcaaatcaactatacttctagctgtgagaaagggatctttctaatcaattgggtcttgccttctgcttactatgtgaattctaatgaccaagctctttatttttttaaaaaaagtaaaataagagaatttaaattaattacttgattttgttgtaacactttaataagtttagtgaaaatattcaggccgggcgcggtggctcacgcctgtaatcccagcacttgggaggccgaggcgggcagatcacgaggtcaggagatcaagaccatcctggctaacacagtgaaaccccgcctctactaaaaatacaaaaaattagctgggtgtggtggcgggtgcctgtagtcccagcaactctggaggctgaggcaggagaatggcgtgaacccaggaggcggagcttgcagtgagccgagattgtgccactgcactccagcccgggtgacagagcaagactccgtctcaaaaaaaaaaaaaaaaaaaaaaaaaaaaaaaaaaaaaaagaaaatattcagcatagtttctttttggcaaataaataaatttaaaaggtcccttaatttgatggttatgtgttgactgaaacaagtgcaaaacaagtccatacaaatgatcctataaatagaattaaatatttaaatttgttattgaaagctgcctttcttaacaagggagcatggtttctaatttagactatagataatttcctcattgtttgtgccgtatccatcgttggtagtcattctaaaagacaaaagaaaagtactaacgtctaattattctaaggggtgtgtaaaaatatgggatctgcccagagaatgtttagaaatcatgaaatcattgttaccctgcagtcacaccccttagtaatccttaagttttttttttttttttttttgagacagagtctcactgtgtcgcccaggctgaagtacagtggtgtgatcttggctcactgcaagctccgcctcccaggttcatgccactctcctgcctcagcctcccaaatagctgggactacaggtgcccgccaccacacccggttaattttttgtatttttagtagagatggggtttcaccatgttagccaggatggtttcaatctcctgacctcgtgatcctcctgcctcggcctcccaaagtgctgggattacaggcgtgagccaccgcgcccggccagttcttaagttgtaacagattacttttcattctgaatttcatattgaacatgataatcttaattttggatacagactattcccatagcattttagatttcgtaagaaagtatatgtaggctgttttatgtgaaaagaagagagattatttagctccatgtctttgagaaaatagttatggattacaatttatgagtattttatacatgttcacattcttttgtatcatgtttctttatgtctaggacctgatgtttacttggcttaaactgaacctaaaattagtagttagttaataaactctctttaaggattacattttttttttttttgtcctagatggactcaaaataatactagagtaatgctttacttcttatcttgggtgactagatgtcaagatgtcatcccaaatcaggtccataataaaatctccttgggacatggttctgctcactcttagagtaggaaacaatagaccagaaggatggagaaagatggcagaagaagatgtgtaaagggatggaaggtatttgttaatttttttctattgctttggagacttaccatggcatgctagaacagtttcctaatctgttcgtcaagacactggtgcttttatagggcccctttagtatttctccactggatgaatgatttgtagcacttatgaagaaaggactggaggaatatttttttaagcggcggttataccagttataattgagcatacttctatttcatcagccggttatcatagactttttattcagttccctagtagtttaatgccttatgcccctgtttgttctgaattaatttcatttcttaaatatgtgaagattaagctgatctgcttcaatgtgtatttagggacactgtgtttcccatttatcacctgctgcttctctttagcagtaaaattaaattgacatttgttaaaagatgttttgatctatctttggaaagggtagtaaagaataattagtcacagtaattttccccccattttgtgtgcaaatttaggttgcttggtgaaatattctaattttttaatggtgatagagaattcttgctttagttttgtggtttaaacagttgaaagtccgatgaatccttgaagcattagtaatttagcagccttgtaaactagcctcttttacttgggtagctcacaaggctggcaccagcatcagtcctacaaagtggtttactctttttccctcggcccagaggctggccctagtcctatcagttgaaagactgtctacagctatgcagtgtgggcaactcacttgaaattgttactcaaaatatgaagtcaggacttgaggaagtatgactttagccttcctgggtgacagggttaacatttatatgcctcagcggataacagtcagcatacttaccatggagggaatcaaatgtgtgtgggaagcagaatgcctcaaagaactgctgagattcaggtgctaaggtgataaaacacgtacattttatattgaacatagtttggtattctaggtcaggcaccccattctccaactccatggttctaaggccccaccaagaataaattttctataagcaggaagcaagagatacaactgttatggaacttagtaagaatttttattctgttccacatgactgtcactttgagtttcttgaggccgttatgattagatgggtactaccttgctggaggttctcatctctagagtaggaacatcttaggtagtattccacagtattatttaataccatatcagggaaggggaggaagaaattctgctttatttgttattatgttgattcttgtccatgaggcaggtgccttttgaagacacatctggactgattttagacccagggctactgcattaaaggcccttcctgcctgggagcacctccccattagtttctctgtgactcttggtacttgtgcagtccctctgggaaggatggctgagctccctttctgtgtcagcttctgggttcatgtggcaatcaagtcaggatggcttactccatacatccttgcccacccttggatgcatagagctctatttcctcctctgcctcccccattcagttgcgtcttggagagcactctacttgttgactgtttctcaacctcagcctcaacctcttgtactattaattagtcctcataaggcattcttcagccttacgtctgctgtccacagtatctccttacctctgatacttccagggccacctttccagtaactctacagccctctctgccagagattgatcccttgctttcttttagcttgctggccaggtttctgttgtcaaatttaggaatccctttctcaagtttctttcataatatgaactgtaagatttcagagctttcaagttttcttttgcagggactaatctttcaatttacaacagtcagtaaccagtttgtttgtgtctttgttgtagtggctcattatgagttttatgtaacattctttaatagtagtattttactgccttactcaacagagagacttccattttgacaaggtgttgaaaagagctgaatctttagcctacagttttacccacgtggtggttggaaaagtttcgcatggattagcttctttatacattccaaacctgtttcttctccactacccacctacttcatcaccaggcatagtaggacacacagtaagctctccagcctgtactgttgtgtcctgatgctgagttggcacagtgggcagtgggaatattccagaaagctattcctataccaagagggccagcactacagaaaccacattaaatatgtccccaactcaaatttccccttatctagaccctccaaggttccagggccacaccaaagccaccctacatgaggaaaagtgtgaagtttgaatggaaagaaagtgttcttaacagattgcagttaaaatatctttcttttgcacattctacaaaaatatatgaccatgtaatacattgctagggcctccaaattctacagaaacatgtgaccatgtgaatatgtgccttgggcctcccaaggccttggaaggggcctgtgcaagtgaggagccctgaagcttgttctgttagccttgttgtaaattacctccaatcagtctgtatcttccagtagagaaatatcagaacatcatagcaaagtatggttagaaacagtgctttttagagtgttttatacatatagttggcactggagaatcattgagatgaattaactatcattattattgataattattaactattattattattggtaattaattcatttcaatgattcaatgcagacactttccatttactgggcactgttaagagcacttaacatatcatctcacttaagtcttaggaagttcaattattattattattattattattattttgagatggagtctcgctctgtcacccaggctggagtgcagtggcatgatcttggctcactgcaagctccacctctcgggttcaagccattttcctgcctcagcctccccagtagctgggactacaggcgcccgccaccacacccggctaatttttttgtatttttagtagagatggggtttcaccgtgttagccaggatggtctcaatctcctgaccttgtgatccgcctgtctcagcctcccaaagtgctgggattacaggctattattttctttttaaaattatttttattttatttctagctgggtgtagtggctcactcctgtaatcctagcaatttgggaggctgaggcaggcagaccacctgaggtcaggagtttgaaaccagccttgccaacatggcaaaaccctctctttactaaaaattcaaaaattagctgggtgtgttggcacatgcctgtaatcccagctactcgggaggctgaggtgggagaatcgcttgaacccaggcagtggaggtttcagtgagctgagattgtgcactccagcctgggtgacagagtgagactccatctcaaaataataataataatttctaagtttttttgtagagacagggtctggttatgttgtctaggctggttttgagctcctgccctcaagcaatcctcctgtctcagcctccccaaatgctgggattataggcatgagcctctgtgcctaatcttactttcattttaaagaggagaaatctgaggcacggagattctaaataacctgtcaataaatagtagcactggggtcaaagctcagactccacggttcacttcctgaccgcccctgcactgcctctcaaatcctaatagagctgccgtgatcccaatcctcacaaggccagaaagtgacctttccagcatgcttagtagggatgtattttgttttccctactttaggagagttaagaagagaaagatttgtagaagagaagctagaatgaaaggagccataaatagggttctggagaaaacacaaaaattgagacaggttaggcagtgagagggcaggttattgaatagctgcttaattgcactgtgttttccagactctgggaaatacttttcacatttttgattttttagtccatatatgctttatggatatatagaggtgatttggtaatgttcccctgccatctgaaaaactatgttgaaaccgttagcacaaatgaaaatggcgtcttggaaaaacagcacatacatggttgcttcaaggatatcgcccaataccttcatttgcggagaaggcataattaagagaaaatagcttaaataatacaggaagagtctgatgaaacataaggaatgttttcttaataatcatgttagaacagtgctccaaaaagggaagcataggatttcagtctttaaaggtaaataaaatataattataaaaactttccatctcaagtaggttcagagttgacttctagccatgatttgaaattctttctcccactaaagagagtatcagcatataaattaaccttactgtggtaccttgttggataaaattctttataatgcacctcattcactacagtcttactagttagtagtatcagctctcacccgtgctgatgggcaggaattacttttaagtgtcttatgcaattaacagccattaaccggcacacctgtcttaaaagcactgcctatggttctgagggtcctaataccattgcagtgctgtcaccgcagtgactggagcaccagggaaactattggcattggcatggaatggccctatttgtcccatttcttcaaccaaagtgtcttcactaaagtctttagccagacttccttctttgaccaccaattttatcttaattctgtgggtatcatatgaacagtcctggttttatcttatagaaaggaaggtatcagagggaggttggggtagatgtctccccatctaatgctaacattaatcatttatccctgggactttgcaaaaaatgatgttaggttgagacaaagtggtactttttcttgtaattgctttagggaatcatagggaggaaggtacaggggcttgtgtgaagccatcatcaagttgctttataataaaagccagaagacatgtaaacaccaatatagttaacacagagtttaataaagaatgagtttaaattctaattttgatatgaataattaaatatttcctaaagcgaaatttggtaacataaggttgtttgtaggtaaggcaaaaggagttctaaaaatatgtttaaccagtcagttgcatttatcaatcacagttgcaaacataattcatattttaaaatatatgtatataatgaattacatatattatctatttaattcagagtaggttccaaattttctcaattatttattacctatgtctttcttcaaataatgccagcaattatgggtccttgataataatgaaatattctacagttgaagcaagaaggtactctgaaagcttacatctctataaattaatgcttcaaataatttaatacttcaaaatgctttgaaaaactccatgaacgtatttgataaaatagtataagacaatcataatgaagcagtttaaaatgatgtgctggccaggtgtggtggctcacgcctataatcccagcactttgagaggctgtggcaggtggatggcttgagcccaggtgttgaagaccagtctgggcaacatggcaaaaccctgtctctacaaaaaaatcaggaaatttagctcggtttggtggcacatgcctatagttcagaggctgaggtggaaacatcacctgaacctgggaggtcaagactgcgtcgtgccaggaaaaaaataataatttttttttttttttgagacagtctcgctctgtcacctaggctggagtgcagtggcatgatctcggctcactgcaacctccacctccggggttcaaatgattcttgtgcctcagcctcccgagtaggtgggactacaggcatttctctgcagaggactaccgtacccctagtcctctgagtgccttgattgctttaggcactcaacaaatagtggagacagaaatactatgcattagtggtccccaacctttttggcaccagagactggtttcatggaagacagtttttctgtggaccagaaaagggggggatagtttagggatgattcaagctcattacatttattgtgcactttatttctattattattacattgtaatatatggtgaaataattttacaactcataatgtagaatcagtgggagccctgagcttgttttcctgcaactagatagtcacacctgggggtgatgggagatagtgacagatcatcaggcattagattctcataaggagtagcaacctggatccctcttaggtgcagttcacaatagagtttgtgctcttgtgagaatggggatggggagtggctgtaaatacagatgaagctttgctcactctcccctgccttgccacttacctcctgctgtgtggcctggttcctaacccctaggggttgggaacccatgctgtacatcatggtgggcaaacaaccacttgagggccaaatatggctcattgccaacttttataaataaagttttattagaacacagctacacccatttatttacttattgactgattgcctttgcactatagcagctagttgagtagttacaacagagactgtgtgacccacaaagttaaagtaattactatttaactatttactgaaagtttgcccatctcagctctacgtttgtaactgcaggctctcacaattccacgtcttgtaatttggaagtcacagaataaatcaagtaatatgctttgaggaattaacttactactcttcattaatgcatgtgcttgactattgtaaggttacatatgattattaaaattataggagttaaacatatgtttcaaggatagaatacacaattactcctttttgtaatttgtaaaacaatgtttggctaaatcttacattactagttcttttttctacctaataaggttgtttcattgaaatggaacaaaagcatggtaattaccaagcttatctctctctctctcttagcttatcctattttaatgtagtttgccttaatcttgtgaaaactttctaattatagtatgaatttgcattcttaaaatatgtgttctaaatcaggttaactcataaagtattattttaagttgatattcattaagtgtatatatacacatatacatgagaaactgattagaatagctataaaacagatgtaaattcaacattttcattcattcattcctgataaaactttgattgaactttttacagggaattgtggatgtcctaaggattgagtcacagacacccttcctcacccaagaaagagcataagaagtaaagcagaaagcatatttcatgaaataagctgtaagaagagaaggcctctgagataatatagagaattaggttgtcaaatcaggaactgggtaccagtggctcacacctgtaatcacagcacttgtgattagaggaggctgaggtgggaggatctgaagccaggagtccagaccagcctgggcaacatagtgagaccccatctctacaaaaaataaaaattagctgggtgtggtggtacatgccagtagtcccagctgctcaggaggctgaggcgggagcatctcttgagcccaggggttgaggctgcagtgagtcatgatcatgccattgcattccaacttgggcaacagagtgagaccctgtctcaaaaataagagaaaaaaaagtgtcaaatcacattcacaagaatcagcccttagcttacatcaaggtttactaataatgttcaggaatacgagtagtcctcaggtacaggatagccatccatccctactctccaggtcctctctagctgcactaggatgctgtgggcccagatttaaggtacaagggcttagaagcaatgcctgtggtatgttaggaagctgtttccattaggaatcattttcgctttgtactccagtggttgcataacttatgtgacatattttccaaggggctatactccctatattgaaagattccaaatttgttaaccagaagtaatcctagacagattagatacgtcctgctaaaatccatcgatagggactttcttactaataaacaccattggattgtttgtcaagagatctgacactagtatgtttacaaggagaattgaccaggttaactacctcctttctttatttactaggagtgtttccatagacccctccccaccctccgctccctgctcttaaggagaaatgaactgtaggtttgctgctaaccattttttcccaatctctccctccagcctgagcagagacaagacaataataatatagccaggtcagttagcatgtgtgctgagttttcttctgttctcttttgttaaagtttgagatttgtggatgtgcttacattttgagtatgattcttgtctcttcagaataggaaaggaagtgtccaaatgagcctttctgatgctcaaaccctcatgatgtcattgttttctaaatattcttgttgccactctgtggaatgtagtttaaatatcttatcccaccatctcaaggcaatgcacaggctgctcccaacttacctttccaactttcttggcttccattttcttgaagaatcctctttgccaactatatattgctgcctctacctcaagtgtgccttccttatttctttgacttttcctaagttccttcttccaggaatgcactctctctcactctcctccctgttctctcaattcgagattaaatctcacctgttctgaaaaactgtctcaatttgcagcagactctttttggaattagtagttactgtctgtgtctgtcacctggaacttgcctttcttcttaattagatcatgagctccttcagggtgggcactatcttaggtgcttaggtgcagtactgagaagattaatctttatctactaggagcttgagctatgtgttgttaaaatacttgaatactgctactactaactaataatagtgatgagaatggaaattttgctttgtggaaaagcgttaaacagttatcaagggcacacataaatttacctattgaaacacgaggaagggccaggtgcggtagctcacgccagtaatcccagcactttgggaggctgaggtgggtggcttacttgagctccggtgttccaaactagcctgggcaacatggtggaaacccgtctctaccaaaaatacacaaattagctgggtgtggtggtgtgcgcctgtggtcccagctgcttggggggctgaggcaggagtatcgcttgaaaacccaggaggcagaagctgcagtcagccgagattgcgagattgcaccactgcactccagcctgggcaacagagcaagacttcatctaaaaaaaaaggaagtatatttggaaaagtaatcatcaaacatgtaagtgtcttttatgtacttgccactgtgccagagatccagagatgaatcaggtgtggcccttgtccttaagagcacagtctcatggcaagacacatacattttttctttgcgtttttaaagtgttttgctttgaacatggattacttttgttatcagaaaaggagcatgttcttttcgttgaaagataaaagtgtactggggttaagatataagtcagatttaggaatgagactgctatcaaaaggaataccgtgatattgacaacaagtagtgggattgagtgaaataagccagcctcaaaaagacaaatactgtatgattccgtgtatatgaagtactgaagaagtcaaattgatagaagcagtagaatggtggttgctaggggttggggagatggggaaatgagttgtttaatgagtgtagtttcagctttgcaaggtgaaaaagtcctggagattggttgcaggacaatatgcatatacttaatgctactgaactgtttccacttaaaaatgtttaagatggcacattttatgtgatgtgtatttttaccacaattaagattgtaggacaaatctgcattgcatggttgactctagcaccctgttgcatatagaagaagaaatctcattaatccagggttagggttttgctgggccagtgtagaataaggtaacaaggggtactattgagggtaggttcacgtgagtagttagttctgatggaggagatggatagggaaggaataagaggttaggaagaggtcttaaagagtaggcatactgggaaaatgccaaagacataggagattgtaatcagactaggaaacagaggcttgtgtgtattctgtggaagtgatacttatctacattcattatgaatggaaatctgttggatgggaagcttcttaatggttggttcaaatttttttgtacttcgtgttaatttagggaatgaggccaaatacctggaatgtgctcagtgaaattatcagttaaataatgtgtgtgtattgtcacatatctggaagtagcatcccctacagaaaatgcctttggcttgctcttcttttccctctgtgctcttattctaagccacacatttctgaggtgtttgctgagtagtggacagaattcatatggttcattcccatacccttcttgttgtctaagggggattgatattccactgagatttggggataaaattatagatattgacttcacccttgtagattctgatttcattgcttttgggtagaacctgggcatttctacttttaataagcccttcagatgattctgatatacaccaaagttgcatgactgctgtttgagagataccaatttgtctttctaaagttagaattgccttgctagatttccctttgctgtataacatcactgttatctaatgtttttagacgttattgaaatttggagtattgaaaaataaattctgggatttatttttcttctgctaagaatatttatgttagcaagatattagtatggatttttttcttaaaaacacaaaagcacctgtaatctcagcaatttgggaggccgaggtgggtggatcacgaggtcaggcatttgagaccagcctggccaacagagtgaaaccctgtgtctactaaaaatacaaaaaattagccgggcgtgatgggcaggtgcctgtaatcccagctactcgggaggctgaggcaggagaattgcttgaacctgggaggcggaggttgcagtgagctgagatcacaccactgcactccagcctgggggacagtgtgagactccatttcaaaaaaaaaaaaaacagaaaagcagaggcatgggctatttcatgtgtttgatgaccagatggcagtagcattaacctctccttaaaaaggtagattaatttccttcacattgaggaaattctgtttagtcaattaagacaacatcatttagaagaaaaagtttaattacaaaaaggatgctgtaggctgggtgtggtggctcttgcctataatcccagcacttcgggaggctgaggcgggcagatcacctgaagtcagaagttcaagaccggcctggccaacatggagaaacccccatctctgctaaaaatacaaaaaattagccaggcttggtggtgtgcgcaggaggctgaggcaggagaatcgcttgaacccgggaggcagagactgcatgcagtgagctgagatcacgccactgcacttcaatctgggtgacagagcaagactgtctcacaaaaaaaaaaaaaaaaaaaaaaaaaagctgtaatttaagactgggaagacacaacatcatcacattttatgaaatgcttttctttgacaaattatagcgatgttcaactaaataagcaagatttagaaaactatggctaggttcctattattagtttgattttaaaagtacatagtaggagctaaatgagcttaaaatttatggttatttaaaagaagcttcaagcagttttaaaatgttgattaattttttccagtcctgccaatagcacttgctttgctttgcttagatacgtatgagaatctgcttttatatcagaaagcttagaatgaaacaacttatttttgtctttgttgcatatttcattatgaaacaaaataaaaagtagaaaaaagtgaaattaatggtgctaatgtattttattgaactggatatatccaaaatattatttcaacctgtaattaatagaaaaattacttttattttgtactaaatctttgaagaatcatatatttttcttttctatttcaataaatttttagggaacaggtggtgtttgcttacatgaataagttcttcagtggtgatttctgagtttttggtgcacgcatcacctgagtagtgtacactgtacccagtgtgtagtcttatcccttacccccctcccacacttacccctgagtctgcctttgcatcctcataacttagctcccacttatgagtgagaacatatgacgtttagttttccattcctgagttacttcacttagaatagtaatctccaattccatccaggttgctgtgaatgccattatttcattcctttttatggctgagtagtattccatggtgtgtgtgtatatatatgtatattccatgtgtgtatatatatgtagtattccattgtgtgtgtgtgtgtgtatacatacacatgtgtgattgatatatatatatatatacacgtatgtgtgtgaattattccgtgtgtatatatatgtagtatcccatgatgtatgtgtatatatatgtgtgtgtgtatatatgtgtgtatatatatagtgtgtgtatatatatagtagtattccatgtgtgtgtgtgtgtgtgtgtatacacacacacacacacacacacaccacattttctttatccattcattaattgatgggcatttaggctggttccatatttttgtattgcaaattgtgctgctacaaacgtatgtgcaagtatcttttttgtatgattacttttcctctgggtagatacccaggagtgggattgctagatcaaatggtagttctgctttgagttctttaaggaatctccacactgttttccatagtggttgatatggtttgactgtgtccccacccaaatctcatcttgaattgtagttcccataagccccatgtgttgtgggttgtgggagagacccagtgggagctaatctaatcatgggggcagttacccacatgctgttctcatgacagtgagttctcatgagatctgatggttttataaggggcttttcccctttgtgttgggcactgcttgctgctgcgatgtgaagaagggtgtgtttgcttccccttccaccatgtttgtaagtttcctgaggcctccccaaccctatggaactgtgagtcaattaaacctctttttttttttctaaattacccagtctcaccagttttttatagcagcatgagaacagactaataacgatggttgtactagtttacattcacaccagcagtgtaaaagtgttcccttttcaccacatccatgccaacatttattattattatttttttattatggccgttcttgcaggagtaatgtagtattgcattgtggttttgatttgcatttccctgatcattagtgatgttgagcattttttcatatgtgttttggccatttgtatatcttcttttgaaaattgtctattcatgtccttagcccactttttgatgggattctttgttttttttcctgctgatttaagtttcttgtaaattccggttattagtccttttgtcagatgcatagattgcgaagattttccccactctagccacccagcggagtttctgggctctgggctggtactggggggtgtctgcacagagtcctgttatgtgatctgtcttcaggtcacttagctgtagataccagcacttgctccagtagaggtggcagaggagtgaaatggactctgtgagggtccttagttgtagttttgtttattgcacaagttttgtgttggttggcctcttgccaggaggtggtgctttcaagagggcatcagctgtggtagtatagggaggatcaggtggtgggtgggaccctggagctcccaggagattatgtcctttgtcttgggctacgagggcaggtagagaaaaaccatcagatgggagcagggttgggcgtgtctgagctcagactctccgtgggtggggcttgctgcggctgctgtgggggtggaggtgtggctctcaggccagtggagttatgttcccaggagaattatggctgcttcagctgtgtcatgcaggtcaccaggaaggtggggtaaagcaagcccttacccagctcccacgctgcccaaaaggccagtctcattcccaccatgcttctccaacagcacggagtttatttccaggccgcgggtgagcagggctgagaacctaccccaggctaccagcctcttggctgagaaaccaaacagggctttcaggtttcaggcctccccacctgctgtggcttctgtgctgtgtctgcactcctgattcatcccctctcccgagttctgtccaggaaaactttgagttctatcgaaattgttacaaagctcagctggaagttcccttctccttgtggtcttttcccagttcctctggtagccctccccaaggacctctgtgagacagtcagaaatggctttcctggggaccaagagcccacagggctcttcccgctgcttcttctactcctgtatttcacttgactctctaaatttgtctcagctccaggtaagtcatattcttctcttgtgatctggaccttcatgttccccagtgagggtgtgtgcttgggggtggatgatccccctttcacactttcacactctgggcacgcaacagttttttggttgtctcctgtggcctacaggagcaatgcgcttgcttccttcaaagagtctgtggattatcttggttttccttatatgttcctgcagtagttcttggagcaaaagttcacgatgtgagtctccacatgctgctctgagtgggagctgcaagttagtcctgcctcctatctaccattttcccccatctcccctcttaagtattttatacttaaaacacatatcaaattgccccagacttggccagttggaagccctttttaactactgctgtatatttgtgacatgttccccatcattttttgagggtactttctttctggtatgcatcttgtccctgctgtttcccaaccctgaaatcagtcatttctctcaggaatcctggttccttttagtgcaaatggttttaaagaccaagatacaggttctaggtgtgagcattgcacatgaggtgcctttgctagatggtgagagctaaggaatacatttatgtgtacatatatgtacatatactgatatgaactacatgcatgcatacatgtatctctacctacacttttaaaaaaaaatcatgagttcataccagtatttctagttctcgtccatccccacagggatctttcttgccttctcctgctccatgtttgtatatccctttcatgatgagaaccttgtcactcagcagtatcaatgcattcaagtgtgtgttcaatcctataactcatctagtatggtttccctatatgcctgttaaaaaggaatttatattttcttctagtacttgagcttcatattttatatttagatcctggaggcatttggagtttattcctctgtattgtgtgaggaatgggtccaattttatctttctccaaattgctatacggttgtaccagtcctatgtattaaaaaggtcatctttgtgatttgagatgtacttttatcataggttaggtacaggtctatttctggacttacttctttggcatctgtgcgcatacgtgctacacactgttttaatcacaggcttttaatgtgttttagtatttctcatggctcttccttttcagtgtgttcctagctgctactgtatgtttatttttacattcaaactttataaagaaaaactataaaaccactgtaaaagagctcatagctattgggggggggttatattaaatttatacattaacttagaactgacattccactcctcccattcctcaaatgtaagcaccttctatgggtataattctattcatctgctcctccctgctctttgtgctattgttaacttctacgtatgctgtgaacctgactttacaatgttgttatttttgcttacatgatcagttgtcttttaaagaaattatggaagaacaatgatattttatatccacatatttcccattttcagcccttttcatggatttctgtagatctgagtttccgcctggttatatccattgatattgttgagatatccttaaccaagaataaggaatggtcttttcattggttcaaggctacttttgtattcttgtataatgagaagtggtgggagaggacattcttaccttgctcttgactttatgggaaaaatattaaatatcctaagactagttatattctttatcatttgattatgactcagagggctggttttcagttttacaggaaatgtacaaacttcaatgacttaaggtaatttgtatgagttactggcattagatctcatcctaggctcactgtacttgctacactcagcccggatgctagtcaccctcaccatgggtcttaggaaatactgcaaggtaattttaatattagatgaagcaaaacataattaggaatgtaaatctgctcaaagccccttatgttctgtaatgagctccccagtcccaaattaatgatgttttggttgtctctattatcctcctcattaatagaggaattttaatgttgagaatttgtattatttggacctgtatgtatatatctactccttttaataccaattagtttaaaagtttaacatttggtttcagcccttgtttgaacgtaggcatggtcacggggtttgagttaaagcctcttaattgaatacaattcctctgcattctttttttaaaaaattatgccagctgggcacagtggcacatgcctgtaatccctacactttgggaggccgaggcgggtgaatcacctgaggttgggagttcgagaccagcctgaccaacatggagaaaccccatctctacgaaaaatacaaaattagctgggtgtggtggtgcatgcctgtaatcccagctacttgggaggctgaggcaggagaatcactcgaacccaggaggcggaggttgtggtgagccgagatcgcgccattgcactccagcctaggcaacaagagcgaaactctgtctcaaaaaaaaaaaaaaaaaattatgccttttacatgataatctttaaacaacatagccagtttataagtgttggattagatttactaatgaaaattctagccaaatgtggattttagttactggcttatagggactcagttttttccttttgccaccaatgggagtgtaatgggcatgagtgtcatatgtcaccagtcttgtgacaattgatttgttcaattagcagtgaaagacaagctcatccctaaaaagagaacatacagagctaagattagaacagctcagcatttcagttgggcagaacctcaactgaagtatcctctttgagagggattaagttacacattgatggaaatccatgcttggtgatgttttgtattgtactttgccctttgaccaagaattgtccttaacattataggtagtaactttatgaggaacctcatttagataattaattagattttctataaatattttacatagttgaggttatttcatactctttcctcttagaacttgtctccatgtttaaatgttccataactgataattttttaatattaagcagacactccatattgcataggatgccttccaactgtggtctgtcatcattgcaaatagtcagtaggcagccaacgtgtagggagcactaatatttatgcctcttctaaagaacatacgtttgttctttcccttaaacttaacagttctatgaagtagatagtgttacatcttattttacagatgagaaagttgagattaattgactttactaaggtcacagagttaataagttgtgaagctgagttaaacatatctctttgatttctattacctcatgctgtttccaaagatccatagataatttacatcatgcagggaatatatagatgacacaaatcttccttgaagcctggggttccctctctccttgcttattcaaatactgttattgggagatccaacataaaaatagtgaactgacttgcagttcataccttcttctttctctctctggaagttcttctgtatgctaacacctctctatcagaagcaaaggaacggtataagtcattagctagttgctagcctgtaattgctacttcaattttctgtgtagtttataacaaatcagatttttatgtttttttatattgccagttagacaaatatacacaatgactttttaatgcttaaataatatatgcttttatgtttagagctctgtattattaaccattgtattttgctttttaacagtctcagttcgtggctcagaaattcttatttaaatatcatgaccctgggagagcccagcatatcaaatgtaatttgtgcttttaacgaagagttatttcccaatttgctgtattaaataagatgtatacctctttttccgggcattgcattatttctaagttactgtgaaagaaaagtatataatgccatgtgaacagggtatgtaaagtattttatccttcaaaggtatgttagcaaaaaaggaggggggcagggaacaaagctaaacacagatgagaatagctagtgatgcccttgattttgttgtgcgtgctctggatatctttctcctttgttcctcaaggggtgtctggcaccagctttgatctgctgccttcacagtggtatctggtcagtagaacaagtttcaaccatgtgttttgcttgactcctacttaatatggtattggcagcggtggttttgatactgtgagtgatgagaagaggtggtggtgctggagttggtcttgagaggaataaggaacatttattctgctttgatgaacatttttgagagggtattttaatgggttggcttctatgcagtttagttttttagaactgtcctcactgttttagcttctctcccaacccaatgttgagtcacaatgattcatcggtttaaaactgtttttcttccaaagcagttgaatagagaatatttatgatcttgacgtctcctaagatattatttgtccattttgtatatgggaaaatggatgaatggagagttgagtgataactagtcagcagtggcagtagaactgggatgccccttaactctccgttgggagctgccatgatcactgttggctagactcaggaaactcccatttcttttcaggtcagtccctaccagagtgtccgttggcccatctgcagaatgttcctgttattccagcctcaccaatgtgtcccattagacagatctccttctagcatcatgagtaatgcccattgggtgagttgggcattttatgaggtgcattctctctccctgtcactttttaagatcctagagcacaaattcccactagtactttgtgagagaggaagaccttgtatagcatcactttggctataggataattacatgacagatactggcgcagctatcttcacgtcccaatttcttccacacacttttgcctttgtggcctgagttcttaacagcaccaggcacaatgctgtgcaggtattgagtatgtggtaaatgtgtttgctttgtattatttttgtttcccttttttctttcctgttagtgatttctgaacagacatcttactagttgtccagcaaaattcacagccacctcacaccttcccctcttgttttttcacacttcttttagctccccattgaaagatctcagagaaatgaaaggaatatatgtcttacagggaagccaaggagactcatttttaacaagtactaccttgcttactaagcaattttttttttttttttttgagatggagtctcgctctgtcacccaggctggggctggagtgcagcggtgcgatctcagctcactgcaacctccacctcccgggttcaagtgattcttctgcctcagcctcccgagtagctaagattacaggtgtccaccaccaagcccagctaattttttgtatttgtattttgtgtaattttttgtatttggccaggctggtctcaaactcctgacctcaggtgatccacccgcctcggcctcccaaagtgttgggattacagacatgagccaccgtgcccggccagcaaatgtttttaatgcttaaaaaaggtgctacataaatgcaaagttgtggcagttataattttatatacctgataaaatttataccttgtaaaattacaataattgtagccattccaaaattgttttgattttaaacatttgaaaagtgaaatacttaggtggttttttaactggtagcttggtgtaggggtaggaatggagctgacacctttagcatctaaccaggattcttttacttcgaaagctgaattgctaattccaaagaacattgtgttgacagtgcctgcaattaagaagccatcacctttgtgttatgacagttttcttccttactacaagcattattgttacctggaataaaagattcctgcttttttgttcacatcttgagctggttatgagtattaacccatgtcactgttggtacatttatagagtataaaatcactctataattgcaaatgggcaaataggttattcccatgagaactcttaggtttttttgtttgtttgttttttctccctgcacattttacttttgtctctttctctgaattgccagcctgtgccacacttgggtgttggaagtaaaggtgcttttgctttcctgagaaacctgggttctacaaaatcacatgttaaaataacagggcttaagggaaaaataagggtagaagctggctattgagagtttattcctctttgtaaccagaacactaagaaactcaagcaccaaaacaaaacaaaaaccaacttgtacttggggagatgtttgagggacagcccaggcaggcagctcagagtggtagaaaaccactacagggggtattaaaaatgtacagaaacacttcagtgcatctctgaagcagcttcagaattcagcaaaaatcatgtgaaggaaactgcccagatctcaggtctccagctttgtcgctctagaccaccccaggtgactgctcctgtctttgctggtttgtcttttctcctgcagacttctgtatgaatcaagccccagccctcttgtagtttctccattaactgaattatttgtctttttaaaatattgatttatacacaatagcaaagaagtaaaaacaacctaagtgtttattcatggataaatgaataaatgtgatacagtggattattactcagacttcagaaaggaaattcggaaacatgcgacaacaaggatgaaccttgctgagacaaataagccagtcagaaaaaaaagaaaaatactgtatgattctacttatatgagtcacccagaatggtcagattcacagagacagaaaatagaatggtagttgccagggttcggggtgagttctcatgggaataacctatttgcccatttgcaattatagagtgattttatactctataaatgtaccaacagtgacatgggttaatactcataaccagctcaagatgtgaacaaaaaagcaggaatcttttattccaggtaacaataatgcttgtagtaaggaagaaaactgtcataacacaaaggtgatggcttcttaattgcaggcactgtcaacacaatgttctttggaattagcaattcagctttcgaagtaaaagaatcctggttatgtgtaatgggtaaggagttttagtttgggatgataaatgagttctagggacagatagtggtgatagttacacaataatgtgaatgtacttaatgccaccggactgtatacttagaagtgactaaaatcgtaaattttatgtatatcttatcacaatacaaattttttaataagtgatttgtaaaatatacaatgtaaatgaaaaatagccttttatctgatgtgttgcaagtatttctcctgcattgtcatttgtcttttgactttcctaaatttttggacatagagatgctttacatttttatgtagttagatgcattttgtattgtgtttataaaggtcttcttcactccaagattataaaagataatacatttcacccatttttttcttctagcactcttaacttttttatgttgaaatctttactccatatagttttttttttttttttagtgctgggaattttgtggattaggacagcaggggtatttctagtgctttattgttttcaaggtttattaggactttagagaaacaacctctgttctctgattcttacatactgctgaattttaacttgtctacagttgtcagaatggagaggtgaggggaataaaaggcagatagcaacatgaaatctagcttccaaggctgtgatacattatgaatactttgcaacagtctggcctgaaatatggctacatttccttccttcctgatgagctgacttagcaacaaaaatcttttaaaccagtgaaaaatatggaacagaaggctggcaatgtcccttagaaacaatgtctcattcaaaaagcataatcccatgtggaagcaaaatgactgatgttgataccccagcctttcctctgagatactccttgaaattcccagagcaaaacatagctgacctcaggttcctgcccttgagacataacattgcctgagagagaggaaaagggacagcctctgtgtcccatcatttgaggtctcggctgtaaggagaggcccagttaacttggtgcctagtaggtgtcagaaaacaactggagttgggcgagcagggtctatcctgctgatatttgagatattatcatattggacaagatgtggtccagatgctagtatgaggaggcattccaagtctataattatttttcttttcattcgtggtttggtagaaaaagctgtgggccgtcaggtagaagaacttggttgtaatccttgttctaccactcattgtttgacattggaaagcctgttaaccaatttgtgtacacccccttcccccccacacccctttttaaaaactagatgaatacattttaaaaattgtgttaaaatatacataagatttaccactttaatcatctttaagtgtacagttgagtggtattaggtgtattcacactgctatgcaaccatcatcatcatcatccatatccagagtttttttcattttcctaaactgaaattctatgcccattaaacaataacttgccattgtcttctctccaccacccctggcaaccaccatgttactttctgtctctatgagtctgactactctaggtaactcatataagcagaatcatatagcatttgtctgtttttgtgactggtttattcacttagcataatgtcttcaaggttcaataaaaattaaaaatagaattatgtatttcgagaattccacttattatatagcccaaagaattgaaagcagggactggaacagatatttgtacatccaactttatagcagagcattattcacaattgccaaaaggtgaaagcaaactcaagtgtccatagagaaataaatggatgaacaacttgtggcatctatgtacagtggcatatcattcagtattttaaaaggtgcttctcatgttttatatctctaaaactaggtggttgaaccagttaatctctgaagcccctctagtatcttgtgtaatacactggtatggagggcttgtgggtcctattggtgcatgtttcatttcctctttgttgtttgccttccctacccctccctccctccacccattccacatacacagaagctcaagcacacacaattcactccagctctgttcagtaagttgggagaaacgtagacctgttcttaggtaaccaagtagctttaagcttgacctttttttagtagggcaatgatgttaataaaatgcaatttaacaacttaatgcatgccttcatggctatatggacagcaattcatgtataggaggtactgagaaaatctagaaatagaagaaagacagtgtcctagaaatatagggaagacagtaggtaacaggtatgctaaacataagatgcatggtgtttcagtgcatttggttgaattgggtgggtgtctgggagtgaattttacctttttttttttttttttctttcccgaaacaaggtctcaatttgtcatacaggctggagtgcaatggcacggtcttggctcactgcaacttccacctctggagctcaagcaaacctcccacttcagcctccctctgggaccacaggtgcatgccagcactcctggctaattttttgtattttttgtagagaaggggtttcgccatgtttcccaggctgatataaactcctgagctcaagcaataggcccacctcggcctcccaaaatgctgggattccaggtgtgaaccctggcgtccagccaattttatcttcctttggaagaaaataatccctggagaagattagtttggtttggcattgagggataggcagattgtgagggctggactttcaaagtttattgagcatctaatacatgtcagatactgggcaagctcttttatgtatattatctctcaccctacagatagccttatagaatgggtgttattatccttatttttccaatgagagaattgaagcttagataatttaagaaacttctccaaggtttcacagcaagtaagtagtgaacagcagtttaaactcagttttttctgaccccaaagcctgtgggtttttttgtttgtttgttttgttttgacacctaattagtttaaacacctaattagttgggaaacaaaagtagttttttttttttttttttttttttggagacggagtcttgctctgtcgcccaggctggagtgcgacggcgcaatctcagctcactgcaacctccacctcccaggttcaagtgattctcctgcctcagcctcctgagtagctgggattacagacgtgtgccacaacacccggccaatttttgtatttttagtagagacgaggtttcaccgtgttggccaggctgatctcaatctcctgacctgaggtgatccacccgcctcggcctcccaaagtactgggattacaggcgtgagccaccacgcccaaccaaaagtagttatcttttaacagatttttaaaatataattaaatataaccaaacttcattataaagaacaacagatatacatatatatgtgtgtgcatgtgtgtgcaagcgtgcatattcgtgtgtgtgtgtatatatatatatatatatatatttttttttttttaaagaaacagtctcggccaaggcaggtggattacctgaggtcaggagttcgagaccagcctggccaacatggtgaaactccgtctctactaaaaatacaaaaaattagccaggcgtggtggcgggcacctgtaatcccagctactcgggaggctgaggcaggagaatcgtttgaacccgggaggcagaggttgcagtgacctgagatcataccactgcactccagcctgggcgacaagagcaaaactctgtctcaaacaaaacaaaacacagtcttactctgttgcctaggcttcagtgcagtggcacgatcatagctcactgcagtttcgaactcctgggctcaagtggttctcctgcctcagtctcccaagtagttgggactgtaggtgtgtaccatcatgcctggctaatttttaaatattttgtagagacagggtatcactacattgcccaggtaggtctcaaattcctggcttccagcaatactcctgtcttggcctcccaaaatgctgggattacaggtgtgagctactgcacctggcctacaaatatgtgttaatatatatgcatatacagtcatgcactgcataatgatgttttggtcaatcatggaccacatatacgacagtggtcccataaaattttaataccatacttttaccatacctattctatgttatatatgttcagaaacacaaatacttaccattgtgttatagttgcctgcagtattcagtacagtaacatgctgaacaggcttgtagcctagaaacaataggctacaccatgtagcctaggtaggccatgccatctcggtttgttagtacattctctgatgtttgcacaatgacaaatcacctaatgatgaatttctcaaaatgtatccctattgttatgtgatgcatgactgtatatacacatatacaatatatattcacttataaacaagtatgttcttttatatataccatgttttctatttttcattcttttcagattcagttaagatctatacaatgcaaagtgttaatattgttatatttttcctaaacacatctccttactaggatcccatgtgtgctttgaggaaacttgtagttaatgagattatgtaatgccaaagcatgtaaaattagtctaagggagaccaagatgctgtatcaatcagggtcttagttgcaagctgcagaaactgacttaggcaaatttaagcagagaaggaatttattgaaagtattttgggcagcttacaacctctctgggagcgcccagggactgtgttcaaaaactagaaggaaggctagtatagggcctcacattgcagagctgactgaagacctgctgttgctgcacacatgagcactgcaatttgtgccatccatgtcagtgttactgtcactgggcagtggacactgctactgcctctgtccttttataaactgtttgtagttgccaccacataatactaagaatggattctgcataatccctcattctcatccctagtttttgattcaaatactgcgggtgagtatttatgatcaatgtggcctcatttacgtgccgatgtctagagcaagagatgctggaaaagaagtatctagaattttctgctttgatagtaggagaggggctctgttttataaggtgagggatgctaaggattaggaaggggattcagatcctggcggccaaaagaatgacaagtggctccattagatggcatttgctttagcagttgtgaagggtggagggtaaattgatcatcaaactataggagagactgctaaagataaacacacaggattaatggataaattaattagtttaattaagctacagaatttattcctaagaattttttatgatatcaaaaatgggattgttgtcttgatttctttttcaactaggctgttttatttgtgcgtaggaatgcactgatttttgtgtgttgattttgtatattgcaactttactgagttcatttattctaacaggttgttactatgtggaatctttggggttttctacgtataaaatcatgtcatctccagatagagataaaggcattgatttggatgccttttctttcttgtttgattgcctttgctagtatttccagtactatgttgaatagaaatgggcatccctgccttgtactggatcttagtggaatagttttcatttgtttcctgttgattatgatgttagttgtatgtttttcatgagtgacctttattatgttgaggaacttttcttgtatgcttaaactgtgaagagtttttattgagaaagaatatttaactttgtcaaaggctttgtctgcatccattgagatgatcatggggtttttaaatctttcattctgttaatgtggtgtatcacattgattttgtgtgtgttaaactagccatgcataccaggaataaatctcacttgttggtgatgtcatcaacaaaaataaaacacttaggaataaatttgaaggaggtaaaacatttgtacactaaaaacaataaaacgttgaaataaagaggatgcaaataaatggaaaataccctgtgctcatagatggccttggcaatgactttttggatcacacctaaagttcaagctacaaaagcaaagataaataaatacatgaactatatcaaattaggcttctgcacagcaaaacaaacaaaacaaaaaaccagtcaacaaaatggaaaggcaacctatgggctaggaaaaagtattcacagactacatatctgataagaggttacatttttaagtttttagaaattttaagaactgttagaactcagtggcagaaaaacaatctgtttaaaaagtagacaaaggacctgaatagacatttctccaaaaaagacataaaaatggccaacagatatatgaaaaggtgttcaacattactaatcattggggaaacacaaattaaaactaccatgagataccacctcatgttcattaggatggctgttataaaaaagtcaagatgtaaatgttggtgaggtgttgagaaaagggaaccctggcacactgttggtgggaatgtggattggtatagccattatggaaaacagtatggaggttcctaaataaactaaaaatagaactgccatatgacctagtaatctttcttctggatatatacccaaaggacatgaaattgaaattgccatcttgtaaagatatctgtactctatgttcatttcagtattattcacaagagcgaagatatggagacaatgtgagtgtccatcagtgggcaaatagataaaacgtgtgtgcgtgtgtatgcacgtgtcggtatttcattgtatgtggacttctagtgtgtgaatatctagtccttgttggcatgataccttttgaaaggtaaggtagagtctttttcttttcttttttgaggtggagtcttgctctgtcgcccaggctggagtgcagtggtgcgatctccgctcactgcaagctccgcctcccgggttcacaccattctcctgcctcagcctcccaagtagctgtgactacaggcgcctaccaccacacccagccaagttttttgtatttttagtagagacggggtttcaccatgttagccaggatggtctcaatctcctgacctcgtgatgtgcctgccttggcctcccaaagtcctgggattacaggcatgagccaccgtgcctggccagtgtaaggtagaatctttttctaagatggagttacttacatcaagggtgctctatagacatttccttctttctagccccagcccaaggaatctttgaaggaaaggtagaagatacgtctcaaggttactactgaagaaaacacaaaaaactgttcgttggcagttaatagttgtctgggtattgctatttatgaaatagaataattaagactttaaattaaatttgatttaaacttgtcacctatagataaatgtcaagttttagaccttaaggtaattattgtatggttgaaaataaatacagcaccaatgatattttacttgacctattttgctatgcgatcagttttttttttgtatttaaaaattactaaattggctaggcatggtggctcacacctataatccaagcactttgagaggctgaggtgggcagagctcttgagcccaggagtttgaaccagcctgggcaacatggcaaaaccatgtctctacaaaaactaccaaaatcaactgggcgtggtggctcatgcctgtagtcccagctgtttgggaggctgaggtggaaggaccgcttgagcctgggaggttgaggctgcagtaagctgtgatcatgccactgcactccagcctgggtgccagaaaataactttgtctcaaaaaaaaaaaaaaaaatgttctcccaaaactctatccactttcccgcactaagtagagtgactgtaatctcacacagttgagaacatttagacataatgtggctttgtgggagaggtgaccttctagattctgaagggtttcaaggactcatttccaatagaacaactataattgcagtatcctagaaaagggcttagagagaagaagaggaaagaaaaaaaaggtgattcataaatacagatgtagacactaggacaataatacatgcgataattgtgaccttggcattcttactgtgaatttccattgaattgctgtaagttagattctctgttctgtttacttctttgcacatgactttatacttgtgtgtgaaaaaaaaaaaaactgaactgtgatttgaggatccttagcttttaatctaaaagaatgagttggtacgacctctggaacatacttctggaaggaagaattacctaagagaatggtttttctgctagtcagaaatctaagttttgtatgctagcttgcaagttaaggatagaaaaggctttccctggccgggtgcggtggctcatgcctgtcatctcagcactttgggaggccaaggcaggtggatcacgaggtcaagagactgagaccatcctggccaacatggtgaaaccctgtctctactaaaaataaaaaatcagctgggcttggtgacgggcgcctgtagttccagctactcgggaggctgagcaggagaatggcatgaacccgggaggcggaggttgcggtgagctgagatggcgccactgcactccagcctggatgacagagcaacactccgtctcaaaaaaaaaaaaaaaaaaaaaaaaaaaggttttccctgaagcaaataaatgtaaacactttgaatcaatgttgcattttcaagagaaaactatttcagcagatgaacaaaatagattaaacacaatagcaaaatctttgaggaccctccagctgtttctagttctactaccatatggtagctggatcaatgaagaaaattcagtttgagcatcagtaattgctacctgggtgatgtgaacaagttcaaagaactgcacttgaaagtgtcctgtcaacagtgtatgagcctcttcactgtgtcataggggcagaggtgagtaccacagttaactctctcagtggtccccaaaagtctgctgaatgaagtacagaatccttatttaggcatgtgaccaccttctatctggtccccacctacctttccagtatatcacacttagagctaatgcttttatcaaattggactccttcctggtatcatcaccctttcctacctctgtcttacaacactataatatttccccctttactcggaatgtcctactcttctcctttatatctcttaacccaaattatactcctcttcaggaccatttcaaatactatttttgaataccatgaagtcctctgttaatccccctgggacttctgaaccatagcactttatatgtctttttgtggcatttgtcatgtttttgtcttgtttcatagctatttttgtgtgttgtgggttgaattgtgccctcctaaaagatatgttcaagtcctaaacttcagtccttgtgaatgtgacattatttgtaaatatggtcttggcaaatgtgatcaagtgaagatgaggtcacacaagatgagggtgtgtcccagttcaatgactagtgtcaaaaggagagagaaatttggacagagacacagggaagaaggccatgggaccacagaatcagtgattggagtgatgcaactacaaactggaatgtcaggggttgctagcaaggctagatgctaggaagatgaggggaagctcctcccctagagccttcagagacagcatggccttgccagcatgttgatttcagacttctaacctccagaactgggagaataagtttctgttgttttaagccactcactttgtggtcctgtacaaggctgccctaggaaacgcatatagtgtgttgatctaatctctagtcctccccaggcaatgtattataagttggtaaagagcttgggctgttttttactcatcattatctccttagcagtgactgagtcattcagctgttttgttttgttttgagacggagtctcgcactgttgcccaggctggagtgcagtggtgcgatctcggctcactgcaagctttgcctccctggttcacgccattctcctgcctcagcctccagagtagctgggactacaggtgcccaccaccacgcccagctaattttttgtatttttagtagaaatggggtttcaccgtgttagccaggatggtctcgatctcctgaccttgtgatccgcccccttcgacctcccaaagtgctgggattacaggcgtgagctaccacgcccggcccattcagctattttttgctttgcttttttagatacagagtctttgtcacccaggctggagtgcagtggcacaatcataacttgctttaacctaaaactccttggctcaagccaccctcctacctcagcctctcaagtagctaagactgtaggtgcacaccaccatggctgcatacatatatttttgatttttagtagagataaggtcgtcttatgttgcccagactggtcttgaacttttggcctcaagcaatcctcctgcctcagcctcccaaagtgctgggattataggcatgagccaccaggcctggcagctgttgtttaaaaaaataaattcatggccgggcgcggtggcttatgcctgtaatcctagcactttgggaagctgaggcaggcagatcgcctgaggtcaggggttcaagaccagcctggccaacatggtgaaaccctgtctctactaaaaatacaaaaattagccaggcatggtggaggctgaggcaggagaattgcttgcacctgggaggtggagcttgcagtgagccaagatcatgccactgcactctagcctgggcgatagagtgtgagtccatctcaaaataaataaattaattaattaatttatgtttattgaggtataatttatgttgagcaaaattcagcctttttaggtatacagtttttacaaatgtaagtagtctgtgaccaccaccaacacatagaacatttttatcatcccagaaagttccctatgtaccttcccagtcctttcctggcaactatagatttgtggattttgtcatttttagaatgttatgtaatggaaccctatagtatgtagccttttatgtctggcttctttcacattgcataatgcattggcgattcatctatgttgttgcacttactggaagtctgttcctttttactactcattcagctgatttttgagtgtcattgcacgctagctattgtgctaatgtcctgcagatggattaatgaatagggtgggcacaatatctaccttttgggttttatatgtcaggtaataacaatagagtatcataagtgttgtgatggtatcaagtacagtgtattatataggagtacagaggaggaacatttaacagatttgaaggatcttaaaaggcttcctagaggaactgatgtttaacttgagactcaaggatgaatgattaggctccaggcagatgatgagagggatggatgcaggcttataccagcttcagagttgattgttaaaaattcaggaactctgcaagttagtggctaaatttttgacagattgaaattggccgtggtgggtgtgcttagaccatggatattgttaaacacatcaaatgaggactctctcccagcccctaaacagttctcctggacaccactggatggacaagtattataaccaggagagataattaacatgaatgcaagaaagaacatggcatttttgaagaactgaaattcagtacagttgaagtatagagtgtaagggagagaactgacgcctggagaattcgatgggtgccagattgtattgggtgatgtaagctatgctaacaagccgtaatgtccttttctgctaatttcatatctgtgtcagttctggcattattttgattgactgatcattctcctctttagggggccattattttcctgcgtctgtgcatgccatgtaatttttgatggcatatcagaaattgcttttaccttgttgagtgcagtcataattttgtattcctataaatactatgtagtttttattctggggtataattaagttacttggaaacagtttaatctctttaggtcttgcttttaatatttgttaggtgagaccagagcaatgtttcgtgtggcgttaattattctctactacagcaagacccttttgaattctctacccaatgcctcaggaattctctacccactgccttatgcgttaggaggcatgaattagggggcagactttgtgactgtttcaggtaggagggtacatttgatccctagcctccatcatggctggatataaaagttattataccttatctaaaattagtggagggcagttatagagaggtttaactaagagtctggcaggatcagatttgtatttttaaaagatcattttgaatataatacagataatgggttgttctatttatctggtggagttggtggggccttcagaatactatattggaggtaggtaaaccagttagaatacaactgcagcgattcagttaagaagtagttatgactgggctgggtgtggtggctcatgcctgtaattccagcactttgggaggctgaggtgggaagaacacttgagccaggaattcgagaccactctgggcaacatagggagacctcatctcttcaaaaaataaaaaagttagctgggcatggtggtgaatacctgtagtcccagctattcaagaggctgaggtggcaggattacttgagcctgggagattgaggctgcagcgagctatgattgcaccactgcactccatactgggtaatagagtggggccctgtctcttaaaaaaaaaaaaaagaaatatagttgcattgaaaacagtgtctgagttgttcaaaaagtatctctgaagtagaaaatataaaccattgcagaagaacagtgaaaaaaatagtaggttaagcttcaaagataaaaaaatcagcccaaatctgatttaaaaaatacattgtcatactagagagtaagtttgtttgaattcagaagggtgcccaccagtggtagaatccaaacacctacagatgggtatggaagagctatgacactaagcactagaggaaagttgaagatggaaacgttctttcaataaaagaacattctgggatcttgctatgctatagaatcggtatccaaaaggtagtgcaaagtttaatttccagatggcaccttttaatcacatagatgacatccagcaattgccatctaaggatatacaagttaggaaaaagttgtgtggaaacagagctttaaaagcaattaaaacagcattctattattattattattattattattgttattatttttttttttttgagatggtgtctcactctgtcgcccaggctggagtgcagtgacgtgatctccgctcactgcaagctccgtctcccgggttcacgccattctcctgcctcagcctgctgagtagctgggactacaggtacacgctgccatgcccacctaattttttgtatttctgtagagatggggttttaccgtgttgcccaggttagtcttgaattcctgagctcaggcagtccccctgcctcggcctcccaaagtgctagtgagccactgtgcccggccgatgattttttttttttttttttaagagaaaaaccctatccaccccaactgcctgtgttcttctactttattaaacttttagttacatttttagtattagctgtcagtggtttcagtttcatttaccagaaaagaggagtaagatcctaatgaaggcctgtcagtgccttcctgttatgtagctgcagtatccagtgcgtgttctttctggagattgggcagagttcagtggctccttcctggttctgcacttttggtgctggtagtgctatttaaaattcttggcatcagtcaggcgcagtagctcacacctttaatcccagaactttaggagtccgaagtgggcagatcacctaaggtcaagagtttgagatcagcctggccaacatagcgaaaccccatctctactaaaaatacaaaaattagccgggtgtggttgtgctgacttgtagtcccagctactggagaggctgaggcaggagaatcacttgagcccaggaggtggaggttgcagtgagccgagatcacgccattgcactccagcctgggcaacagagctagactctgtctcaaaaaaaaaaaaaaaatcttggcatcaaggttgctcctccttctcattcttttctgtttgaaaagccttgagttggaacttggtgtcactgatgaattgatggaacaccgtgaccacactctattccaactgcttctttgatttattgcacatttggtctgagccagaagtagctaatcagaggggctgcataagcacagcagggaacccagagagtgcacacccctttctgcttttcctatcaccagctttaagatgcttcaggtagagttcactttgctagtagtggtgatgccagtttttattcaggaaagaaagtccaaaaagaacaaaagtaaatttcaaaagaattcacattatgcattgcaaacaatagtttaaaaacagaatattcaggaaaatactactttgcttgtttctttttttccacccaagctggagtactggggtgtgctcatacctcactgtagcccccaactcctgggctcaagctatcttcacaggtagcagggattacaggtgtgagccaccacgccctgcaaatactactttctgatataagcaaggctggtgtttgtatgaatttcttcctacatgttaaaatttctgtggagatacagccaatatcatactgaatgggcaaaaactggaagcattccctttgaaaactggcacaagacaaggatgccctctgtcaccactcctattcaacatagtgttggaagttctggctggtgtaatcaggcaggagaaagaaataaagggtattcagttaggaaaagaagaagtcaaattgtccctgtttgcagatgacatgatcgtatatttagaaaaccccattgtctcagcccaaaatctccttaagctgatgagcaacttcagcaaagtctcaggatacaaaatcaatgtgcagaaatcacaggcattcctatataccaataacagacagagagccaaatcatgagtgaactcccattcacaattgctacaaagagaataaaatacctaggaatccaaattacaagggatgtgaaggacctcttcaaggagaactacaaaccactgctcaacaaactaaaagaggacacaaacaaatggaggaacgttccatgcccacgggtaggaagaatcagtattgtgaaaatggccatactgcccaaggtaatttatagattcagtgccatccccatcaagctaccaatgactttcttcacagaattaaaaaaaaaaactactttaaagttcatatggaaccaaaaaagagcccacattgccaagacaattctaagtaaaaagaacaaagctggaggcatcacgctacctgacttcaaactatactacaaggctaccaaacagcatggtgctggtaccaaaacagagatacagaccaatggaacagaacaaagccctcagaaataacaccacacatctacaaccatctgatctttgacaaacctgacgaaaacaagcaatggggaaaggattccctatttaataaatggtgctggtaaaactggctagccatatgtagaaagctgaaactggatcccttccttacactttatacagaaattaattcacgatggattaaagacttaactgttagacctaaaaccataaaaaccctagaagaaaacctaggcaataccattcaggacataggcatgggcaaggacttcatggctaaaatgccaaaagcaatggcaacaaaagccaaaatagatgaatgggatctaattaaaccaaagagcttctgcacagcaaaagaaactaccatcagagtgaacaggcaacctacagaatcggagaaaatttttgcaatctacccatctgacaaagggctaatatccagaatctacaaataactcaaacaaatttacaagaaaaaaacaaccccatcaaaaagtgggcaaaggatatgaacagacacttctcgaaagaagacatttatgcagccaacagacacacgaaaaaatgctcatcatcactggtcatcagagaaatgcaaatcaaaaccacaatgagataccatctcatgacagttagaatggcgatcattaagaagtcaggaaacaacagatgctggagaagatgtggagaaataggaatgcttttactttgttggtgggagtgtaaattggttccaccattgtggaagacagtgtggtgattcctcaaggatctagaactagaaataccatttgacccagccatcccactactgggtatatacccaaaggattataaatcattctactataaagacacatgcacacctatttttattgtggcactgttcacaatagcaaagacttggaaccaacccaaatgtccatcattgatagactggattgagaaaatgtggcacatatacaccatggaatactatgcagccataaaaaggatgagttcatgttctttgcagggacatgaatgaagctggaaaccatcattctcagcagactatcacagaaaaccaaacaccacatgttcttattcacaggtgggaactgaacaatgagaacacttggacacagacagggaggggaacatcatacaccagggcccgtcagggggtgggggactgggggagggatagcattaggagaaatacctaatgtaaatgacgagttaatgggtgcaacaaaccaacatggcacatgtatacctatatatcaaacctgcacgttgtgcacatgtgccctagaacttaaagtataataaaaacaaaccattaaaaaatagttaatacaatataaaacaaaatttctgtggggataaatttctaaagcttgcttattaccaacaaggggaatgtttaaaagccagacattttagtatatcttttaggattttttttttttccagacagagtctcactctgttgctggagtgcagtggtgtgatctcggctcactgcaaccttcgccccctggcctcaagcaatcctctcatctcagcctctcaagtagctgggactacacatgtgcaccaccacgctccgctaattctttaaatttttggtagtgatgagttctcactatgttgcccaggctggcctcaaatttcagggctctcatgatcctcttcagcctcccaaagtgctgggattacagctgtgagccaccatgcttggccagttttacctttgtaatggtcatgttcatagctcatcagctagtaagtttgcactgttcacttgtcttggatagtggtaattgctggaatattacattttgagatccatccttagtttcttttcatctttctccctttttgagagtggtttaagaaaattctaattgaagatctctgccatttttttctccttcccacttgttcttatttgagttatttgatttactagaaatttctggttgcaaacagaattctgtattttacatttttgccctatacttttggcaagcttcatgaaagtaacatgatttccccccttatttctctgtttccttatcccctttatggcacatagactactgatgttcatttgttgattttgtttagccttgtattcttgttcgtttgctcatttattcttgcatgcatatatttacgcattattatttccctccttcctaaatgcacatttactaactgcctactgtgtgccaggcaccgcaccagtcacaagagtagtaataaaaactgggctctgacagttaacagtgctttactgaagatgtgtacattgcagaaatcatgttggctttgtgtggagctaggcagcatcgagccccaactaagataagatcactatatacctcagactactgaacatataatgtgtattatcccttgaggaagtaaaaaaaccagaaaaccaaaaaatgttttgcatcaatgaacaaaaacctagacactatcagtgatgcacaaacatctccagagaagatcagtttggcacgtcggagagggaactcgccttgacaccttgtggccacttggttttctgtgaagtttggaatcggtagaatgtagggtttgtatctaccttgccgtaccttgaccccattggtggagagcacatttgtttgcacatcattttcaggaccaagcttcgagtctcccctctaatggtatgcccgattttctataaatgtatgctgtgacaagaagccacagctgctccgttagtctcaaaggacatgacctgaaaaagaataaaaatcagattgcacatatttgctctaatttttgacaggaaggctaaacaaaacatttaaaaattcaaattactctgtatgtcatttgcccatttaaatcacagctctgtagaatactgtttttcaaaactaaaaataaaagaaaacctaatgagatgagaaggcaagttggatgcgtatttttttttgtgcagaaacatatttcatgtccattgggttgaataggagggggaagaggcagagaaacagataacttaagatttacattgtagtgtcagacaggtgtattcaagggacattatggacgtcctaattagtctaatattattttagagttttcagctaagctcatagtgtgcacaaaaacaaacagaacagactcacaagccaacagtggggagagcaataaaagcaagaaatctgctggatacttacagaaatgatcttggcattggtgggaaaaggttttgttatactgacagagattaaaagactagcattatttgaataatgtggttttagagtttttgaatttatatgtcatttaaagtctttgtagtacagcagtcaaaaaagatgcccatttttatgattttgttaatagatttttcatgtttgtatttagaaatctggaagatgttcaaaatattaaatgataattttctgaaagatattttcaagtatatacaaattaaaataataattttaaaatatctgtaagacgtacatctcacctgagttatatgaaaatagcaaaaaagaattccaggctgggtgtggtggctcatgcctgtaatcccagcactttgggaggccgaggcaggtggatcacgaggtcaagaaattgagaccatcctggccaactttagctgggcgtggtggcatgcgcctgtagtcctagctacttggggaggctaaggcaggagaatcacttgaaccagggagtcggaggttgtagtgagccaagatcgcgccactgcactccagtctggtgacagagtgagactccatctcacacacacacacacaaaaaaagaattccaaaagtattttccataggcaatttaaaattaatattaatcacactggatataaataaatattaaatatattgactataaaacattaacaataatttgattggagttacattgactataaacattaatattgacatctttacagttgtaaagtttcatccaggaatgttccacttttccatttatacctctgtccttatctttaccttgttcacattttatgctctagtaacagcaaattgcttgcacatcccacagtacctgcattttctcctttctgattttggcccttcttttagttaccatctccttctggctttttgcctgggcagctctttgttttccgtcggatcaggtgtcacttctcctaggaagcctcactgactctgccccaacctggattcactatgccccccttccccctgccacacacacacacaatgctcccataagactttgtgtctgtcattgcatgttctgtaactgcttatttatgtgatccttaactcattagggtatggcactaatctatttaattttatattttcagcacttaatacagtatctggctcttaacaaatttttgttaaatgaataatcaaggatctttctgtgtagctttatattttttttcatataggtctcacccattcttaaggttttgttgctgtcacggaggggttacttttttctccttaaagttattacttgtttatattggtagtatgtgggaaagttctttctcatctgctctccctgagggtgaactaggtgtggttgcaagattgctgatggtgttgttgggctttcaactccaggcattggacccggaagctttgattatttgtatggtggttttcaccaacaaagttaactaatactcaacattttaggtgtcagacaagttattagtaagacacataagcttcttggtggaccaaatcttttctaaataaattagtatcacgagcatatcattgtgtgtataaaataataaagggagagaatgtgaccccctctaagtccttgaggaaagaattcagatttcctttaagtttctttttttctgtttcatgtagtcttctcttgtcttgttcaactcagagtctgtctgagaataaggagagcaggagtgtatcttctatatttatgttattaacatacaatagtgtttggcacatagttgtgctaaaatgtatgaaaaatgaaaattaataaatagaatcatcactcctgaagtcattcccattttcccctagaaaggtagtaaacaatatttattttggtaaaagctgttacattctgctggaaactagaattttaccccataattaccctatgttagaactgaaaaaaatgttgaaaggcacattgtctaaaattccagtttgagaagtctgaatattacaagttttcaaaatggttgggagacaactcatggtttagtgagcacaatccctcccctagaagctgacccttattaactagctatttctcaagtagtttggtcccataacttgtcacagagagtatttgcttcctaaccccatagtcattctccctttttctctgtggtaatagaacctctgattcttatctggactcatggccacccgaaaaaaattatcttacatactttgtggtttgatagaactatgatgtatttcttatacttacaatatagctctgtccaaaagagaaatgagtgcaaatgttctattgtagtttctagaaaaccttaattgatagatgctgcatgccttctgcccccttttcttcaactatttttccatctcgctgcctggaattttgatgggatagcaggagctctggttctcatattggactgtggcaagaagggcctccccaggcatggcagagcaatagggggagcctgggccaccataccagcctttgactgctggactctgtacttcatttagttgacaaatgtattagtcaattctcacactgctctaaggacatacccaagactggataatttataaaggaaagaggtttaattgactcacagttctgcagagctgcggaagcctcaggaaacttacagtcatggtggaaggggaagtagacatgttcttcttcacaaggtggcaggagagagaagaatgagagctgagtgaagggggaagccccttataaaaccatcaactctcctttgggaggctgaggtgggcggatcacgaggttaggagatcgagaccatcctggctaacatggtgaaaccccatctctactaaaaatacaaaaaaattagccgagtgtggtggcacatgcctgtagtcccagctctttgggagggtgaggcaggagactcacttgaacctgggaggcggaggttgcagtgagctgagatagtgccagtacactccagcctgggcgacagagcgagactccatctcaaaacaaaaaaccatcaaatcttgtcagaacttactatcatgcgaatagcatggggagaccgccccccatgattccgttatctcccactgggtccctttcatgactcgtggggattatgggaactacaattcaagatgagatttgggtggggacagagccaaaccatatcaacagagatagaatcttttatcttgtttgggccgtgatatacaggtacaggtctttgttacatgcagccagagcttatcctgacacactatactacagatcagttctaagatcttatgacttcattgcccatccaaagactgatctttgtattcccttatttattcagctttgtcaagtcatctactctcatcttggagttctgtgccagggtttgatgctggccttgttctgaaggtgattgatctgacaatttttactaggtcatatacagtggtacagggttaacagaatagtcaccaactgttttggggaaaacagctgggttctaaattccagaatgtcatcatccttttctcataaagcctagaatccctttaaggtaccttagtgtatttggcatttccttcaacataatccatgcagatggggaagcagctttttaatggcattgggaagataggcacaacctattatgtagtgctcagtgtggatgttcgatgctcaggggctttttgggccctacacttggtgagaaagctaattataagtcactgttgagcaggaggagagatttttattattattctcttgttcatttagctcagcctaacttttaaaataatcaccgtagtgacttgcatagtcttcctcacaaagacaaagtgttaggtgtcgcttgttttagggtaaatattgaggtgaaggacatcacatctgcatctacaaaggctgaatcatggaagctagaaattggaagtggtgaagaatttttatgtcctgtaggctgagctgtggattttccctggattgatctgtgtcagcgtggagacttaggatccaccttgaccctccaaatatgtcatctttcatagatgagattagagaagttcagagaaatgaaagaggacattttatttttggtagcagccattgcggtgactattggacattctctcctcctctgtgaagattggggtcttctcagcctttgtcgacctataaagttcatttgtgacttttcagtaacttggtgtcctggttgaggacatgttctgcaggggctgtgggatagataaaggaagatgatcatgatgaagaggagccaggaaaatggagcttaaaatgaagtacttatgcagaattggtgacacattcctctgctttctagagttggtttcctaaaggagacaccacaaagattcaggtcaattatatgatttgaaagatccaaatagccaggatgaatgagttatgggaattgctactatcaaatgatcagaattgggtggtaggcttgggaagattttccatctttcacattcactcttcacatatgcctgatctgtattgttcattctgaaagtctttgcaggtttccttctgcctgagtaaagattgttccttgtaatctctgaactctcactggatagctttgttaagtacttttgcttgactgaaagccctttttttgttgatagggctgaaagggtaagcttaaaattggcagctgtattatctatgactagatggtaagctttttgaaagcatattagtactgaggagttctagcaagtttaatgtccactttgccactgaccataagacatgtgttaggccagtttgggaagttaggcagagtgaaaatcctggatattataaacacagtgatggaattggtacgacacctttatttcactaatactatcattattagaatacttagagttctgtaagacagactatttttaaaagtactataggcataattttaggaaattcctgaggtgatttcctaaaaagaggaattctttatttcttagtttggacttccatatcttcaaacatgtcaacaaatcaaatattagtatgtcaactatcataaaatatttcctgagcatttgcttttgttctggggaactcaagatagccaagaggcctagcagaaacagtggaaaaaagagctttactacttaataatttattattgtaaatgctctctgggcatggtggcatgcatctgtatttctagctacttgggaggggaggctgaggtgggaggatcccttgagcccaggagtttgagaaaaatcgatgccaggttgtcttttggagaagcaaagttaaaaaataaaataacaaatgctgtgagccaagagtctaggtgtctagccattaaatggctgtgtggtcttggttagaacattgaactttctagagctaaggttcttcacagctctataaagtgagggttagaatgaatgatgtctgcagttccaacttttgaagtctctgaatattttgtctcaaatacattctgagaaggtccctgccctcaagaaaattgagctttttctctagattttcttccattttgtttcgttccaaaaggaaaaatccttgttgtttacaaaggatgattcaactggaaaatgtattgtgtcaaaaggaaaagtttccttcaatcccacattctgagagataatcattttaaaaataggtattaattattttgactaatttctatgcataaattagtattttttgtgatatacatacttatatatctttatatctatatatgtatcattcatactatactgaagcgtgcttttctcatgtagcagttgagataatgggtatctttctgtgtcagtacatacagacctaccaaatggagtgccactgattgaatattgtggttcaccaaaacacattttggccaaatgatcaatatttagctgaagttaaagctaaatatcattgttgtaaaatggactactgggatacaagaaaaaaactcaaattaaagactatattaaaattttagtagccagatttagacaaatgggcatactgatttctgaccaccgtcagctttttggttattcctgtagtcaccatacactacactacacatttgcaatactaaagttgctaccttttaactgaggtgtctagaggaacaagatgttgtttggctggctctgccagaatagagtactgatgatggtaaagttgttcctcagcaactacgcttgtcttctcaaatagtaactgactaggtaagaacttgatctccttatcagcccctacccttggagatttgttttatggtcatgagtttaatgaagcaatcctagaaattgaagcattgtatactgcttgaaacattctttctgaatattttcagaagcatgtgtaagattgctgctatctcttatatttatttctaattttcttccgtttttgtttcttttgtttgtttgtttgagacagggtcttgggtcttgttccgtcacccaggctggagtgcagtggcatgatgtcagctccactgcagcctcaaactcctgggctcaagcaatctcccacctcagcctcctgagtagctgagactataggtgcgggccactgtacctgggtacttttattttattttttttaaatagagatgagttctcattttgttacccaggcttgtcttgaattcctggcctcaattgatccttccacctcagcctcccaaagtgctgagattacaggcgtaagccactgtacacccagccttatttctattttttttttttaacatttttgcttcttcacacaattatttgatttaaaaatctcttattaattttggctctagaaatgtggcaatagagcaatgtagttgactttcaaaatacaacaaaattgtctcaatatctcctgtgtctcagctttgattgcatgtgtgccaacttcagcattgttgctggaataggatgagatgaggctttttatcatgtaaggaaaatgtgaactcttcatgtacatcagttttgctacccccttcccccttttaaacagattccagtaaatgccttcataataagcagtcattggattttgtaggcctaatattttggtattcttatctataaagtagtagaatattatgggatttttattgttttttaagcaggctatgtaataggcactagctgctcttccatcttgtttgaggatattatataagtacacaacaaggccgttctacaatattctgtaagtcagacagttgtctttacttgaagaagagggaagacagtggtatactccctttgagcttcctagttctttctagttctattcctttcactatgccccaattaattcaggacacacagctgttgaatcttatgactcctaagacacacttctccatgtttgttcccttgtcaactacagttggctgtcactgttcttttctggttttcttctataccttttagtcagatccaccatgtgtttagtatgtgagagaccaggaactcttctggcaaacaaataaagctggagtggaatggaatgtgctgtgaataccccttgctatcttacttaaagtaggtttctaattgtccatgcatgtccatatgtctggtatataagatataaaagtagcacatttggtgaatcaccatactttgtgtgtatgtaacaacacaacgcagaagaattttggtaatatgttttctagaaagacttttagttctaggattcatagtttcaggtttgtacactttcatcttcaatgtgagaatcagagtggttggtattctatagtagtcattttaccaagtttactacttaaaattagccaggaagatcagttgagcctcagaggtcatggctgcagtgagctatgattgtgccactgcactccagtctgggtgacagagtgagaccttatctaaaacataataataaaagtagcctctaggccacatgcagtgtctcatacctgtaatcctagctctttgggaggttgaggtggtggattgtttgaggccaggagtttgagaccagtctgggcaatatagcaataccccatctctacaaaaaataaatttgctgggcatggtggtgtgcacctgtagtcccagaaacttgggaggctgagatgggggagatcacttgagtctaggagtttgaggctgcagtgagctctgattgtgccactgcactccagccagggtgacagagtgagacccaatctccactaaaataaaaaaataaaataaaattagcttctatattctttatctgtaaggatttttaaaagccttctttaaattgtgttatattttgaagttttattcctgaaaacaaaatgtggtaacttttgtggtatttaggtaactcatttttctctaacattttcttctttatattctttatgtgtattttattttgtgtgcatcaaagatgccttcatggatgtcattgtttatgatgttcctagtttttcctgttcttgaaattttgacatggcaaaattataaaatccatgtctcatgtccccaatatcttaatctctgtggatctttttcagttaactcttgtttcttttttcttttctctttgttttctactattttggtctcatcttttggtaggcctgatcgtttttaatgaatattggacattgtaaattaaaaattatagagatcattggaggctattgatagtgtcattttcctccaaaaatgatttacttttgcttgtaggcagaatcagagattgagctcactcacagctggacctcagacttggtgagggctggtcaattcctactttactcctaacttacaggatgcagtcatcagggggtcccgcctgaaagccttggttttccaagactcttcctcatccattggccctgaactctagtttttgtcctcccagtgctgtaagactagcagagctttcttcagctttacaacctcctgggttgttttttagcctctcaataccaccttttgaaaattgataaatgccttagggggataagcagccctaaatgttaccctgacctccttgtttgcttctcttctctccaggaatttcatccaagtcctcactgccttgggaactctcatgtcttcagataagacttttcaggtctttttgggtaggggcgcctggttcctcgttctcagcaagactgggggaataagatagtcattgttggattttacccattttttgtttgtttgtttgttaagagggttttattttaatggttgttttagggtatacagtaaatacataacttaccaaaatctaccttcaggtgctattatatattcacatatagtacaaaaccattattacatgttcttcacccaccttcgcttttctgctttgtcatatagtttgcttttatttttattgaaaatcataatgtattcttattaatttttctctgaatagttctctttatagacattactgttctctttatagacattacataatacagaggtttctaattgatccaggtagctactgtatctgatttttcatttctttttgtcaaaccacatttcaatgtgggatcattttctttcatttaggggtgtcctttatcatttctaatagcgagagtctaatggtgatcaattccgtaggatttcacatgtctgaaaaagtcttattttgcctccagttttgaaagatgtttctggtggataaagaattcaaggttgttggattttgcatgttattattttcgagacattgcttcactatcttcttttttttattttattattataccttaagttttagggtacatgtgcacaatgtgcaggttagttacatatgtatacatgtgccatgctggtgtgctgcacccattaactcgtcatttagcattagatatatctcctaatgctatccctcccccctccccccaccccacaacagtccccagagtgtgatgttccccttcctgtgtccatgtgttctcattgttcagttcccatctatgagtgagaacatgcggtgtttgtttttttgtccttgcgatagtttactgagaatgatgatttccaatttcatccatgtccctacaaaggacatgaactcatcattttttatggctgcatagtattccatggtgtatatgtgccacattttcttaatccggtctatcattgttagacatttgggttggttccaagtctttgctattgtgaatagtgccgcagtaaacatacgtgtgcatgtgtctttatagcagcatgatttatattttacccatatttttaagtgaacattcagatattaaaaataagtatatatagcatgccttttttacattactgaatcttgtaccaattatatattaatctgtgaaatcatatgatcatttctaatatagaagttcaggaatgtcaaaaacaacactgaataaggcattcagcaatttggacagttttaaaaaaatctatcagattttaaattcatacatctgtcatttacttcatatatattagcaatcatatttcatatattctccccttttcctattttcctactggattgctttattctaatggatttgtggatgttctttgtatctaatacacaaagatctaatatattattagattaatacgtattctttgccaataatatgtgctacaaacgttacttctcagcctgtcatcttttgagtttgttgataatttctgtaattcaaaaaaattttctttttatgtattaaaattttttcagtagccaaaatttgccctacctgctttcttgtaatagtgttatgatttcctttttttctgaacacttaaatatctgattcatacaaaatatgttttacatctgagaaatgagatattggtaactagcctagtttctcacatggctggtgagttgctttaacactgttaaagtgatttctgcacagatatcatctgccgctcttacgatatctaagtttccatatacctggggctgtttctagacactcttctgttcttatgtttttcaccagtggctatccattttatttattgagacttttgaatacatttttataatcaataagacaacttctttaccatttaaaaaaaagcatatcttcgtttcatatattttaaaaaatgaatttgagtaatttggacaaattcaaaaatctttttgggattgaatagtgaatttatagacttcattaggtgaaattggtatcttgataactgttgagttttttgtcttcctttttaagttttattttgtaaagtttcttttaataaatgtttattcctgattcattcccaggaattttttgtatgttattgctattatgaatgagatattttcttccattttgttttatttatttattatttatttatttgagacagagacttgctctgatgcccaagctggagtgcagtggtgtgattttggctcactgcaacctccgcctcccgggtttaagcaattctcctgcctcagcctcctgagtagctgggattataggcgtgtgccaccatgctcggctattttttgtatttttagtagagacggggttttaccatgttggccaggctgttctcgaactcctgacctcatgatccgcctgcctcggcctccgacaatgctgggattacaggcatgagacaccgtgaccagtctaacttttgtatttctagtagagatgaggtttcaccatgttggtcaggctggtcttgaactcctgacctcaagtgatccaccctcctcggcttcccgaagtgctgggattgtaggcgtgagccaccgcgcccggcccccttttgttttctcactggattttgtttgtgtattagagagccatttattttttaagataagttttataactgggccacctttctgagtccctttcactcattgttttggttttccagacacacagcattgtttcttcagattatcatgctgttgtcccctgcttttcagtgttgatgccttttaattcatcctcttttctaatcgcattggttgctctttttaaaaaaatgttagatgaccatggtgttagtttatatttttaggtataatcctggctttcagttatttagatgagaagattggtgtgtttgtttctttaatttaaaaagaagaaaaaacaacccacaactctgttggttcttttcctcagtttctctgtttggctttttaggaagttaggaaactttataaaactgctttatttcttcttaaagttctttctttgcttagtaatgaaagtatttgactttaactttttctctgagaacaaccacttatttcttatggattggtttatattaatttattactcttttctgtattctaattctacagttttagttctgtttttttctgatcaaaaagtcatgtgggaaggagattaaatttataaaaatgtggggagcttttacttttgtggttaatttctgcttgcttacatcagtgaatatgatttgtatggctgctacattttagaattaattttttcttggtcttatacagtcctttttaaaaattagtgttacattgatatttataaagtaagtacacacacctatcaaaatatgtttgacattctgaccaggtgatttttggagtgacagtagaggctgataacctcttctaaagagaaagtttaagtctgttgtggtatgcacatatacacatgtatatccacaaatacaaggtcttattaattatattattcagaggctttatgtaataattttttttttttgagatagggtctcactctgtcacccaggctggagtgcagtggcatgatcttggctcactgcaacctccgcctcccgggttgaagcgattctcctgcctcagcctcccaagtaggtgggattataggcacgtgccaccacgcccagctaatttttgtatttttagtagagacacggtttcactatgttgtccaggctggtcttgtactcctgacctcaagtaatccacccgcctcagcctcccaaagtgctgggattacaggtgtgagccagtgtgcctggcctatgtcataactttttgagggatcaaatttatttaccaatgactaagagtagtgattttatccttttttcttggtccttttgccttacatttaatcttatcaaatgttaacattgtcatctgtgtgttttgtaattttggaaatggagttggaggtatgttccagttttatccttgcctctccctttgagtttgagcacttcagaaatggcacttttgctctagcagggaaatttagagaactgagagtttccgttggcttttgcataaatttttttttttttcctattcctaggggactcattctcacagttccggtttgctgaggagaaagaatgggatagtgaagcttcttgtccaaaacaggtaagataagagttgtgttaagtgtggactggctcttcttcaaggctgaaggctaacaccttttacgttcttgagatagagtcttcatgtagaaaagagtagtaattcttacagtgtaccctcagctaaacttttcagaaaattttcagggggctgaaattccacaggtccttgaagctagagttcacctttctacctggccatctgtgtgaattatgcagcccacatggacggggtctcgaggtagaaacttgatagccgtgattttgacagagtggattactttgccatttggtcttcctcctttgccacgctttgacaattcccttgagagttgaaaattagttttctgtctctcactgtttttggtgttaggttgagaaaacccttaaccttgcagctttaaataacacttctcctacaattaggagaatagaagtataaaataagggcaaatattatagaagtctttcagcaagtctctcaaccccaaatgccttattttctttgtgtgtatgtaatattttcttcccaaggagttctgattattttccaagcaggcttcctctaattcttttcatataagagatgacagatattctcccccttttaggatgcacatagggacatagtggtgacttgtgatatgctccccaactccaggcctagagcatactgtctgataaactgattaccatctgcccccagcttcagagaggtggctgaagctgcagacccgaagcccgtaggcactgtcctccctgttctgctcccacatcagcgtatgtgctgtgggtggctcgtttgatctgtgggctggttttaggctcaattgtttgggatggcctttgacgcatacggattacgaggaggggagtctcttagaaaatgactgcctggcactttacaaagaacgtgttatatatgccatagaaaaaggtgagaattacaaatatttgtctttgcttaagtctgggcctacgcctgaggtactgtttagtattctaggacacatcgaagatagattgttgaggaatatggtagaagccgaacaatttacatttcatctccttttgaaccatactgattaccaaagaatatttcaagtagcttcagagtttcaaataattctaagcttcgtcattcatcaaaacatagagcacttgtttactaaatgtttttattaaatggagcttattcaaagtgaatgagacagaccatgcctgttcattgctctaagccccttacctgggcacactcggtgacctgtagtctgtagtatggtagatgctcagtagatatttacctaatacatgaaaaagaatacaacctaaaataaggggtgtgatgaatgaattaacaatactgagagagatagctactttgcactggaagtgattagaattggtaccatggggaaaagatcatttgaacgggtcttggtggacaagtgtgactctggtaggtcctgtctgaggaaacaacatgaaaatggtaagatcaggaaaacgaggttatgctcagagaagggtgtggccagagtgtagtattcccagaggaggaggcctcaggggcaggtgtgggctagttagtaccagcagtttcagacctgagtgtgaattctagatctgagacttgggcaaactttttccttctctattgcttcacctgtaaaatggaggtaataacaaaatataactcagagttataagaaggactaaattagataataaataaaaagcccttgagtgcagttcctgatgcatatgaaacactcaaaatgagctcttttattactaatattatctgttaacaaagttttgtttagcaagaacatggaaatggttagatctaacttcagcagtattgggaaggatggggagggattgaacggatgagatgagaggttagaggcagggaaaccgattaggaggatgtgatgttggacgaatgggaaagaacgagagcctgagagggtcaggcagtgagcgtgggacaggggttactcatagacaagacttgagtggaggatggggtcaactgtgctcactggccagatgtgagacacaaggacaagaaagatttgcaatggcactatgctttctagcttgagtaactaggtgagtggtgatgccatgaatggaaaaaaataagagcagaaagaagttaagtttgattttgaacagttcgagttggaggtgttggtaggacatggctgaaactgaattcatttcaccatcaaaacgatttcctgtctgacttaactcctcactaaattttcttccttgttgatgtaagagaaaaaactggatatatataatatataatacgtattatatataattatatgtaatatataatacgtatattatatattgagtgcatatatataatatatattatatgttgagtgtatatatatattatatattatatatatgtacacacacacatatatgtaatttgttgttccttataccatcccatgtcctcagtgtgaccagtgacgcaagacaatagagagggggcgggcgcagtggctcacgcctataatcccagcactttgggaggccgaggtgggcagattacctgaggtcaggagttcgagaccagcctggccaacatggtgaaaccctgcgtctactgaaaatacaaaaattagctgggcgtggtggggcacgtctgtaatcccagctgcttgggaggctgaggcaggagaatcgcttgaaccaagaaggcggaggttgcagtgagccgagatcgtgccattgcactccagcctgggcaacagagagactccatctcaaaaaaaaaaaaaaaaaaaaaaaaagaaaaggaaaagtagaaatatgttttgtctttgcagttaaagggagtgggagtttgatagggagacatgtccaaaatcctcaagggaatcctggcaggagagggaccgggcgtcacggcttggacttggcgttcgttgctctgtggctgatacgcagggtgaagggacacaggtcggcggtcagggtgctctgatctagctatgttggcctccatgaccacaggggtgtcggtctcttagatccacaagtgggattctcatacctttcctttggacagggtgggtaccatgtaaagagaggatgagtgggaaggtaatttccctgggtgaacaaacagatttattattttttaaatcacctaagtttttaaaattccacattaaatttctgttgacatggtgacttatccagtaggacttccttgggcaatatactggctgctgagcaaactgctggctgctgagcaaactgctggctgctgagtgatatgcggccgttcctgagggcctggcttttaaaggcacagattcccggctccccccacgccacccagagagttcagttctgtgggtgaggcctgtgaacctgtatcttaaaaagctgcccagcttattactccaccataccatgtacacatggtctctgggccccaggctcatatggacagtaattgctgtagattctgaggaggatgtaatagtctgattgaagggtatgttttttagctgcaaagtgaagtatatagcgggttcttttcttactaaagagtgtgcctttatacagatactggacactcagagtcttatgattcctggccagagaggaagcttcaggcttgcagattctcagcacacagacagggtcctgtgcacactgatggcagagaagtgggacagaaaggctttgtcctacagtcaggactggctcccctctccccagcactggagtgtctcctttctctttacaccccacccccatagcatccttagtgggtgttgtctgctcctgtctgcagccagatgtcgtaggccaggccctctacttcaactgccaagtggctgccagggttgaccaggctgacatgggagctgggttacccaggcaaaaataatgcaccgaatactttaaaacatgtacaaaatgctgatttattattattccaattaaacctatttttaaaattcacagtttagtattaaaagcaattcactgcagctaactttatatctaaggccttcttcagctttagccctttatggggcaaactggtgaccaaaaaagaaagccttcttacaaagtggctttttttttttttttttgaggagactagctcgtttgaaaccttcgcaacacctgtcagtcccttctcactgcctaaatagccctttcctcttctgaggccagcagtctgaatttagagaagagatcaggttagatttcattaaatgcttgcttttctttcagcttgtcagtcattgcaaaagcctccaccgtttccaggttactggacagtctttttttttttgagatggagtttcactcttgttgctcaggctgttttgcagtgttgcgatctcggctccctgcggcctctgcctcccaggttcaagcgattctcctgcctcagcctcccgagtagctgggattacaggcatcagccaccatacccagttaattttttgtattttcagtagaaacagggtttcaccatgttggctaggatggtctcaaactcctaacctcaggtgattcacccgcctcggcctcctgaagtgctgggattacgggcatgagccactgcgcccagcctggacagtcttgatgggaggatgatcattgccctgttgttgctctgacagtgtgagctgtggctcaagaaggtagctttggttttactgatcataatgtggagatgcagaaactctaacacataagtgtgatgtatggtgtgacttattcctagccaaatgtaactccagtggattatttacagtttcttcttttatttccaaaaggtcataatcatcacctgatattttattttcttttatatatatatatagaattcagcattttatgtggatagtgagttattggttcgagcccttcaagagctgcctctctgcctccgactcaacgttgctgccgaactggtccaggtaaaaatcccgaagccctcttgaagcgggtggattagggcaggaggagaaaaagaggggaacacttccctcagcaggatgtctcagtgtcagcttccctttataaaagtgagggtttcatatcaaggtagcattttgtaaagtttaaaggagaatccaaaaattttttgaagttacttttttatattttatatttgaaacattttaaaggatcaaatgtagtggaattgagtgaaatgtaaaatataaagtctggctattttactcaaaatatttacgcatcacgctctatgttcggcactagggacacagtggtgaacagacagatgtcgttcctgcctttctggaacttaatctattgggaaggatgaatattaatcaaatagtcacacaaacatatacaaattgtaatacatcctgtgaagtacagtgtgcttttagagtaaatcagtttctggtgtggtgtggttaggaatggctttctgaagcagtgatagatgagctgaggtctaaagcataaggacatttgagctggcatttaaacgagaaagacccagtcagctttgcgttaataaaaacgatggggctgccaagtagagaagactgtgggattggagtgcatgtgtgggggtaagtctgcatgtgcacatacacatgcacagagcaggtgagggaggcacatggggaggctgttgtacaggtgcaggtgagtagtactgtagcttggactacagtaatgacggtggagatggcagaggagagggctgtactgaggtacttcaaaggtacaattaacaggatttgacggtatattggaaattgggagagagtggtcaagaaaaaattcaagactttgtagattgtgcaactcagtggtaggatcaggaagggtgagttttggactttatgagtttgtgcctctgagatatccaagtggaaataacagtcaactgaatgctgaactttatagttctacatcaagggctagaaatacaaattcaggagataacaggatgaagtgataattgatgaactaagagagggggaggcccaaagattatgccatgaagaacttcaacattctggcacgatcaaaaaaaaaaaaaaaagtgaaaccttgggacgtactgattttaagtagaatcctagcaactgaaattatcaacttccttctgtgggtgaatgtgatgctaagcttgagcatagtaatgaattggttacccattcatttgctgtatagcatttactagtctaaaatttgggacagcaggcagagttcagggatggaggacagttagggacagggtagagaactagaaagaattacatttgcctctgatgggggattgccctgggggttctttggaaacatttgggggtgtttgggagagcactagtggctcttctgctgatgtccagtgatgttcaaagttctgaagtgcttggcttgatctcatatgatgaggaatgtttagcagaactcaccagggaaatgctgagataaaggattcaggactcaggacagagaggaagtggttgtgagtgtttgaagtgaaggttgtaatgtcagtggcaggcattaaaggtataaaataattatgtgacattgaaatcctggctaaatcacttagaaacatttctcccccacccatgctgtagagcagtattctctaccttgtttgcacattagaatcacctggggagttaaaaacaaacaaaaacaaggccagacacccaccccagaacaattaaatgactctaagattagaatagaggaccatgtcccagctttgccctgtacaactgactgactctgctggatatttattcctgtttgtatataaagccataccgtcttacatgtctgctcaggatgtttatgtaaaaataaggggtcaggacctccagtagaggttgaacttctgaacctgcccactgtgaggccttgctcatccctggagccttccctcgagagcggtgattctcagccttagattataaccttgtattacaatcaccgggggagtttgtaacttttattaaagtataacatcgattcagaaaagtgcacatgtaagtatacatggaatgagcatccggataaagacttagaatattgtcagcacctcagaagccaccattcatacacactccacgtcactctctccccaaaaggcactcgctcacctaacttctaataccgtagcttttgaactttttacaaatacaatcatcaaatagtgtattttcttttgtgtctggcattttttaccaaggagagtcttggtgaatttgttactgcacctttatattagtgcacttaaatacaatgaacagatctgatttgctaattacttcctggtgacttttttttttttttttttttttttgagacggagtctcattctgttgcccaggctcgagtgcagtggtacaatctcagcttactgcaagctccgcctcccaggttcacgccattctcctgcctcagcctcccgagtagctgggactagacactctccaccactcctggctaatttttttgttttttgtttgtttgtttgtttgtttgtttagtagagacagggtttcaccatgttagccaggatggtctcaatctcctgacctcatgatccacccaccttggcctcccaaagtgctgggattacaggcatgagccactgcgcctggccacttcttggtgactttttatagatgttcatgtcttaatacagatttaagtgtaaagccaaatagacctatggtactggcagttttcaggccagggctaggaagacatggatcttttcattccaaatctgagctagttagcacatggtcaaggtagggagagtgggaggcacagtgctggcatgtttcagtgaggtctcccacatttaccccagatgtcaggaagggtgcccccaccagggcctggaaaggagccactttgtgaactatctgaattgagtttcctctgtcacaaagtttgatggcttcgtttagcctcctatgtatttacttaagccaatatggcaagactcacatttttaactcagtttttatacttctctttcagggtacagttcctttagaggttcctcaggtgaaaccaaagagaactgatgatggcaagggattagggatgcagttaaaggggcccttggggcctggaggaagggggcccatctttgagctgaaatctgtggctgctggctgccctgtgttgctgggcaaagacaacccaagcccgggtccttcaagggattctcagaaacccacttccccactgcagtcagcaggagaccatttggaagaagaactagatctgttgcttaatttagatgcacctataaaagagggagataacatcttaccagatcagacgtctcaggacctgaaatccaaggaagatggggaggtggtccaagaggaagaaggtatggctttcattttattccccgtgaatcttgattctggtgttttttcaagaacagccccgcccgcatcacatccgcacacatccctctgggtgtctgacattgatccagtgttgtccactgacatctatttctgtgctcacgtctctgcttccccctgagctgacctttctgacaaccttcctctcacgcgacacaccaagcttccaaagctgctacctgcctgactgcagtagaaacctggggctgcaaatggaatttccgctatcagaaggcattaggatacctgtagccttcagctttttggcagtggcccttttaatcgactgacaggccacctcttcatacctttttcttgctatttctgtcttatattttgacaaaagaacaccacattctgatttctgcatgtcctgtgagatagtggcccatctgatgtagaggggcctaaggtgattgccacatgcatgtattacatttgagatcctttaattttccaggactgctgcaataataatagtaaaaaggaaactgagctgttggtctttgaaaaaaaaaccaactagcaaggtgtgaagttcaacttcagaataaagagcaaatcctctacccagctttatttgtttagatattactgtatcatcttagggagtaagaataatgagaatgtttccccttgttgtaaggaaagtaataaattgggctgaattataccttcaattttaggactcatctgagggtgttaacattgttttttttcccccagtttgtgcaaaaccatctgtgactgaagaaaaaaacatggaacctgagcaaccaagtacctccaaaaatgttaccgaggaagagctggaagactggttggacagcatgatttcctaaaaaggggaaaaaaagtgcctgaagcaaatcttggttgccttctaacggcaggtgggcataaggctgtccttcaggaccagccagtttacaagcatgtctcaagctagtgtgttccattatgctcacagcagtaaatgcctacctctgtgtttgacatctgaaagaatacattgaagcagcttgttgcatttgtttttctggcttagtaatctaatagatttccttaagggcaggagatagactctggcccttgtttctagcctccttccttgcagtgtttacaacatagccagtgtttacagcatagcagatgctgctgctgattaagagaatagatgcaaacaaggcatgcatttggccaaaataaacaaatgctggtctgtcc

SEQ ID NO: 38525 - DNA, 115634 bp, Homo sapiens
gcagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccaggtaagccactgaaagtttttctatttattgcaacatggtttcccctttaaaagtgaccgctaaagcaggaaggccacgcagaacggcacagaagaaggctccctcagtactcaataatttaaagagagatcccagccggcccttcctacaccaccacggctgctaaaacccaactttcctctcctgctaggagtgtgtgtgtgtgtgtgtgtgtgtgtgtgtgagtgtgttttgaaacagaatttggcggtgttcatatgtcacatatggactgaatcaaaggtttaaaaatactacaaagcctttgcattacagtttttgggaattttttttccctgtcttgaagcagaacacatctcccttgagtttctccaactagccagtgaaatataaatcatttgcattccctccacttagctacattgagcaatgttaactgaagggcttgggaaagacaagagtttagttttggttttcagatgctgtagattctttggagaatgactggttatgcttcagaatcataaggctcaggctggtggagcaagttggcttgtggctgagataggggcttggggttgggtgctgctggcaaccaagacggttggtctcttctctcttcatccatgtgttgtctgggaaagtaaatcgtacgttcttttagaaattattattagctaaaacaaattgcaggccctcgaaggtctctcactcttgtgaagtggttagaaacttttgagtggaatttgttctcaaccactgccaaaaagggtgtgtggacaggctgctgtggagataagcatttcgaggcccagaacagtctggggaccgcatttgtggggagcggcaaggggtatgctctggaaaggggaatccatggggaatgcagtggggtttgtgcttccttctcggaccactctctagagtgagcctccctacccctctgagaacagtgtctggaatctaacaacaaaactcttagcagctgctacaggtgattggagatggagaaaccatctatggaggaaatgggtgaaagaaaggcgaaaaagccttcctgaagtgccctcacccaaggcacttgcaaggcgatggcggcagtggtagagctaactctgcagcctccttggcatccccagaacatcagctagtggatcctagccttgcatctggtactgtcacccttccttctcctcacgccccccaccagcacacacaccactttaagcttgggcatttatttgaggggggaagaaaattcaggaatgcctttgccacccagatccgcacgtttgcagctctttctttgccataagtggtcttcagggcagctgcaaatcctgccaaagggatgggtgggggtcccacttggggagattttctgggcctccgccgttcccccttgccttatttctaaattcccagcttgaagcggaattaaattaccactcacagacctggatgctgcgtaaattatgtatgtttgtgtgattcgctgtgtgtgtgtgcacacgcgcgcgcgccgtgaggatgcccacagtatattatgtattcagacacggactccagtaggccccagcgcgcgagcgcgcacacactggcactcacactggcgcgcacacacatgcaacttcaggttccgtgtgctgtgcggagcgggaggggtcgtgaagactcaggggccatctcctaccccagatgttcgcacatctgtccccgagcgctgcttggagtgtgtgtacgtgtgtgcgcgacacccgcttggacccactcccgctctgccacctgcctgccgcgctctctgcagaaccccctcccatcccaatccccagcagtgctgcgtcacttccagagaagcccagaggcgcggagttcggggcaacctcggacccggggtgggatctcagggtgggattcgaagctgggacctgccagggacctccagctccccaaaatgcgatctcaagccgtgagctgctcaggctttcaggcggagcaaagcactggcaccctgggagccggcagcgggtggccagggcgaggccaagccacatacctctgactcacccggtgtgcgccggccgggaagggggcctggttcagccgccgccgccggcgacgagaaccaattctgggaaggagcaagatggggcagaaggtgcgcgcgggggagcaactgagcaaataacacggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctccgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtgaagagcacgcggcgtgcggccatccacgtggtggggacgtgatagcccctcagctctcctcctagccctccctccccttccccgccccccagcgccttctctaacgccgcatcgatttgtttgggctacgcagcagaaacagagcccagcgatccataaacattctattaagcaaaaatattcccagcgaaagcaaaaccgaggctgaagcctccgcgaagttggccgcctccaactactccatgcttgtgccctcctcctcctcctcctcctaaggacacccccagggaaaagcctgcggcatttcttcaacgctgccctatgccggaaagttaggtctcggctgcagcgctggtctctggagaagcctctgcctgcagccgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttcccaccgggtcgcaggcgtccagcggctgggtggcgggcgccggtagccctagtgtttggaggtgggggagggatttggaatagacttgtcgcccctctgggaatcatctgggttggggaaccttcgggaatcagctttccagaccaagttttaggggatcttgcccatatgcgttgcggcttctgcggctccggctgaatttcttctaaaagataggagatccacgctcaggtttattggcgtgtgctccctgctcggctcccctccctccacttcctgttctttcggtttcagacagagaggagagccccctggcgctagccattcccgatcagcgcccactacgaacgtcccctttgctagagttaatcatgatctgcggggggactgggttttgctcagaaaatcattcaagtcctgacaatgggtttcttcaaatggtggcaactcccaggcctaatgtccccacctccgggacacatcgcttggggccaaaagaacccagaccccataaccatctacccctcccctcctcgtctggagagctttgatctatgcttgggttttaacgccattgccatggacacgcgcagattctcggtcaattcacccttccgtctggactggatgatcagataagaggtgtaaattggctgtgggagacaggtctgggttcagacaaatcctgaaagagaagcaatgacggtctaggcgccggataagggtttgaagtgtttcttttagcctgtctccccaaaatgtgagatggccattggcgagcataataatttgcaagtaaactgtaaactcctagattttacgcagacggcctgctctgggctctagggattggtctcatgcccacattaaatgggtacccagtaaacatttttcccccgtgatcagctcctggaggtagggaagctgtggccagttgccagcagagcacacagtgcaagacagtggcaagaggagcactccccaaagggccccgggcaggcccctactcgtccaagcggtgcctggtggaattgtgaatgcgccagtgcacatcaggtttggagttttatgtcatcccatagagccctcagacattaagctacggagcactcaactggcaaaatgaaagattggaaggctgcagtgactggaacccaggctacccagacaggactcctgctgtctaccaaatggctctgatcccctgctgttgaatgtatcaagtccacgttctgcagcagaaaggccagttcctatcttccaggcatagaaaaagctaggaatccaaatgccaattcatatgcagtgaggcacgaatacaaatgacagtgagggaggggtctggggtcagtgaggagagacaccagggaccagatgattctggggaccctggtgtttttcatttcactcaagtcttccctaaagcaatcaggaaaatgaactgactcaggatgacctgagtgtaagacaattctgagttgacagaattcaagagccaggtaaagaggtttccaaatatattctccaaaggtccagtttggaaagactttaggaacttgagctgagatcttcctttcttaaaagatagagcaaaagaagaatatctttttaatttcttgaactgacaagaaaggacttgaaaagtgtcatctgggcaatggcttgtagtgttattaacatatttgaggtattttattatctgaccatcacttgcaactggataatctttgagataccttccttgagtggcagataagtatattgatcaccagaagttagtctttgtactgttccttccaggtaaggacttggctgtttgctgatttttgttttttaattaacccatttctggaagatgctgcagaagtttgtcctggagagctacagtatttttcaaagctttatctgccttgatgagaaatggtcagaggcttaatggtttcattgcctaacaggattcagtggagtaggattccaggacacagtggccttgtatcatggctggccctccaggagaaagcatcttctaaaggtttaggaagctgtcaagtttagataaggctgagctccgatcctctgggaccttggttgtattaataaggagaaattaatttttaaccactgggaacattgccaaattatgtgacctttggcagaccagctgtgctataaaaataaatcccccatttctgaaaatgctactcctatccagtagaacaataacaatgtggcatttaggatagagaagagtaggattgagaagaaaggagagaaataggagttggcaaaaaacaaaaaaacaaaacaaaacaaaaaaaacaaaaaaacccttcgatgttgtgatacatggtttcagacctgaacttcctatccatcacccgccctccccggccccatgcctagggtttccagaacacaggaaagagggccaggatgacaaggagctgagtgcctgtgtgtacagggagtggagaaggtgttaagtgcttccagcccactcacaccccagcctcaaacacatctctcattgttcacacagacagagtactggcacaggcagagaaaagggggttttcaaacaggcaaaatatttgtctttccctaaatgctaccaagtaggtttgccactgagaagttttgtggggatcatccctggccttcccagcttctgaaacatgggaactagactgcctgggtttagaatctagctcagccacttgctggctctgtgatcccagtatcctgtgtgatcagatacttagtctatgtgcctcggtttccttgtctgtaaatgtgtttggtaacaatacctacttcatagggttgttgggctatgtcagattatgtagaatactgtttggcacatatgaagcccattctgaagtcactgaatctttaaaactgtttcagtggggttagtggaatctcgtgatcgtagaaagcacactataaccattgtggtaagttgatttttatgagatttaaaaaataattcttattctcagttcttccaccaccaaacctctgtgttttgtaagcaccatattatctctcgccatgctcttcttcagagaatattctctgctgagttcttatcttagatttatgtctcccttgcattttttccctccttcttcctctgttttcagtattcttacctcctattttctttttaatctctcatttcctttccttttcctccccttccatccttcaacactgagagtgtgctcagcagggaacaccgtgtttaaggcgctctcccgaatgtgtaataacttctactctggcactaaggcccttcagcagctgaactcaaaaaagtcatcataaagacaaaatagcttttacccagcaagggtcttaataatcccatttccctctgggtcttcataaaggagtcattatctaatccagaaaaaaaggaggggctgggaataacaaaagagaagctctcggtagcacagagtgcacgaggctgccggccagctgagtgcacgtggccgtggtaccctgctcccgcctccacaaatcctgcgataaccagtaaccagttctggcgagtctttcagcagagaagataatgggaattgcaaattactagaccgaatgctaataataattgtttggatacaggagaaaaaataaaacagatgttccccaaaggcattctaggggctacagaaaggaaaatgaggagggggttgagtaaagagaggtttgctgaaaccaagcacaagaaaatccaataccaacaaatggcttagtgatgaagtaatagtcagcatcttcctggtggtacagataaccaatatttaaagttgcctttggaagtgtgggggttggagtgaaggggacaaaacccctgagataaattaattttactagtattaaaaataaaatggccgagcatggtggctcatgcctgtaatcccagcactttgggaggaggaggtgggcagatcacctgaggtcaggagttcgagaccagcctggccaacatagcaagaccccatccctgctaaaaatacacacacacacacacacacacacacacacacacacacacacacacacacaatagctgggtatggtggtgggcgcctataatcccagctacttgggaggctaaggcaggaaaatcgcttaaacttgggaggcggaggttgcagtgggccgagattgtgccactgcactctagcctgggtgacagagtgagactctgtctcaaaaaataaaataaaataaaataaaatgtgaatgtgctttgaaatttatcattattatctgctttagggtgttctaggagacatagttcgcactaactctaccttgacctacttgtgactaggtattattatcccagacaagttattcaaactctcaattcaccactaagaaacatttgcacttaataacagctgggggtggggagggaagcgcagtagctgtggccgcagaataatttctgatagaactctcagagtctgtcctatctagtgatacctttgatgttcctttggtcacttcttaattggttaattcaccaaatcttgatgagtctgacttttgggaaaggttctggtttgatcctgtaagacttgccaaagatggatcagcaaggagtcatgacctcaagttgctggtggctcagtagactggatgaggccctccagaactctcacacatctcagaagatgctaaagagcttcagcctctcagatgcacagaggagaaagaccactcccagtatgggagaggagaaagggcagaggcagcctggagtgagagagtaggtgggatttagagcagggaagggcataccaggggaaggggaaggtgtgagtagagaaatggatgctgggttggtttggggaacactcagaagctgcagtttagaatgtatggtgggaaataattgcaaacaagattataaataatagcttgggctcaattcaaggcccaaattgctaggcaaagaggtttgggtttcacttgctaaccaatggggagccattaatgtttcaacataagcttcagttaatcaaaataaatgaagacaatattatattacttttttttctcctttggtttttggagagacctcaaaattattcttctgtttccttccccaaatgtctcctaaaatggtcaggaattgtaatcccagatctctcatcaatggcatcaaaattgcatttgcaatgagggctggaaaagagaggacataaatataaactaatgacattatatcggctgccctattggaattgcatttgtttatgatataagatgacaaataataaggttaacacaggtggcatgattcgaggtcaggagaggtaatcgcatcaaacttacattttaccgattaaatgaggcttcatttttagaatctagattgaggggagagatgttcaaaaggccccatttccagacccaatttccagttctctcctaagtgaattcattggaggtgttttaagagagggaatttgcttcattctttattcatttccaaactcatatgctggcttcctctcctgctctctgcttccctctctccttccctcctagatggcccttttattcagattttgaactttatcatttcaaaagttcagaaggatttccatttgctgtgccttcaggagtgcatcattcactgccaccagtctccataaattgagtagattgcatcccttcccagttgccttaggaagtggtcaaacagccacattcctgggctgatggattggctcatttcttcccagcttaagccaagatacagattttatgagactgtcttgtgacaggctgaagttgctttgaataaaacaaaatccagcctcagctcacagaaataattcttaaaacgcagcttatcccgggttggtgagcaaaatttggttaaaaccctgagccaacgacttagatgatctgggtgagggatttgaagaaactccttttggtttttcttttcatgcatcactgttgttgacatgctcacacacagaactgtgtatccataatatttataaatatgcagccacagactcagttacaaaaagaaactcgtgttagtagacctgatgtgattaaaggagacatttgaactctccgtaatgcaagacagacatgttttctgaagaatcctggagtttggtttcaggcttaccaagcagatagaacaggggtagcaccttgagtaaatgtcttattgtctaggagggtagagaatcttttgaattcttggctcaatctgtgggttataagatctattccccacctcactacatgggctttggattttagcactggaactgacctttagaatcacccctctcattctatagatgagaaaacaaaggctcagagttgtctactagcttacccaaggtcacacagcttgctagtggtgagactagacttgattactaggcttttaaatcctgctccaatgctatttctaataaacttcctggtggagtaagtggcaaggtgacaacctcctttctttttaagtagaagaaagagtttcttctttgccttgctaccaataattaaatgaaaacaatgctgtggaaatagggacaaagtgggattatgctgtagataagaaataaattataaagtagataaagtatattattttcagaggaaatgagaccgattgcttttctccactaagtgccctcaggtatacataggaaatagatgtctcctagtcatctgctctttctcttttccatagcattttaaagtaacagggaatggagatgccccatttagagggtttcaaaccatgttccaggaagccccagtggacttgcagagaagcccttctgagctgagggcaggaactaggaggcctggacactacaatgcttctggctacctccctcccagcatccaagaagagctcccttttatgttctttgtacatgggaggtctaggtagagttttgttcaagaaaaaaaaaaagtacttcaaaaaaagcaaataaatttgaaagctacacacctaattcagtccattctttgaattacagtttgtgaagctgagccccagaaaggtcaaattgagtgagttaagagttgggtgccatctcccatctttctgctaatgtcgatccctccctttcctggtaacccagtcccatcaccccagactcaccttttacaacaactgggccctctaatcccacattcagccaatggccaagtttccctggtttcgccaaggactttttccttcagttcaactaaagcgagggatctgattggtcttttaccaagctgtcgtgaagtaagctatagtaatcagattatctgctacagtcaggcttcagtatttagcaaatattattgtcaagttcaggttatccagtgttcctttaaaacaatgccaactacatttttctagaaggcagaccagatttttaaaagatcttcttttcccattcttaatacttcttaaaaattaaatattcgcaaggaaagtgattgggttctgtaggaaggtgagttcctaagtgaaggggtacaacatccctttgccttttcagggctatgttacccctaggcagaggcagatggtacttagactaccagcaaaacaacaatacttaagaaggagaaaaagagcaagacagaaagagtttaaaacaatctgatattttacatttcaaataaaaacacctaagtagtacttataagaggaaaatcagaacttggtgacttcagaacttagtgttctctttatttccaattacatctggagctgtcactttattcctttcagccttgggcctttctcagacctgacctggctcatccctcagccttccctcccaggtataggagaaaatgctctaacagtccaagcctggattttgctatctctcttcgggtgatgaatttgccccaggtgaaaggtattcacaaaatagttgcagaatgaagtcttttgtcaactcacccagcgggctcagtagctcaaacagggtcaatttcccctctgtacatggagattggccttaagggttttgcccttgagttcaactctcctttggcttagcttgactcctctgaaacagaacagcaaccatgtataaagttcattgtggaacacaataaagacctacaaagtaatggatggtatagctcttcagaagaaattttagctaatttctattgggacatgtttgtatttaggaaatgatgtgtccccaaccctagaaaggaaagatcagttatcaagaggagaagtagaatgattaagtgtgttttctttacaatttttactgatatgtttcaagaattctgttctctccaagaaaaataaaaacagaaattctagtatttatctttgtggatatatgtttgtgcaaatgatgtgtgatattttatgagaaggtgtgaacgtatgtataggactaaagtgtgaattactgatatgtatatgtacttgaagtatgttcaatatctatgtttgtgtgtgtttctgggtgtgaatgcaagccaaacaagaatgtgaatttataaatttgtaagtattgaaaaggttaccaacacacaactgaagcagatgttctaatgagttctctgatacttcaataactgccctgattttctccaggtaaagaaaggatagaaaaaaagcaatggatgactcctttttcttttggtttaacagcagacagtacagactatcagctatgggatatatatatagtttaatttttttgtgtggtggtggtgaagaaatgatcacttctgctgtagatgagaaattaaaccttcctgcgaagaagtttcctgtctttattgctgatctgtgtgcctggtctaattactaaaagtttaaacctggggtgtggggaattgagggagaaaagttcccctttcaagagtaattggagagaagtagaggaagggatggggaaaggagggagagagtgtgggtagggagagtggagagtatgtggaaaccataacagttactaaacaggagctcagctcaggtttcctctgacgaattccaaggcaaaaaagtgtggtttggggtgagttggtggcagggctgcagttttctgcaaaatatctggcagaggagctggacccggtagaaaattcccccttctgctagttgagtaagagcagctggtgatctatgtcctcacacctctgccttctcagaggaccactccaccctatttcatgtgcataagccaggaccaacgggcctcaatttggctggctagatgacattaggttcccagcatgggtgagtggtgtgggcacctggaaagcctatgggtattggctgcagaggagctgggcctcatggctggcctcatgtggtctgggtgggagggatgagctcattgtcttcatgggctggggtgggtgcagggtcattaggtaagaagatgatgtgctgtgtaccagcctgaggaaacggctgcttttgttttccacccagtaggaaatggacctgaattcattccattctgggcagttcaatacggcacagtttgagctcgtggaggcttgatgccgaaaaggctacttgtgtggatttgtgtcccaaccacccgtgtgcagcgtgcccatcttttatgcatttaaagcctgtcaggccggtagtctaaagcagaggtctgggagatagtaatgccaacagacatggggaatagtaaagtgcacctgtagagttaaaaaatgcatgacctgttccctcaaagagtgaacacaggagaaagacccatcctggagggcggctgctgagtcgtaatacataattcacgggcccatgctgctccatgcagatggcgatattaaatcgtgattgatgctaagagacacacacatctcaggaaggtctccgagaggcttctgaatatttccatgtctcatgtgccttcccagcttctgttctactgtggtatttaagcaaaactccctatttcccaagaatccctgctggggattgcagaactttactcccgaatagatgagattcctcaaatgtcatcacccacctttggagcctttgaaggtggctcccttccctcccaggccacatgaagctgtctgcctccagccaggcactgcaggtacagggagccagcccttcctgcaaacggccagttatggctggacaaagcagcagcacactctggtggtggtgaccaggcaggagggacagtgggcagacagcgcagaagaaacagatgttcattcaacacaaagcacctttgtcgaaattccaaggctagagccagtagattctctaatacagatttttccattcggtgtataatgaaataataaatcaaatttgtggtatatatggaattaaatgtttggggggtttgcattttttttcttaaaaaaaaatttaaaaaggctgcaatcaccctccagggcctgttctggcccaaagctgaaagtgcttcctctgcaccacatgtaattgttaccaggctcgcttgtgggtcggcaccacaaaaccaccattgtcagttcccagagccctgactgctggctgcctgggctgggctgggagacaccgaataaaatgaaggatttatgagataaagatagagataggaggttgaatgaggagaggaagatgggccaaggaggggaggcaggaaaggcagggaggcatgttgagtttgcagtcctcttgtttttttaatcacagaccatgtaattgagaatatttatggccatgttctggaatactttcatctgtgtgtgtgtgtgtgtgtgtgtgtgtgtgtgtagttgggtgggtagggggagggatgagccggaataatctcttccaccgaatgagtaagtaggttagtcttctggactgccataaaaggtctgtaaaatagttttaatcagacactggtacagaagagaaggagggagtgtggggggaagaaagttgtaacatatttgaagttctttgggtcgttgatttctctttcagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtaagcaccgtcctgtcccactgtgtatcccatccatgagatgcacacgccctgcccccacccctgctcttgtcacttctatcacccctcaccccaagacctgctgctaaccagtggtggatcctggccccagaggaaaacctcaaggggcattccctttccagggaaataaaggtgtggctgatcccacagtatggtggaaagagccttcttgagtgaaaagtagagaatattaacctacctccaaaggccggtagtggaggagaatttccatgtggtggcaggggctggactacaaaactctactcttgactttgggttaccttgcacttggagatctccccatttccacagctgctacatgtataaaccccacccacttccttaataagatagtagctgtatccccaagtggagacttccctcgcatccagccacgcaggatcagcctgttaccttatatagcggtaactggttttcttatagaaaaaaaaaagggtaaaaaaaaaaaaaatctaagtagttctaagattcacattggttcttgatagctgtgctacacaagtagagtctcaaagtcagtgtcatggatttatttaacaaacactcttctaattgcattacaaatattaatccatttactttgcacagtgggccctgggaagttagtgccattatgatctccattttgcaaaagagagaaaaccgaagcacagagaggttaggtcagtcacccaaggtgactcagctggtcttacaacattggttctgccaccctggaaatgtgtggcttaggaactcccaagtggacatttagacacttgggagtactttagaaatgccatgttactaccgaggtccctaaaagttaaggttgggaagcaggcagcatgtctagaatgcagatgtgctttaagctgtctactgagctccatcttaaagtcttttctcattggaaataaagtgagagtttttgtgcagaaaagaatgtgccaacagtcatattctgccccaaatgagcgcctacggaatgctgttactctgataagtattcagtgctcccatgtgattcataaattgtctaagcattccttgctattaagcaaggaattgcaaatactgaaaaattaataagggggccagctggcaggacaggtaccaaggagaaggcaaaactcctacaggccaggtctgggccagcacttcctcatggaggaaacaaggcccctctttaactagtgctagactgtgaggctcagtgaattgatgtcattattatccccctagggctaatttgcacctacataatggttttctcctaacaagaggtagcctttgttgaaaaccaaagggtttcccggatgaatgcctcatgtgacgaagagtcataagatgaagtttctaatcccagatccactcttgactcaacggatgacatagggaaactcatcagttcctctttgtctaagttacatgagtaccctggatacatttgctcagcatcccaaggcttctgattccctgacagtgaactttatcaaagatttctgttagaagagcttctttataaggtgttttgggctctgattcctctggctggactgcagaaggttggcacaaatggaagcataatgtacagagagagcctgggtctaagctcagagaaatttgactaagcacctttctctactaagggccaaattctgttatgcttatgacagcaaatctcccaaggaaattgccaagaggtcatcctatgttgtattcatagtggcagagggagaaagcatggcttttggaaggaaaaacttaggagctagtaagcatggcttaaaacatgttgggaaggacgaaaggccagaaaggccctgctttgggttgcagggtaccccttccatggacaggactcagtcccagagatggggagaactgaaggttgccagagactctgacaaggggaagaagaaggcattgccccttgctggaggtggagtaggggaagccagcaatttacagggttatcttctggcttatcatcctcgctaaatcacttcctgtttttctccccattccatgacctcatgtgtctggtttgaacctaaaaagtgaaggaggtcagaaaaaaatctttctggggtctgtttctcccagtgccaaactgtcagagaggctctgttgggattaagcctcatccacttaaccttgtcattaattctctgttcctccccccatttctcccccactccccatttctctctctttctctctctcattaatttttgtatttagaaagactcatctggttttctcagcctctcactcttcaaggtatttttgacatttcccctggccatttgcatttgccataaatgggcttcccctccccactgccttgttttactttcttgtgaaaggaacaattaatctaattgaagtcctggaagttctgtcttgttccggctctccctctctcttccatactgcattttcgttccaagggagctcctgggtttggaaagcactcactctccaaggaaattagcctgctttctccttttattttgggtgcatgcttcaaattggatttggctctgcaggcccataaggtggatacttcccaaaagaaaactgcctgggctggtcttccgatcacagagcacagcagcaatgccccagcaaaaaggggaactgagcaagaaagtcaggagaagcagccaactcagctgtggagacagagcagtggtcagcacacccaacctcgtgtttgcccgggttcttcctacgtgcagggttaactgcaaagattgccccaaagcctggaaacagggccctgatatgaaagaatttatcctgggctgtggcccctgggcccttggctccctgtataccttgaactctacatcccaaaggttgagacggttgctgagtaaaccccagatagaccttttcccctaaccgttgcttattaactttgttccattgaagcttgctgtctgcttggaaaatttcactcacaagccgcagctttgcctgactcagtgcaatccaaggccaccatctctggtgaacttcccttgactcctccctccagccacttgcagaaatgcaaatcctgggcacccacaggctgtttgggggcctgtatagaagctgtgggcagaaaccagaggccactgtggtactgctggactcctgcagccaaaggacaaaagggcgagactacgggccgtctgggcaaacagagagaagccactttattccctgtggagtggaggatgctaggatgttgctgctccggcagacagaggcctttcgcttgagtcatcagccaacagactgaatgttatggttttagaaacccatacacaaagttgagtggttttttccatttctaaaatttaaaatgtatgtatttttaaaacacccacctgcatgtaatacacagcttgttcaggagttctcaaacagccccagcacccaccccatcccagaggctcaaccaaataaaaccaaaaccaggaggctgggtccttttaagcactggtaatttctacctgtaattccagccctttgggaggccgaggcaggcaggtcacctgaggtcaggagttcgagaccagcctggtcaacatggtgaaaccccgtctctactaaaaatacaaaaaaaattagccaagcttggtggtgcgtgcctgtaatctcagctactctggaggctgaggcaggagaatcacttgaacctgggaggcagaggctgcagtgagctgagattgtgccactgcactccggcctgggtgaaagagtgagactctgtctcaaaaaaaaaaaaaaaagaattggtaatttctagatgggtaccttgatgggtctcagaaagagcaaaacccactagcaagaaatgaaagaacatttcttaggctaaaatcctcaaggaagtctacataaatgattgtatgtgctatgttcagcccagcaatatctcatataccacgtatcattgaagaatgacattccatttaggtgaagtgtccagatactgaaatatccacctttaaagttcttaaaagagaactttaaagagttccaagagttcttttttaaaggatttctgataaagaacattctaaatcatgtgctgcacttccctgtctttttaaaacctacattgagaggagtcaactttttctcaatgattcaggcttttaattctaagcttcacttttgtgacagcagccagtattgccataattggaacaggcagattaagatttgaatttttattgaccttttaaacttcccaggcctcagtttcctcatctgcaaagctgtcataataataaatatcttgcaagattgctctgcctttttatgtagatgcccaataagttagcaactgtgttagcatcattggactttgtcaggggacagtttgggactattttctatcaatcctcctgctttcacacatcctgttacgagtatgcctgtctcctgtagccttcccattctgacttgtttttgcttttttatggggttatcaattttgcttcaggagcccttgctgtctcttgggaagtttgagttctgggacctaagctttgctcaagccagtgcaatcccaaggccagcatttccagttggcttcagccagccaagcttgcagcagagttaggactggggagtgatccccaagtgacaaagcgtaagagcaacagaggatggagttctcaacatcagtgtagctgctcacaatctttttttctgaactcccccacaccgttatattctgcatatttaaggttttggatatttgcctctaagtgtcctagataaacaaggtgctcttgtgtttatttacagccagaggggccctctatatcttagaagatatgtctgtttctcccaaagtaagagatgatatcttagaaaggtagcagtttcccagttgataacctgatcatagtaaacagagagatcagaccagaccttagtcatctggcccctccccattcagccagcagtgtttccctgtgctcagtaaacaccctcgattccctgcaaacaaccaagcatagtcttgcatctgcatgagccccctgagttcccagggctccagccctcctttccctccctccacagtgtccagctgcaagctcccatcttcctcccctgagtttccttgcttcctgcagttcccttttatcaccctttcctctgaactcccagagcacttgatgttgcctgagtcccttgctttttgttcatatgtggtcatcttgagttctcagcaagtaaattctacaagggcacaaagcatgtacttcatatctaaactcccatggcgcctagtctaggagggtgctaggcaggtgtgtgcaggtgatttcgtgatattttttacattggaaatgccaggcaataggtcagcatgagctgaatctgtgttggaaggcagacagatctgtgttccctatttgtccctctgggaatatgacataatcttagggggtaggacacaggccaagaatgtcactaactgatttgggacatgagtctctcaccaacaaaatggtaatagaccattcattcattcatcaggaaatagctattaaacacctactatgtgctaagcacgttggtattattgggaatacagtgatgaataaatcatattcttttccctaaagtcactgttactctttccattttacagatgaagaaacttgggctcaaagaagttaagcaactggcccaaggttctactcccataagtggcagagaagggttttgaagccagataccctagttttcaatctctgctttactcttgtgctgtctgcctccccggcatcatgcatttggcaggggacatgatatggacctgttacgtgggcccacagcatccaggtccagcctaagctgggaagatcaaggaaggctccctggaggaggtgacgcctatacgaattctaaagaatttggccaggcagcagggagtgtgtttggctggtgtcataggcagacagcagcatgcccaaagacaagaaggagggagggtttgatgccttcaggaaccaaaataattgaacatgcctgaacccaatttcttaaccagtgagcattgtaagggtagactaaaaggggctgtccttgtgacttgctgacacaaacccttttcccggtgaagaggtgcctgagcaatactatttaattgtatttcctggccagacaacttccaccatctccttaggagacagggtggtcaggaagcaggaaagactaagatgatggggactctctgctgtccccaccttccctgtccattgtagggtctctgcagcctcataccctatgtccagcgacctcccccaccccgccgccagtggaatgcctgaaagtggggtttggcctgggaaagtccaggtaacacttcagattaagctcctcttgtcaatttcctgctacacaagactttctgaatccaagtctctttcctatgaatagagggcgggaggccagattgcccagttggaggtgtggcttcagctggtctccgttgaagtctgaaaagccaacaaagcatagtgagaattctgtgtggttcaagagggtgccttgtgcttgttgaggagaggccgttggcttgatcactcacgacactattactgacgttattatttactgcctgcccaaccacagaaatattctgattcccctaaggagccagtgagcagtaataattttctgtattgcaacaatcctcctaatgacagaaacagatccacctccaggtacgtggtggacgaatgggagcagctggctgctggccccacacttaccaaccttgaccacagggtccacccagcaactccacctcacccatggatcagggggaaaaacaactcacagactgttctcctcttaccaaggttaaaacgcagctggaattactttgggcagtttgtttttaaaaatgagtgttgcaattgtaactgtctcaatgcaagcttcgctgtagatgcccttcttaacaatatgctttatcttctgactgagaaaatcacttgagatgttatcatgcacaatcccacttgttctgcctctccaccctggcaccttctccgaacccagagatcccagagggccagcatctcaccccatgtaactccatgtaattctcccatctaattacaccggctgagagtctgtcttaagaaattcagtgggagctccaggtgtggaggggataaagaagagatggaaatataccaagtgaaaacatcagatttttctaaaaagggatttgtgtattttcctggagtcatgagtcctatagaaaaaaatttatattctttttgttttgtcctttttactggcaagggatttaagcctttggattaagagaaactcaaaagataatttaattccattcttatacttctgcctggataaataattccagaaaaaaaaaaaaaagatatcagctgcccttgtctttccttccagaaaagagcttctgtaatcgtccttcattatgggacatcgtgcctcacaactcatctcagttgattgcagagtagatggttgtatttaatttacataatcaaaatttttttcctagaaggagaatccctgaaaaatgttagctgggtcaaaataaaattttctaaaaagaagaaggaaaaggaaaaggagaaagaaatgtgagttgggcttaggtttgggagggcagcagaaaagcatgactttttttatgcctcttttcgagctttgtagccaagcatcttggcagtctctaatatttttctactttttcccactggggactcaactgtatgtttgtgggtcacgtggaggaactctcaaaattagacaacaatagcaaacatttattgaactcttgccagacatcaggtcctaccctaagttttctatgtttaaccgccacagctggtactggtactactattatcccatttaacagatgtagatactgaggccctgagagatcacacagatagtaatcgtggggctgggtttgaagccaggcagcccaaagctgcctttgtatacctgtgtcaatctgcttggagctgtcatctgctgtcccagtgcttaggtatttggggcctctctgatttctttagatatccttgacaagccttttcttttccttttctctttttattccttttctttgcctcttcctgccatgcagtcacctccggatgccagcggggcagtcaaggagagagatctctttctgtgtctttaaatacaagccagaggcctctcagtccatcgtctctctctgcctccctgtcacctacctcctactcccccaatccccccacagccccgctcaccatcctcttcaaattccctgccatcctcaccaccaccttcactctccatctggagtccaaagatgtgagggccagtaatagagtgtcagcggaagtaattgattcctcacaccgagagaattcgcctgcctttagtgtcaatggagctgaaccagagtcttggagggtgagcgagacatgtaaacagtccgtggccgagctgtcaggacgaagccagacacaccggagagtgaacgaggggggaaatggtggaacaaataattgttttattggaaaggaaaggaataaataatatttcagcccaggaactggcagtttgaaagagatggttgagagcttggagcagaaggattcgtgatgcaggttttaatggaagagattttctttgtctcaaagtaggaggtttcgtccccacccgacccccctctcccattatcatcattattatcattaaaataattactgtaacaattacagttgatgagacctcaggtttatacagcacctttcatctaaaagttcaaagcgatttatctatgtgtcatcttttgagagtggtaggagggtaagaaactattattttggggggtcatctgctgggaaactgaggtccaagcagatacaagatttagtccaagcctcagggcaggctgctgggttaaatggtggggtactgagttatcttcttgggggccttttctgctgtactcttcactgcctgggcctttatacacacgtggctcttgaagctcatccccggcactgatgcctcctcccacactgccagggcctccactggtcgctacaatattgtggccaaccagccagaagctctgtgcgcaaaacaaacagcctgcttctggctgtgagatgaataaagatccttcaaggtctgactcacacagctcccatcctgcttagagacttcctgtaatctggttccctttcttgtagaagctcatgtcctttctaaacatctttcttcatggtcttatgaggctctagccaggagcacccaacattcctaaatgcttgcttcttccacccccaacaaaccccaacctgttctctcagaatggaaagggcatttctgggatggggagagaaggtgaatgctttaacatgcctcacatggcccgggctgcctgtgcagcatgatgcttcagaatgcagctgtcgaaagcatagtcacaaacggaagcggttccagctgactggcccctgagtgctagattcagaatctccgccctggcgtggcagcagccctttcctgcttggacattagtgcaggcccatcatttccacaccatggtgttttttgcacagtagtgacaagtttgcccctggagccaggagaagctccaagctctgtaatctgaagctccaagtaaatgaactctaaaagggaggcccatcacacctgccacctactcccaaactgtcccctacttggatttctgcatggcacgtttttcagatgagttttgcatcttccaagttttgttagggaggctggatgccagcaaagaggaatagaaaaatgatatggagcctaaatccctggaaaaacaaaaaggacttttctgttgctgtggtggattccctggtgcccagtacacttccgttcccagcaggctcccgttttttggacagacggggaagttatgatttgccctcacaattggatcccctgggagccagaattagtgtgaacacctattccggagggaactgttcaccctgccgagtaaaggggcactgccagcacaccaggggccccagacgctgtgctctgattgcccttcagtgaccacccatgcaggcagccccaccgggcacaaaggcatgattcctgttcccttttgtcaaatgaggccaactgaggcacacaagcatgattgatccaggccagcgtaggaaaatttagtaagtcctggccctgctgggattcacctttacacctgctagtgctgctgctgccgctgagaaaaacagaaatggaaagaaattgtggactactcttcctttgcactctggtatcattccagaatgctaccaaggggccctttaagttgactgcagagggtgaggattttatagacacagagcagaccaacgaaagacccaacactcatgctgaaagcagcctgcccccaaagccttaaacttcacattggcaccggttgcctagaaaaccattccttacataagcaaacatgtttcatccaagtggcctccagtgtgtgtgctggtccagaagcagagcagacccgtgaccacacggcctcaggaatgcgccttgctggccagccaggtcagcgagggaaatggtattcacccaaaggaccagtgcagaagttggggaggctttgttgcgtgcccttaattctctgaaagttcaccttcagagagacttatcagatgcgttgtctggagtggcctccttcctcacgtcaggaggcattcttggcagcctgctccatgaggaacaatgagattggcggggccctcaccatcatcgcagggcctttgcggaaaaagagccagcaattataaatagatgttatttgtcgtttccattttcttgccttcaaggttttttggaataattccttcagtttgttttgggttattctctccgtgtacttcctttggtgggtggtcagacttcctcctttctgaagagccatggtgaccctggttgtgaggggattgtggataagaagctcaaaatatcagcgatttgtggtgggaagaaatgaaggaagaaaatacaactgcaaacagccactattaaaaaggcgcttggtactgatgcagatacccaaacaaatacagagtttggtaactgtttgagcccttggcgttaaatagcaaacaagaataacagcagcagtaacaacaaatggctattcatggagcatgtactgtgtgccatacactgtgctgacccattgatatgcattaactcaccagcctcttgggagcttgagcaccttgctatctaagacagcagatggaggacgggtggttttgaacatagcctgggctcagaaacacaagtttgaaataaaatctcgaaaactcaagtgtctgaaacactgttgatggatttgtgcagggggatgattttttagaaacccagccccaagaagcagggtattgagactgcctctaactgtgcttttcgtttcatcttctcctgtctggctcccaaggtgtcatgtgtgtgtaactcttctcttctccacatccaccatcctgttttgttttatgctggtaataataaaaatagccaggggctctcaggtgcttccttaaggcatctggcactgtgctgggcctgcatgtaccttcgcaatcctgccaccacccgcaaaggtggagactgttattatgtccattttgtagatgatgaaactgaaactcagagaggttaaataccttgtctgtaatcacaccatgagcaagtgccagaaagtaactgggtctgtccacaaagcccacatgctacacttcccaggttacacaacaccctcttaggtatgtttccgttaacagtaatttaacgtttcttttgtcacagaccttttccctagaaaaatgtgcctactcacaaacacaaaatttcggcaaacaaagatagagcttccccaacccacttacacttgtgtgtaggccctaggagaaatccccgcatttaagaatatgtgctctagatgataacttaagagcttataaatatatgggatgctgctttctcactccatgggccatatgttcacatatggatatatatgtgcttataaaaatactccacttacaaaaattaatatgttatcccatctgaactcttacaagctagatttctgctgggtgagtcttgaaatcatggattccaaatccgctcacttttcctgttggtgatttgtctattaattttggtaagtccttcagccttgtttaaacagaacaactcaaaagagcaagattctgttaagtctcttacatatcttacacccattttgtggaaacctaactgaggccctaaggattctttacacctggtacctgctaatgctattgtgctatggcaatccggtattttcattgccctcagatcttcctcccacaaggagacaaagggaggaagggaaggtctctgtgccctggagtttgactacttgggttcaatgcctgtctctgacctttcctcctcatgtaaccttgggcaggtcacttaactgctctgagcctcgatgtctgcatctgcaaatggatggtaattgtaacagggcctggtttggatgaaatgaggattaaatgaaataatatctgaatcaatggcctggcccatagtaaatgctcaataaaatgtgaacagtttgcagatataccagctttttagtaaatgggtggtacagatgcaaggcagaaattcaaggaaatgaaatttactttaaaaagtctgacctgacagtgagctgacttctccataaaggctaggtgactgtactgagcctaaggagcaggtggcctggcttcaggcctgaaccgaccagagacctcagcattgtgcagatctgccttgcagcctttttagacatcgtgcagcttctttgttgggaagttgtatgtgacagtgctgttttttttcctcctaatttcctcacaggttttaatgtaaggattaataagacagtgtttgtagatgtctttgagcctcctggaagaaaggcactccaggaggtgataaattctctggcctggataatctactcatgaaatatggaactttgaaagtgtgagaaaaatctcaaatcactttgacagcattttaattatagttgatttgtttgccgctaatagtgaaaatgctgtcagcatgatttgagatgtttcttccactcaaaatgttatatttcatgtttttgagtcacaaggcaacattttggttttcagatacaaccagaatagctcagtaaatgtgttggggcacaaagacagagagtataaaatggatcaaactccacggaaagcatcatcgtagcacgcattcttctcaacatggaacaccagcctgaagtcccttattcatttacatttatttactcaacaaaaagtgaatgagacctcctacatgccaggcaccagggaagtgtcgtaaattcagcagtgaagaggcaaggtccttgccttcatggtgcttattgtctggtgcaggagacagatcataaacaaataggtatattgacaagacctttccagattataatcatagctatgaaagaagtaagatgatggtgagatagagaataagggcatgccatctgaaatagggtggtgacagcaggcttctctgtggaggtaacatttgtccttaagcctgaaggatgagcaacaaccagccctggaaagcaccaatgaggagtactgcaggcagaggaaagagcgcttgcaaaggccctggggttggaaagagctcaccatatacaaaatgtcttcaacatcttatgatcttatgatgagcagtgtgaaaggaggccttgcttggttggcaaaggttatgatgtcaggacttgggcagagatgttctgatacgtagacccaaaagaaggggcagagtattcttcctccgaagacctaagtactctatcttcgatacagaaatccccttccaagtggttctgtgtggcatccctaaagctggattctgacaagggccagacatttcggtgccctgagagaaggacctaagcttggtgaatcttccagcacaggctccgttgactaacccagcctttggtgccctgctgggaagtgtcaagcgtggagacagttatggaaactagaaagccctttttcatgtttgcctagtgatgagaggaagagatgagattgttgctttttcatatctctcccgtggactcttaaaattaacttcactgtcaaaatttcccatggcccaaatgtaggtttggggagagaaatgtaagactttgaagttgagaaagaaagtagagaaagcattctctagacaaatgctcaccatgcagacttcagaatctgtgaggagacaaataaaaaggcactcggggaaccgttttagagagaaaataaagaactgggagtagagatggctacttcagctcaggaaaaaaataaataaaacaatacaaggtagtgttaaagctttgaaaggaatttttcgtttaggagagattatggataatgaaatgcaaacactctagttaatatgtctgttagctggtttatgttgccttctggaaaacgagtgatacgttctaagaggagcagcttttcaagttatcctacttgactatcgttggggtgagctctgagtctgtaccccggattcctttaccaaacactggatattagacactagatgcaaagccgtatttattccaaagccagaaacttcctaagcctctgcctaactcttcacaaatgaacctgacaacactgaaatttctaaggagatttactccagctgtagcaaatccctcataataaaaaatttccccaaatgagtcagtcacacaggaggtaaatgagacattctgtatgaagtcagcatgtcatttggagtgtgccctttatataaaaggcccagccagaagaccatgtggttaagtggggcttgtccacagggcagaaccagaagactggaagttggggggatttcagctgccgaactgtaactctgtgtcacttcccctcaagcaaaccttatagaaaaatctagtttttctaagaagttcaagtaaggtttgttgattatttgcttcacaaaaggattcagcagaggggtcctttaactaacaagctcagagaaaaaatttatagtatgattgaattatatgaagctttttcaaaaatgcatcccttctctatatgtgtgttagatacataaggatgtatttgttgcaggcagcattacaagaagggatttggggtggtctgtatccgttgagtaaattgaggcaagcttgtaacagtggcatttgttgggcagccctgcttcattgctgattctgttaatcccctaaatgactccatgggtgattaggcaaccagataaaaccctctcacttctgatgaacaagccagtgggatggcagggcctctctttgtccttcctagagaaattggcaacacaaagactggaactatctggtgaagctttaaaaaaaaagtttaaaaaattatttattgaatgtgggtcatgtccttggcactgttccagatgtcccgacctactgtgtctcatttattcctcactccagttctgtgacatggatgatgatggtgatgatgatgaacttccttctacatctgctaaatcatgacagctggattcttttacaaagaagagagaaaaaattaccaattatcctaccacccatgtctgtcgccattgttcatattttagtagtctttcagacttcctctgtatgtttatgtgaggaaatgtatgtataccttttaaaacatacttttaaaaaatctcctttttaaaaagttaacagtatagcgtgaacatttttccataaaaacaaaaaattctagacctgcagactattgattgtagcaggagagtattccattttataaatatcccagatggattcaccctccctctacggttgggctttgaaaccatttataagcaaaatatcctcccactttttatattttttcaaaatatatgcacaaagatgcatatgcatctttgcacaattgtctgattattttcttaggaaaaattcctagcagtaggattgctggattaaaggctatgtacatattaacttctgtcacatttcaccaaaatgcctttcagaatgtttgaacagatttccattcccgctgatactacacctctgctcatttgttccatttctgaaaacagggtcgcttctgctctgtggctcagcctccttgcctgtgaaatgggtgtgaaaatacaacaaatcacagttcacatttacttagcactcactgagtgccagactatggactaacactttagatagattagattttgtcatttaagtcccacatcaaccctaggagaagactgtaatatccctactttactctttttctccccatttctgaggctcagaaaggttcagtaacttgcctgaggtcacccagctaaaaagtggccaagctggggtgcaagcccagctctgtctgcttctgggattgggactcttgcgctctgggccatgcatttcttagtccagatgagttgtctgattaatgaacatgggtagcagagcctctcaacctttgtgcacattgccagggcatcaccattgctcacaggaatgtgtctgtccagcagtgcttgccttagtgtgaaaatagcacggaggggttttctggaaggtttgggagtttcccctgagaacaaatgaagcgtctttttacttttgttttggaaatgaggaagcatgttttcaaagtcagcaccatctcccacactgaaaccacagacctaaacagattccccaacctcacggtcttctcaatctgtgaccatctctccatttctccctgggggttgaaactgccattttgacttctccagactctaaggagcttcagcggttctttttggactgtgggagtccagccctgtggggtctaagaatgaattaatcctggcccactccttagacttcctttacaggcctattatttgaaagtggctaagtaacatagctcctgggggctgaagtgaggcctcaggcctccccagctcacaccagccactccttccggcagccggcaaccccagatccttgtatgtgacaggatcctttggcaggcacatcccacagaagggtgcattcccagccctctccttacccgcaaggaagagatttcttaagtgttgctttaacaggttgatgcaaaataaataaacagaaagggagggagagggagatggatggttttcagtaaataatggtgcagcggccagcagttggaagggagctggtgggaggaagtttcccacctaagcagttgtgacaggagtattaactgggagcccaaaagcagcacaaacgcagcacagtgaggactgccagagcacataccggggctggaaaatgtgtgtctgtcaagataaaatggtgcattatgtttgcaccttcccatgaacggagccaagggtatctttgaggtgcctgcttcccagccctggccagtttgactctgcttcaaatgagcacaggcctccacttcaggagggcagcctgccctgcctctcactgaggctaatagttgtgtgcacgtagacagtgggcccctggagactcacccctgcttttggagaaaggtttttatcgccttatctaacatgaggctgattccttttaagaacacatgttgactagacactgctgatgggaacctcgcagagtcatcttagggaggcggtggcccacgggtggggagtctttgtcactaacaattaaagaagggatggcccaggggaaaattgaaacagggggctggagggagatgggaaaataaacaaatgtctctgaaacatcccccgtgtgcctggcacagtgcctagccccttacatatatattttttttcattctatcttctccccagccttgtggagtggatatttttatcctcatcttacagatgaagaaattgatgctcaaaggggttcagcagcttgcaatgtcacagagctaagaaggagagactaagattctgagagagcataatggaaataaaaatggtgctattgaaggaagaaaaaaatgtgttttgtgatatttgatagaacgatgctcctgctcttacgtgggcaagagataaggccttccagccatgtgtttattcactctgtggctttcacaaagcacaacgacctgcagtatctctgtttgccagtctgtacaagcagacataagtgcccttcgcttatccatctgaaacaccttaacttctgcaaatgaatagagagacataagtgggagcgacacagtggtccttctcatgtccttcgagtgatcttttcttgtctgtgccatccccacccaggtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggtcagtgtggtcacacgtaggggccgggagatgggcgtcttagagaagaaggagggacagcacccagtgggctgaggcactgggtaagggtgacagtgtcatccagcttgagcatggtgagaggttcaaggtgaacccacaaacatcatgagaagaagagccagctcagattatccaccagcttaagggggcgggctgtgggcgggggggtgggggtggggtcaaaacagccattgtttgtggtattagacaaacagaaaaacacttcttgaaagaattggatttttgtatgttttttaaaatcaaaataatcttcatgggaaaaagcaaaactctgatgactttctcacgattacttcatggtctaatgatgtctttatttggaactacatggggctgaggacataatcttttcattgtttggagtctctaaagatcttgccatgacctcccaaatggggtcacaccatagcttttaaattaaaataaggttcctagaaattccccttggcagtccatgttaccacctctgtccattgaacccctactctctaaatgccaatgaacttgactccctgaaaagcaatcaaaaaatagcagaaaaagagtcagagggcactgcacttgctttaagttgactgcttgatttccatcaggtcccccttagattactttagggcctgagaatatgggccagtgctcatttccaaaactaaatacagcagacttttattcacaagaccccgcttcatcagctacactcaagctctcccagtggtgtgtcctcttctgtgatgtgtggagcttgttatctcgaggctaagggaagcatgtcctccagtcctccccacccaccacccactcccttcctcagaggctccccttccatctatgtgtgtgtctcccctctccccccagcagcccaagttttacaactcgtggatggagtctggttcgaggggaggttgtcagccttgtcatcaagaggcccaagaccggcgcctgttgagttcagtgtgaggggaactattcatatatattttctttttcactaaacagctcttgaaaggaagtggtagctgctgaaagcactttttatatccactctgtctaaatatttgtcggatttgtctgcccgagaacaagaacgtggaatcaaatgaaggggtggggcaaggggactgtgtcatgcaagagtggcagcccaggctgctgcagggcacaggtcccaagaaggtttctctgccttgggttttcatgctcctgactatgatgaggtcacaggggctgacaatctgtgtgtccagtggctcaagctgttgtgaggcccctgaatagcttgatccatattcccctgagtcttgtgcaaaattcagatcaatgccaccagcaccagtggagcatcctctgctgccgagcagtggggagaataaaagagaaagaaataaaaggggatgcttgctctcttcgggttggagaggcaggtgtgcaaaccctttgcacgtaacagattcgcaggtgatgttattggatgagtatgtatgtaaattgaaaggaaaactatgatatgaggcagaatgaataagtgcaaagtaaaggtacaattgacatgtggtggttatgaaaatgggggagcagtcaagtggcttagcaatcgaggggctccagagaatctattcaatagcaaggtccctagtgctaatgctgccactcggctgcactgtgctggccatgaaaggaaaacagctccaagcaagatcttccaggaagctggccaagggaagtcagaacaagggtgagcagggccatgaaaactcagccttggtctcacaccacccaacttagtatttcacaaggcatcatgctacattctccagaaagccacaggaaaagtcaatgttcactctatccatcatgcaaatttgaaaggaggatattaaaagataaaacatgtaagagggtatcataattcaatatcgctgtcttgaggacatgctgaagcaggatttcaaatgaagcaacaagtctgtgaactgcctagaaacaatggtgccagccaacggagctaggtggcttcagcttggagaaatggggtggcctgctttaaggattggggttgcctagtgaagagattgtaagagaaagccctgccaacaacagccacactcctggcaatgtaagagagcagatgagagcccatagacttctcagggccactcgtacctgccgtcatacccacctgctgctggaagagcaactgtccgcatgacagtcagtcttatatatgccgggcgcagtggctcacacctgtaatcccagcactttgggaggttgtggcaggcggatcacctgaggtcaggagtttgacaccagcctggccaacatggcgaaacctggtctctactgaaaatacaaaacttagccgggcatggtggcacgtgcctgtaatcccagctacttgggaggctgaggcaggagaatcacttgaacccagaaggaggaggtggcagtgagccgagatcatgccattgcactccagcctggacgacaagagcgaaattccatctcaaaaaaaaaaaaaagtcaaccttgtataaagtgcagaaatgtgcaagggagcaaaattcaaaacagagaagtttagaaaaatgagcattcatgcaggtgccttgtcctatacccacatttccattgttggagtcaggagagaaaatatacaaagtttacgtcatccacagaacatgaaagaaatgggtggacatgctgaagaaatccaaacaaacacagctatgtttgctagtcggattcatagagaggaagaagcgggggaaactgtaaacacagatacgcaaatagccatacagagggctctagaagccttcgatggtacattaccctggtgaggctctgctgtaggacccacagtgtgagtgcagaccagggcatgtggctggcgtggaaggttcatgtctgccctaagtgaagtggtgtataaaagattctatatgttaccagactgtctacatttaaaagggtaagccagaacaacttacatacttaaaagatctcaaatcaagataccatgagcagaacagaaacaaaaaaaaaaaaaaggaatttttaaacgtaaaatgtcacattgaaaacaaaatcagtggaaaatgtgtgtgtgtgtgtgtttggttttttccagaagctcctttaaccataagttcaagattaggttttctttcctgtttgcctgtgacacttcagaaactgacatttttggggtcattcacagaggtagagaaaactcggagtgcctactgcctccacttcctgaattcaggaactgaattcaccttctgcggggaaggcaaactcagctttgggtaaatccactgtgttttaaatgtcttgatacctatagattcttctacttgcagagttattgtaaaattcacagcggaaaaacagagtggacatttttcatagcagagtcttttcctatgaaatcattcgctgcaacccaaatcccccagcttctgtagacaatcttagccttgagtgggcttgagtatttgttgacttgagttcttcgtttaacctttaaaccttctaacacatctcagaaaaggatcttggataaggcagatgtctgcaagagccagccagcttctgcctccttttctgagatctcttcctggcatctgctattcagctgcttttgtgatgctgcaaacagtgagatggtacgattagagatgaatgcatgatgttaacagacaggttttatttttctgcataaaaatagataaaactggacaaaagtttttccaccgccttcaaaataagccaaaggatatacccatttatagccatatatcagaaatgcttttttctttctttttttttttttttttttttgccttaagtacctaaggttgaagtttcttttcagtcaaatgcaggagctcaggaccctgggaactatggatactttcaaatttcacattctccaagcctctcttagactcactagatgtccatcgtggaagcacttgtgccctaccaatgacaggaaccaaagaaagattccgccagaaaattccccactcccaggggggtggacattccccttgccttctaagggaatgacaatagagcaagctctaagagggcatgtcaggatgctctttctagctctcaagcaagaagtgaatagagagttaatttcctcacaaccatgtgtgaggctcagctgagtggcccgcatgaagaatgctgcacagcagccataaactctaaccttttcaaaattcctcttggccccctgaagacccgccagctggcttggctttgctgaattgcctcatcccgggccattgaggaggccctcaggagtccgaagcccaatcataaacaaagctgggggaggcagccccagctcatccctccaggactagctgcccattgaaaactcggcctgacctgctgctgccatgcatatgaatgatggggtgcagagcctctgagattcgctgcttagagcctccacagaacccatgcaaaggttagcccttgccctcgtgtgttcctagtccctaccctgccaaagcacagcacaaggtggaaagtaggaagtgatggatggataggtaggagatactggaattttctgtctggtgctgaagaaagttgcaactcctccatccgcatttatttgcatggcacttcttccaaatcagacatttgcctctttccagaatgctgtcatcaataaagagactcaatgagaggccccctacaggagctgcggataaaggcatcgctgcaggctcagatcagtgtattgacatcacctagttatatttcagtgtgagccccagaggacacttcctgacagtaaacacccagtttatcgagtatttctggttggttgtgttttttatgcttagagtgtctattatcctcctcaaaaatcctgcttccttttcttcttttaaaatctgaacataacgagtgaaatcaattctaattgtccagcactttcattcattgcgtgaatgtgcatgagctcgtgcttcgtgggtccatgggtctgggttgcagtgctcccgggacccatctgtggtgctgccctggcaaatggtggctggttaaagcacaaggacccttttaatatgactccacctagaggcattaagagatagggtggctgtaatcctcttatgagctcctgttcctgctcctgctgccatccaagctcgcaccaggatgcgaatgtgtgccgcatttaatcaggatgcctccatgcgtcccaagaaagcagacgcaagagctcaggagagaaacaaggccatccacaccacaaaggagccagaagccttccaaatgtcaatgcactgctgcatttttccaaacttgttgccggagcggcctttaacatccccaacggcctgctgtgatccaccagctaaaaacatcgattgttaattgtccgaccactacagagcagctcgttttaatatagtcatgacatgaatgagacccaagctcccctttgcccctcccctgaggcaccttggatcttggagggagaagggggcacttcgttggctgtggtacaataggggctagtgttgaggtcagcaacaaataaggggtaacattgttttccctgctggcaatcagcaaggcttccttaaggattgaaataacttacatttctggagtgagcagctgagtaattgagaaagaagactctgttcctcttttcaagagaatccctctctctctctctctctctctctcatacacacacacacacacacacacacacacacacacacacacttctctgtacctccaccccactccccaattcctcaattgctgctctcactctaataattatgtagagcaagccagctgtgcctccctaatttatgagggcttgaaacgtgcatgtgaagagtatgttgcttcaagggccactccagtagcaacaaaaacctcaagagcagggggatttggggccaaacatttaaataacccatgtgacagaggccacaaagaaaggcatcttcttcttagtgctacagttctcttttacatacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatggtgagtgatgtcatgaggcattcctcagtagcttggcctttgcctgttaattgctttagtgatgataaagaggaagaacaaagacttcaaagctcctatgagttcttatatgacccatggtgactttctcttcttccccttcactaaggatagcttgagagaaattacaggaaggctgtctactttcttggaaatatttctttagaaaaggataggagactaaatagatacttggaaaggatgagaaaacttaaagtgttcatttctactccaaattgtcaggatagaaggtggctcagtggctaacccctgtgacaaaacagaaggactccagagccagactggccgggcttaactcccggctctgctactccccagctgtgcaaccttagacaaatcccttaccctatctgtgccttatctgtgttaagttagctgctatcatcatcattattactataattttaaaattgtcattaatatagtcataaatattgaaaaggtacatcacccaaggctaacagccaccagtacttcgcaggtgaagaccaacatggatcttgggtctaattagtattggagaggaacaaatctttcacttttgtagtcattgtaagttttttctaatataaaggagacttgatgactaagcaaaaagagcaatttcatttcctgggtaaatcacaagacttagtcagaaaacttgggttgtaggcccagctctgctatttcctagcagtaagaataaagaaatcacatgcgctctccaaacttcagtttcttcctctgtagaacagacattgtaatgatacctttccagctcatcttccaggccactgagaacagaatgaagccagtgaaagtggcctgtacctttttaatgaaaaagtgaaagtgctttttgatgtgcaggaaaaatattagccattgttcttgaaacatatctttggtttttatggcaagatgtacaaagtgtgctccactgaatgaaatgcaatgaggggaagggaaaacggagtgaaaaccaagtttgacattttgatttccactgacttctctttgtcttgaatgtccagttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagagtgagttggccgattgggaacctctgtcctgtccttccgtcagggctgtgagggtgtacaggtgaaggggggctgagctcttatgagggaggagatgggaactctacggaatttatggtggcatctgagtttagaggtgcccacatcctcttgccaggaagaggttgatgagaaaagaacacatttcaatctgggtgcttctttctttaaaaaatatatatatgtgtgtaacaagaattagttattttcagggaaagtcatggtaccatctcatacctcagtttcctcatctatgaatgaaagagaggctagttaggatgatctatacagggcccctcctgtgctaacatttttttagtctgtggccatttttttccctctcaaaatctcaggggcaattgtcacaaaagtgaaccattttaaacctctctttctctggattttttgacattaaccatctctgggcctgggtaatgttttcctgactagattggtacaactgcttagacttggacttcacccttccaccaaagatagtttgtggagcttctagtatgtgccaggcaccaagcaaggaattaaaaactatcactctgatcacagctgctgtgggacctgcagtccctcagcactgagcaacatcttcaaatcagctgctcttggacatgtgtttcaaatatgctgccatttctacttaaaaacccaaacgataacttttttttttttttttttttttttttgagacagagtctctctctgttgcccaggctggagtgcagtggctcaatctcactcttcccagtgcaacctccacctcccgggtttaagcaattctcgtgtctcagcctcccgagtagctggaactacaggcatgcgccaccatgcccagctaatttttgtatttttagcagaggtggggtttcaccatgttggctagactggtctcgaactcctgccctcaagtgatctgcctgccttggcctccccaaatgctgggattataggtgtgagccaccatgtccagccccacataactttaaagactgaagaagcacttttaagaaagattcaagctgtggaaatcctaccctgattgcagacaactcaccatatatataactacagacacggcagcctggcctgcaggaaggttgctgggttttgcatttgttttttcatcaaagagcttctgaagattgagtgacaaagaaacagtatggcaaattgcaccaggtcccgtgaatggtcagtgcagtcacagagtaaagaataggttgatacctgataaggattgctggccgatcttagacacatgcacacacacatatcgatcagtgttgatggcattcatagaaggacagcaatgcaactgacagcacagggccagagtaagtgacttctgggtctatttgtccagacaggtggtgcgggggaatagagagtgacatgcatgtgctcatggagagatttcccaaagacaagtatttatgctttgtaatgtctgtcttctgtgccagaactcacaagacagttgagtgaaaaaagaaagaagcaaaagtgcctcctgggtgtttattaataaagcaggcttcccacgatgtatgagctcacccaaatcgccacgagtctatctcacatttacctgtattgcagtaatggtgcatctggcatctgtagcctgcagcaataacagttcttgtgctttagattgtatttttaatctgtatgatgattctcttatttatccatagcctgatttcttttaggtcccatttagtttctctcagacccagaggggttgtcaagctccatgacttgatgtagttgtttttaaaatgtgagcatataattagggtcttttaaatgaggaagtgcctgcaaggacttgtccctagaagggaggcagcatttgggggatcccgaggtatgaggttggaaggcctaactgcatttgaccgtctgctttccccagactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtacttgtgcagataccagaggatgtgagagtgtgtatgtattgctggggtaggagggtagctcctcaaatacagtaggcagaggacacaaagaaaataaacacagcatacctgagaactccattcattcattcatccaaacagatgtgtatgccaggcactgggttacatgctggcatacactgatcagagggagcctgcccctgcccttgtggggattactgggcctggggagaagttgtttggccaggatgctgtttgccctatcactatagatatccaaggaacattatataagctgtttggatcttcctcattcttggcacagggaggcatcagggacatggggggcattctcctaaggggaggtttgttgaggtgctagctgcacatgacagcttctcatgatctttgctattggagagagccctgccaggaaggttttgcacagagctatcagaagaacacataggaaaatgtcactaccaggaacagaactcaaggtgccccagatgctcggcagcatctcttcagaccattgtttgctttattctgaataaaccttgcagctcatgttgagtaatcttcccgcactgcacactgctccaattctcatcccctgggaagaagtaaacagggggaaagcaagctactagttccacaccagagcagtgactgcttttatgacacacgtaagacagccttgtgacccactgacaagcctgtcctagctctgaggcgacacagtgacctctgctctaagaaggatattgcaaagcagacaacaggaaagggagaaacaccacttagaaactccagggagtccacagaggttctaacagtaagccctggggccatttgtcattgtctcttctctctgcctctccaaaaatccatctcctcgcagcctgcaaaacttccagaaagttctgtataactggcatcccctatctttgaccttaatcatatactttcgcctattgctatccacctgtttctcatacgtgtagacagcactatgtactacttattcaaatgtttagtaatgctgagcacattgtaggtcaccaataagtgcttactgaattgaatttagccagtgtgtgctagctacattttggtcatatggagactgccattaagaaacaccatggccatcaaaggaatgacatccagcaatttccaaatgggtttggcattgtgggaggggaagtaccttaaaatgttggccatcctcctcatagagcaaaaggtcaggactcggtgcataagcctaattgcttgggcagactctacatgccctttgaccccttagtgacctgagcaactaaatacacaatggagcgagagggtgtggggaggggatgcctctatgagtgtgacttttggaactagggcattataagtgagttggattgaactggacaggagtagagtggagtagattcaaccttgtttctttaaagcagcatctgcttccacagtccaaggcaggccatcatttactaagaagggattatagctctagatgttcaatgattgagaaaaatcgagtattgtcccttcatatttgcaaaagagagaaaaaagaaaaataacctaacttttcaaggtgtctgatttagtgtaagataatgtgagtttaatcgtccaatggaattgcaaactgatactaattacaagtatgtctcagtgaatcacagatacaggttggaagcaaagtctaatgattgtgtcctttggaaaaaaacaagacactgccctgtgttgggaatggtggtctcttactccagccctctattccccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtaaatccatgatcctaccttaaaggcacattggaccagggcaggagggatgggatcaggggagctttaagccgacctcctacaggagagagggccttgtgtagtcaggctcagataattgatggaggcaagggtcgtgctggccttgaaaatcttctctcttaggctaaagcgattggaaaacaccgtttctctgacagccagttgctgttgcatcttgcgcagcagagagagagagcttgcagagtgttctctgacttcaaatgaaggagaaaatatgtccccagtccacttctccccacccaggattcactgaacatttatggcctgagtcccttccacatgctgggttaacaatcacaaaaccacatgatactatagttcaggagttaccgagctctggaaatgaaagggcacaaatcctgagagggaatcacaatgtcctggagaagaaaaaggacaataaataatgaggagaaattcagtttgttggggatgggctctgaactggcaatcatgcttagcggcgaggcattgaattctctctgctggtgcctcccgcatctgcggctcccggaggtgtggtctgtgtgggtgatgtggggcttttgttgtatacatatggatgaatgtctggcactccactttcttaagacatgacattctgggtctgcagctggcacaggcgatgtgctggctctatgtgtatatacacagcacactcagcccatgggggcttattgcaaacagccaggggcttgtgtgggtaggattggggtatctgtgatgggaacacagggcacgatgccccctgcagagcaggagctggtgcagaggtctggaaggagagtgtgatgtctgggggattcctaggggctgcctgtccttccctaaaaaggaggtagggagggaggaagagggtctctcctgtagcattacagttccaccaagccctggtctgtcagagtgtgaattatcaaaatggggcacatgtggccaagcctagggaggccaaagatcttttccaaagggaatctcctcagcccctgtcactgccccgaggcagcttgctctgactggtgcagctggaaacctcagacccagaaaattctgaactgtgatgttggcagtctcacttgggaaacgggaaaaggagtagatttttaaaaaatcaaaatcaccatagtaacggggtaccactcatctgaaaaccatggcttctggatattaccaggtatctcacacacatgcacacaattgcccgatttccacgataaggaaagtgaggtacttagcaattgaaagatgtgccaggccaggtctggtttcccactgacttggtttcagaaagacttaccaagcatccgttgggaatgcccagcctgaattggcactgggtgccaggagcttgggggctgagacctggttccaccccacccttttcaattataaaccggtagatctcggaagctcagctagcagacgagggccagaagccaggcaggggtggtccccggggagaggagtggggctcacctgattgtctccctgtccaggcgcaatgactaagcagcacaggcccagagggatactgtagcataagctgttttaaaagcatgcagatggaccaggatgctatttaaaacatcatttgtaggaaatctgcttttggaaataccttagcactgcacattttcatagaatgctgtcctccctggctttatccctggtattcattcttcaggaaagatattcctgaaattgaatttagctttctggttttcagaattatttttctcaactttttcataatggatatattctctctcttttgcctcctctttccccacttggctagatttagttccccagcagccaaggggtaacttgagagtttttttgtttttgtttttgtttttgttttactgaattagtcgtgcccaaataaatggagttggggcagaggaaaagcccattctcttccccattagaaattcatcctttgtgtacttagaaggaggcaggaaaatggagagcctgccaattaggcatcgccccactctccaagctccttcaccccactgcgggtgtggtggacgcccaggggctttccttgtctcccctgcaaggatggtctcagctgccccttcattagcagatctttcgttcagatatctgtatttaatgtgcagattccccctcattcacggtgcgtcagcgcagctctctgggctgttggggttgaagtagttgagtgaaccgtgccaaatagatttgtcaagtctgccgcagtttgatttgatgccatggggggaggtgggggttggggagggacttgggggcagtggaggaagaggcttcgtccatgccgagtgccaccactgagtttctctttgtagctgctggatggtgggcactgtgccaagctaactggtgctaagtggtgggcttgaaagtgaaattcagacaacaggagttagcagaaaagcaaagcagagatgaaggcaaccgcctgctctgctctgctctgctcagagcagagggaaggtttgcaaatgccttcccggtgtgcagggaaggaagagggaatagtgacatttgggacagaaatgtgggaactcgatttcaactccctggtcactgtcaacagcaatgcagcataccaaagaccagggaattggggaagtcagagaaaaacaagtttaatgagtgctcaaggtggcgggggagggctgtcctatgtctttgcaaaacactgtttacaatgtggacccagacggggctgaggcaaggcctaggcctctgaaagaatgccttcctttttactgccagtgggtgagaaagactaaggaactcttttccagcctcccctagccaggcagcagcctgttcttggtctcttcccatccaacaggtcatcatgaggtcgcctatgagaaagtggtcagtcacactgttgctggggcattgcaagcctcctcctggcaaacgcagcctggttacacaggccacatgcacagcacatcccaaatctttatccaattccacatgccataaatatggaacctatgattctcatacagggtgggcccgccttatgtatatttatggcataaccacaaggcagagagctcatctgcctgatggaatccatatccaacccacgtgctcctttagattatacaaattgctttgcatacatttcttcagaaaccacaagcagaaattactgcttttggtttccccagctatattaataacaccctagatgcagacatggcattgttaatacaacagtagaaggttcatgtatgtttacataattataggcacaattatgtacatacataccaagaagggcgcatggagagcaatgggaagagctcagaggcacaaggtcttggtctagttcctgccctcctgagatgctgattccatgattctgcactggggataggctgtgcctcgggaatggaaccacagctggtgacaggacacgggggagagagactactgcccttatttgtctaggcaaaagcccttatcttcagttccctctcattcggtaaacgtggggatctcccttgttgacacagctctagttagtcacagtgtttctgggctattctgatgcatttggaagaaatttgggctaaaagagaaagtctgtggggtgccaaatgcacgctattggccagatcgaggatggatgggtgaagatagggatgaggtaagacttgggtccaagaattttcagaattaccccaccaggagtggaaggaatgcactgagttcatcacattaatgtaaggatgacctccaagggactcagaaaatcctcaggcaccagcttattcactagagtatttcacagagtttcacaactgtggaattgaagctcttagagattaagtgccttgctgcagggactaggaaactggagcctgcatggacggcgcctggtcaccagacttggatgtccagactggcgctctccacaatccgccctaggccttactcttcatcttgagggaaattggcttcctacatgttcagtccaaggactgagaggtacacattttcctggaaagcctcctcttcagtgaagttctgcatgcaggatgagcctgtacatggcttaacccactaggctcattattgtggagctgggcttcaccacagaatcatgaggatggagagttgaaaggagttgccatttgtttgatttggccacatcccttcaaaacaaataaacactccacttcaaaaatcctctatcccatatttattttctaaattaaaacaaatcatttttaaatcagagacttgggaggagagaaagagtggtgtcagaaaaccaaaccctcaaatcagttggctaacagctagaggcacgtgatgtctattttcagatcttcttaaacagggcaccgtgtgatcttggaaacatctcttagtggctgcacgcctcagcgtttccacccagtccaaatggaatggcgctgcggctgctatcggcaaagcaccttgagatctgtagatggaaggctctccgcggatataattaatggagtagacccacaaagctcttcttgagcagaagcaagttatcaatttaaaaagtaagaaggccccatgggatatttatgggcctcttttaaaatcataggcctggaatggaccatgataagtcatccagacctttccctgcatctgatggggcctgcattgagctgcctcagataaatgtcatccatcccagcctcactgttctcttagggatgcaattatgcttctacttgatcatttaagttttcaggaaaaaccttttttttaaaaaaacctcctggcagatgatgggcttccccttattccttttgtggtagtaattttgtttgttgaatatgagatgaggacaatacctcacactgtaatgggcaccagccttcagaagtcatgttgcgtgtgctctgaagggggctgataccccttccaagttcaagtccctcagtttatctgaccctctcaattataatggagaaggatccagtgccctaggtaattaagtttgtcccttatccatttgccatgggatgagctcagacctttagcctctccacttaggaagctcaggggaaaatttcattatacagaagcttgaaccttttctctatcaggctcccgcggccagcgtcacccagctcccgtgggtgctgaactgtctccagtagctgaggcgcgcctccctggcgctgatagccttgatgttaaactccaaggccccggctgtgcacagaggccagtgacaaggagcacacagaggggatgtggaagggcgctgtgattctgcttgggctgtggaatcatgttccttgccccaaccccaactaatgtagatgagcactggagtgaagccctcacctggtagattgtcctgctctctgatgtcaccttgtccctgctccggtttgcagagcctccacctgaagaggcaggcaggtggcagaggtctctggaacctcactccctgttccctcaatctctccccacctgggagttaaaggcacctccttaagaaaacccaaacatctgtgttaggaggtttccaggggtggagggcccaccccacccagctagaatgtcctagaatgtccgagtttctccttccctcttcctaggacattgactgttccccccaagcccgctcattgctctgatcctgtgctcctcccccgcctgctcttctccagccccacccctgagctgccctcctccccgctcctccctgatgcgttcctgtctcaaatcctgaaaccctaatcctgttagtatgctgtgttccaggcctcagcgtctcgatgggggtaacataatcccgcagtaaatctagcgggccccgcaggcccacacagatggggatgcgcacatccccgccccccagaacgcagccgcccctgtgcctctgtctcctccttcatgtaggaaagctgcctgatgacaaaaacagcccgaaagtaaaggaggatgagagcagaggtcatcagagtcctaaatgtgcatttggttgttagacagcttctttgcctaccggcatccctaccttctcttaatctctctctgtgtttatatatatatatatatacatatatctatgtaaagtatacacgtgcacacacacacacacacatgcctctaactctatatctggctaagttcccacatccactagaatgaaacaagctttaaaacaagtttttaaattgtctttaaaggggagttttaaaggagaaagatcaggaccatgattcacaaacaacaaaaaaagcccattgccttcatatcatttcccaccgcccccccccaccccgcatcgcaacagttccctccccctacttgactgttttgtgcaacaaattaattaaacaggatggcattcattgattagcaatttatttttacgtgtagacccaatggctggtttcagagcagatgcaagggaagggggtgggagagggaggacacacagatctgcagtcagggtgagcggatgagtcagcacatttgttcctgacactagttttaaaaacatgcttctggcttcccccagcctctgtcctgcattcctgccacttttctcttctgcctgctttgttttcccccttcttgagtgtctgtgccaagtacattgaaagggagaactttggaggcaatgaaacatttattagtggagagaaatatttattttaaaaaagaagaggaacatctcgtgcacaatgtctaccccagggctccagcactgcgctgtcttggaaatatttccctgctttctttgcagtccctggagctggctgacttcagatatttacagcaaaatagaagtaaacagtagttcacaccataggtaatgaagagatgggagtgtgcaagctgagtgctgaagcgctactcacatgagaggtggtgcacgtgaagagagactgtttttgtaccccaaagggcccgcctcatttgggaagggtgaaacagccagccgtgtctctcctccaaggagctcaaagacttggacagaatcttcatcttaggccccagaggcaggcatgatgacaggtagcatctacactgtcctgggcacatgggtattgatagcaaagatgaatggtatataagaaaaggctttaggctgggcagaaaaattcctctgcctagaggcctagaaggtaggaaggctgcaaagctcactgtcctcagctatgtcagtcactgcatattcttcaaagacaacttaaggaggggtcagcaaagaagaggtgactgtgactagaaatggggtgggaagcagagaaaatgttctgagatggcctcagaaaccatcagtaatgcgttctggctggatgcttcttattagattttatatatatatataattatatatataatgtatattatagaatatattctatataatatatagaatgaatatattctataatatatattacattgaattatattgtccatgccttgtggactcacaggaatggtcaaaatgcactgattttctttgcctgggagtgtagataacaaccaaactgggatgctggatagcagctgatttaattggcaggtcccccactcccctagaggtgcaaatcagaaaatccaggaaatgctgatggttttcaggttctgggctactgaaaacaaatcagaggtctcaagaatcaattgaaaaatgctggattatattcagaattcagagaggcacccaatagattatccagaccactttgtgccctgaatcgctttttaaacttggtttgcagagatgcacttgaagaaatctttatgttcaacttagctctttttaaatacgcacacacatatatttttaataattacaacataatcaacactagcatcagaaagctagggtcaccttgaacatacttgtgattttcctttgggtagtaaacaaccatactaagatctttcttttaaaacaaataaaaagtgggccaggcatggtggctcacacctgtaatcccagcactttgagaggtcaaggcaggtgtatcacttgaggtcaggagttcaagaccagcctggccaacgtggtgaaaccctgtctctactaaaaatataaaaattagccaggcttggtggcgcatacctgtaatcccagctactagggaggctgaggcaggagaattgcttgaaaccgggaggcagaggttgcagtgagccaagattgtgccactgcactccagcctgggtgacagagcaaaaccccatctcaaaaataaataaattaaattaaataaataaaaaatatatgtcctctgtgacatccagcttctaaagcagatgttaacattcctatctgagtataacatacaaggcaacccaccgatttttctcagatacctcactgcaaagttgtcatctgaaaattgttggcctgaaggtgggacttgggagtagtcgtggcttttggaacttaaactctcccacctgtgcaaagacccacttgttacttgtgacctggcttacacgctaacatttgtcctgggtgctatgcaagccttggagggagggccagtaaacttaagtgtctatctgcaagcctattatcgactttattttcctgaaggagaaaccaaggtatctaaggtttattgatttgcctataatgattcagtgagttgtcagggaatagggaataaaaccaatttcctggcgtcatttcccatgcacacaaccccttaccttgcaatgcctagactggaagccaagaatccatctcagtgaatttgatcagaaaacatatgaagggtgattctaaaaccacagaagcattgagaaagtcataaagatgtataatatatgatagcatttactagctataaataggggagatgcagggagaaaaatagagaccttgtaaaaccattgggtcaggataaatagaaactgcttaatatttcattaaaaatggattttcataaattgcactttgatatctttgggcaaaagacaatatgtaaggactaaggcgttgttattcattactctttgttattaataatttgaactggtattgaaccaacacatcaacaaggtatagtcgccctgtgaatggggcactccccatgtgttctgggcactattcaaagtgtataaaaagtccacagccaccgtctgcaaaagcacttaggctgtaagggacaacgggtaactaaagtgccctgttgcaaaatggacactgttagagcagttcaaaccacaaaaagtcatgcgaagaaaggtttagaagcaggggaccagagagaaccctacaaatcaactcatacaatcccctcatttaacagaggaggaaattggggcccgagggaggtagagatatttgcccacacttatgagctaattagccgcagagcacagctcctggcttctgattcagtagtgttttgtgtgtgtgtgttgtttttcccactataccacactcagagtgagaggtgtgttaaaaaatctaataagatggtgttccttcaccatccaaagaacagaaggcagatgtgaacacaaagtcaagagcagacaagaaaacagttcaggaactaggcttggaaacgtgaagggtaatttgaagctaagttgaaaagatccttcatttgattcaagggtgggagaagagtgggcaaaatgaaagggcagactgaagttcaattgaagcagtcaggtagatggcctaggggacacaaactgtgtgcttgcctcccttcctgagtggtgctactgtaagcagagattagggggttcacccagagcctgtggccacatgtatccatgggaagactgaccccctccctcagctcatacatgcgagtgcgtgcagcccatgcccatgtgagccacactcatgcacacaccgccatcccaaagacagtccaaatacacaatcatttactcattgaggaaagaaaaggtctcttagcgttgcctgccaaggctgagaaatgcaggggtcggataagataaaattggatattaacaacacataagacatgctgtgtttctaaacggtaccagcgtggtgtgtatgctgtggattagcggcagtgttaaagttcagatccactcaactttccaattatgcattcacgtgacaagtaaagcttttttcacccaatgtgaactccttagcgtctcctgatggcgaccacacacacagtccccatcaccatcttcagagagcaagccagtggaggcccccctgctgctgctcacaacacccatccgaaataagcaaagtgctgcatttgcttcttcctttccaaaacaaaacaaagcaaagcaaaacaaaacaaaacagaaagcctctgcctcatgctgaattctcagagaactgatgaatctcttttctttggatccagttccccatccctttcctgagagctgtggagccctttttcagtacgaaggaagtagggtcagtcaccactccccttgggccttctccagggtgtctggccctaaccttctttccttccctttgcttggcttttctccttccctcgctaacttggtcttctcactccttctcatccacaatcgctatacaggaagcagcaaaatcaaacctgggagagaggcatgactaacaagttctttcccggtgctccctgctgtcaaccttaggacccgggtgggaggacttcccaggggaggagagggagcagcaggctgggtgcgcagggggcacccccagatttggtggacttcgcaccagatcaatggtttaaactgaatatggtggaccagcgaaaatctgcttccctgtttgtcttcagccagccacttcccttcatttacttgcaaaaggtatggtgtcttcagtggtgtgttattaaatggctctaacttttaaccttagcaagcaggaaatagggctgttaaatgatggagttcacagttcatggggaagaaaggactgtgttgtcaattggctgtagacttctgtgctgctctttgccattactcaaagccattctaaggtgggattataaactcacactggaaacacatcactggacagtgactctacctccattcagcccatgcctggagactttaagggccccatgactcccagccaccagcataaacactgcaaatgtgttagaagaaactacaagcttaaaacctaaaaacttggcaaggatgttggatccagacaggcatctctgagcctcagtttccttatccaatgaagtggagataagaatatctaccttctggggtactatagatataattgtttatactcaaagatattttgttgcatctggctgaaaagtcttcaaatataccagtttccccagttctcttgtcccagccctgttggtgcccccaaacacttggcatggtctgaatatcaggagccgaaacatctagttctcctaagcaggagaagtcgctgatggttgcagagttggctgtaagtagatttacagagtcccttggttgttacagctatgacagaaatgatttagaagtgatggttggttagttggtttttccctctacccttattcaggaaaaccaagggaaactcacatatactttgctctagttacttttttttttttttttttttgagcagagagcacaaaaaagcataaggtccatatggcagttattgatctgggccatctggaaagccaggacttgctcccaccatgtaggatcagaagctgttccaaaaagccttccctcccataagagatgtattggtcagatggggacagggatggatttcattacagggcaggactacagtgagaggaagctggagcaggactctgaaggactgtctgcaaccctgaccctgccacaaagatcagagagaaccaagaaagtgttgattgacacagggccattgtaggtagagggtgcccctcatcatcttgtccgctcatgggtgggatggcatcaagtaactaacaaaaacaaccgtgaagcactttgcaattagaaaatgctctgcaaatattcctaggtgcctgcaacatgaggaagagggagtgtcaagttcaagctagtgagtgaggtctggtagccctaaaagatgatatttttacttcattttaaacagatattctacttttctctttcttccttagcttctcaagtgttttccttcttctgcctgctctcagcctggaggcaaaattttccttccctctaaaagtttctgggaagaccactgataattttcaagtagaacagtgtgagaaattaattttttttacagtgtttctttaaaaagcccaaaacaacatacccactgattatttttaagcttgagggaaagaaaatttgacagaactttcccatccccttcaaagactgctcaagtggctgaactacaaacaggggtttcaataacatggttttgcatcttacgctacaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacaggtgaggtgggggctccaatgaggttggggtgctgattgagccctaggctctgctccctttcaactctctgcaaacagcatgactgcaccacatgaccttcccagaaagactggctcaaggactcaagtcctaccagagtttgtcttttcattcattcattcagtatacatttattaagcatctacgatttctattaatagctaacatttatggaatgctaactaggtacagatgccattctaagcacctaagatgtaacatattttattatcctcataaggactccatgggtattattctcctcactttacagatgaggaaaccaagacttaaagagctaggtcactcaccagtaagtggtagagccatggtttgaatctaggcagttccagtccaaagcccttgctttcaaataacactctctgctgcctcaaccgggggccaagagctgtgcatggtgctgtggacacaaaggtgggcacaacagactgttctgtgtgggcatatggacaagttgggcagacatactgataaactcataaataaatataaaatcaaaactatgatcaatgtctggacatagaggcttatggtccttggaagtacatcgtaggggatttgacccagcctaggagctcaaggaagacttctttgaggaggtgatgattgaggtgaggttagaaggcaaataacagacattacctggtgaagaagggagggaaggtgcaccaggcaatggtcacagctttctcaatggcacggtggcaagagggaccaaaagaggaagtgaggagcatggacacagcttgtgggctgaaacccaaggcatgtagattggagaagaccagagtgggagttgggacattataggaggcaatgcagggggtgcagatgggagatgatgatggctggattagccccagaaatttatggacagaccaatcccctttatcttgtgggctcagcccagggcaggcaagttgcctctttgacctggaagtgtcttcagtgtacatccatccacgtgcctttcccctaatcattccagctctgacagggagtgctccaaggtctgaccctgtttgaggtttctagttaaaacaccttgtgtttgtacagtctctgcatctccacatgcctttcttgtttatcatcttgcctacactttctaacaaccctgtgaggtaaggtgggccagggactgataaggaaaccaagactcaaagaggctaaatagcttgcccaaagtcattcaactaggaggtgacagagccaggatctgaacccacgttttctcaattcaaattctctgctcttaccacatttacacaaagacccattttcttctaatgggatcagtttatgctaatcctgtctaggggactattttctgtcccttccctgttgctgttccaggataatcagcaaagatttaggtagaggtcattctctggaagattgaaaggagagaaccagtgattttgaagaaggggaacaacgtggaggatcttttttatccatagctcagtttgcaagtatgaaatgcacattgactatagaccctgccttgcctgacatcatttattcatgcattctccactcaatcatttgttccacacatctgatgtgccaggcacacactgggaatgggacatagagacaggaacaaaatagatggggtctctgacatcgtagaactttcaggctactgagcaagatagataataaacaaatgcaagtactggataaactagaatgtgcacatgaaggaaaagaacagggtgctctgagggaaaccaatttagtgaggattgaaaatttgggaacagcttttctgtggatatgacacttgagcttgggggtaagaaaatgttagtctgggggtgactgaagggaaaagcatttggggtaatgggaacagcatgtgggaaggatccaaggcagtaaagagcagttatttgggaagtaaagacctgatactgatgccaggaaggtttccttctacttggcaaaacaattactaggaaataattcaatgtttagctcagttcccctgttctcagtgtccctgatagggtcagtggggactagtgtcatcgacagggatgtgcagacacacattctgagagtccttggttagagctgtaagcacaaatagttaatggccattggatacttaaatatgccaggcaccatcctgtgagctcttagtaactaacagaatccttgcaacagccctcaagaggtaggcacctctattagctcccctttagatctaaggaaactgaggcaaagagcaattaaataatttgcccaaggccctctgactagtaagtggcagagtgaacatgaacacaggcagtctagctctgagtccaggctcttaaccacagtgctgtacacattcaccatgcaaagaaattagtgctgacttagtatttgacagttgggctcttttgcagctcccttcttatagcgggtggtccctggttagcaggtgtcagccatgacctcttgtatcttcctctcctctctgcagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagagattactttgtgccaggcactgtgctaaataccttatttctgactcttttgtttgtttgtttgtttgtttttgagatggagtctctgtcacccaggctggagtgcagtggcctgttctcggctcactgcaacctccgcctccagggttcaagcgattctccagcctcagcctcctgagtggctgggattacaggtgcccgccaccacacctagctaatttttgtatttctggtagagatggggtttcaccgtattggtcaggctggtctcgaactcctgacctcaagtgatccacttgccttggcctctcaaagtgctgggattataggcatgaaccaccgcgcccggcctggactcttttttaatcgttacaacatctgtgcaaagtagatctttttgtcactcccattttagagatgataaactgacacttgatatcatgcccagggtcacacagttcacctgtgatagagccgattcagaaaccggaagtctgactccaaagtccagatgcctaacccctactgaacactgcctttttataaagttcaacactctttatacactctttcagataaagtttccttgaaattggccagacatctaaaggggatgtggtttttggaggccaagctatagaaactagaggatgacttccaaaaataacgatgtttttctgaatgtcgctgcattcctttgtattctcctagttttgactgcttagatctttccggcctctcagactgaggcaagggagaagcaagagaaactcaccccgagccagaagctcaggccagtacagcttactcccctgccaccagagtgaaggtcagccttcaacacagacacaaggagccccagaaggggaggagacgtcatacctctgtccctccccagatcagtctcctggcaggccaggctctctgattcttatctctagttaccccttgtttttctcaaaagaacaggtccctaaaaaaggagggagtttgcatgtctcggggccacctttgctaagcaaatgtctccattctgaatacagaggcaagagttgggttggaggttttgcgatgctgaggtaaactcccagctctcaactccagaggcttagaaaggctcagggcttggtaactggaaccttgcatcgatggagcagaagttggaccgcaggcttccccatggagagctgagcctggtttttcttgggaaagaagttgatctttgccattgtgggagacagccctatccgagacagtgcttctggttcagaattgtggacgcagggcatcctgaaaactggagcggtcctgctgaatttctgggggctaatcagctgcaggccctggccacccactcctgtccttcccccggatgagtgtctccaagtgtactctaggctggtcctccaaagcagccccctgctccccgcatcatcagttttatgtactggggctccatgtgaggtttcttttgacaggagtgctttccctaaacaaaggtttgggaaacagtctaagactatcgatgtgtgaccagaagacagtgtcattggcctaggggtcattttcccgtaaggttctcagtgagctaggaactatcagtcagcttgggttacctcaatggaggctttcacacattagaaaaagaagtgttcctttccctgtagaccaggaattcagaacggtcaaagatcgcccaaactgccttcccccctctctagccaaagtcagctgaaaacgcagttggagccaaattcttccccagatactccattttagtcaccaggtaaaagacacaacctggaaattgccacctttgtttacttcctattttccataattctgggtccataaccaccttccaaatgaataaaatccttggtctgaaaatgaagctcgcgtggatcagaatgtcccagtgaccaggaatcaactaggaagctgccttcctagcaggacgtgcggggcagggaggagaaggggaaggaaagggaagaaggtgatagggactgggtcccacaccagaagggctgagtggcctctctccctgcagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacaggtaagatgacatttcctcctctttgcatctcacccacatggtcctctgaccctggcatcccacgaggccctgggagggctgtggagggggcagccatcccaggagctggaaatgctgcagacccctgccatgttctcctgcctcagaccacgggtactgcagcctctggacttgggacagtttctcaagggatgtactttgtcttttttaagggatcatttcagttctccaacccgagtctctcaaaaacaaatcataaccacacaccacccacccaaattcaattagaccctggctcttcaggccagagggctgtggctgttgatttagggaagaaaaaaacccctcatgataataaagtaatcggtttatgtctgaatctggcctccagatgtcagtggctaagagacttcattttcatttcggagccacatctgtaaaaggcatttatttgctcaggagggaccctgttgcagggagctgatgggggcaggactccttctcattgtcctgctcattcctgccaggtggcccaggccttggggaacacctctcatcattccaaatgagggtgaggcccacggagggtgcccagccttcctggtttccgagggagggccctgcccttctgagtcaggccctaccttcctttccttgggtcgccagccctcctccctcagcagagctggcaccagatcttacccagagctcactcactgcctgccaaaaggagtttgtgggagccactggggctcagggactgagcctgatgccagcaggagcagccaccagcctgagctatcctgccctcctccgccagagccccaggtatccccattttcctgtctgtgccgtacctgtcacgggctcagccggcaggatggcatgagggattaataagggcatgtcggagaagtgcttttggctcccagggagaaaaatgctgcctgtatgctggctacagcagcgcagaggagccctgttgaggcacacgggctgggaattgggcccaaattagcctcctcacttttgaattgaaggcagccccagcgaacacatcttcataggaagacacttaactccccattacctggggatgaggccaaagttccctgcagcctgctaaacgtgtgtcacccgtcctctcacaggtgcagaaaacctccccccgatacaagctggcttcatttatgtgccctggaatcaggggctcagcgctgtaggggatccaggagcttgtaagccagtggctttcacacacttctgcccatgatacacaatttaaaataattttccttcacaacccgcttcacttataagcactcacacacagtggtgtatacggggtacagtgtatgggtaagtgcttggactctggagacagattgccaagttcaagtcctgcccctgccattggctggctgcataacctcagaaaagttagtctctcagcgccttggttatcttagctgaaaaatggagaggacaatagtctgtctaccccatagggtcattgtgaggattaaatgaatgaatggatgtgaaatacttagactactgcctgcacccagcaaacctgttatgataaataactgtaactgaaacaaaaggttcccaaagcaatggtcatcttaaccatggaagtgcactccaaaatattatagtcggtatgttttaaaagctggtcatgacctattcgacggattccacaacccaatgatgagagtgatgcgtggtttgggaaatatcacagacctgggccaattcctctttcatagacaaggaaacagccccagaaggtagaagtcacttgccagaggtcactcagctggatgaagtccacctcattcttccccccatcccttgcccttcagtgccatgccctcccagtctggccagtgggacagttgctaatgacctctttccttcattgctccccaatcccaacatgccccaaattacactggtgatggtcagtgacaggtttcttatttcaaagccctgcctggccattccttggaagatcagagttgaggagcgttcccctctgcccagcctcctttcctttgaagtctctgacatctggtttcaatttcaggggtagcgttgctgtttgatgggcagttaccttggagcacccagtacaaacatagtacaaacagtataaacaccgaggcctcggtgcccgccgttcctccactttcatttacacgccctgccctccggtgcctcattggcccctgggtttaacattctttacaccaatcagctgacccattttgctacctaacatttccagaaactgttctccataggtcacgtggctatgtttgcttttcgaatttccatctgtttctcacactcatcttcggttcacttcttcatccctatcccaaaggataacaggaaaaataatgggctgggctgagctgctgcagctaaatactttgacagggctgcttcacctgttagttggtttgtgtttcaaataattatgttttgccttactgccccatagtttgctttacaatcgagtttctatgacacagtgacaaacttgaacttacaaattaggacacttcgaggttatttgctatttactgtgagcaaaaggcagacacagcaaagggaagtatgaaaggttatgtgcgtagtatttaatagcagaaaggtgggaagccgaccgtgaaaaagctattcagcgtatttagcaatttcctccagctcctggctttattaaatggtatcctgaagggtgcctgacaaaggcgcctaatcacatacagtagtgcaaaggagcatgtatagaaatgagagggacaaggcactggcatcctgttggaggacagctctgggatgaagacaccaccccaaaacacatggacttgagcaccagtttccagaacccctttcaccccacccagggcctgactcatagctccattcactccctcaatagttgctgaatgaatgacgggcatgagcaaataagcaaatgaataggtgaatgaatcacctagagctgaggtcaaaaccccctgcctgcagccaggtttggcctagccagggttcattgtgtgctacttagtataacatttttaataagttgccaacatgtagagtctggagattttacttagggatttttgctttcttgttgggggaaggaaagggggaaagatttggaagacctggcctggccacactgggccacctcccctccaggccccagtctgctggagccagtcatggaggccacctttaaaccaggcatgtaagatcccagctttcaccacctcctctctctccaaccttcccctgccctcacaaccacgtctgctttcctcacttacagtaggtgtttggatccaggaaacacttgaacttgccacaccctgacctaaagacatagccccaaatcactttcaccatgtagggtctgagcctctttaaatccatattcccgtccatccagttttgtgcaaacatgagccagagtgtgctttggtccttccttggagtcagcgtcgcctgtagccccctccattattgtctcgtggccttttgtgctaaactcggggcctctgctgtggagtaaagaatgtgggtttgtgtccctacctctgtcactgctggttctgcaacccaggaccattctcattctactatggtgatgcccctgacttcgttgacagcacacagacatgacttcagagttccgtgcacatgtgtgcatcttctttcccttctctagagatgtttggcatcttcctcctgctgggttgcaacacaggctgctacagcattctcttatcttcctttgcccttacacagactccaagcccacggtagagacgctgggacccactgtgaagagcgaagagacaaccaccccctaccccaccgaagaggaggccacagagtgtggggagaactgcagctttgaggatggtaagcacaaattgcctccagatggcatgggtgcggactagtcagagtgggagctggcctgtggctggacagggacctagtggtcccccagatcagagatccaggggatctcaaagaagtggtaagagaggtgggggcacttaggggtttggggcagtggctgtttacaaccaatgtagaagcatttggatagtgtaacaaccagtacagccctactggtgtgaacccactagacatcaggtgagacaaggatgactccaaagagaactcctcttttgaggagtctcatttgttgagccctcactatcttgcttgtctgctaaaggagaaccattcttatccttagaattcacagctctgatagtttttcctgttaagctgtgtgtgtatgctacagcgaagtgaagatacggcagtcatctgggtgatggagcgcgatagttgggttaatccagcagttacctgtgacttaattgtgtttccctgtgtctttcaccgccaccaatttgagaaagtataacagtgatgattctataagatagtgcactgtatcctctataactggagtgcagatcagagacaaaggcggaaatgtaaaaaggcatcttcaaccgttccctcaaaactcaggggctccgcatttctggatgggtcccatcacatgggaaattcttttcatttatcttcggagtatatccaagttagataaaaacaataattggcagaatccaaaagtcagtcacattttaaatcatactgctaaagtcaccaagtatgaggacatttataagaaaccacaaattttggaacacctggcattttggctagaatgttaagcttgacagcctcaacttacagtaaattactgatcattattaaatgttcattaaacaaaatgagggaagattggcaaagagactagagaagtgatggagacataaagatataggtagatggcaaaatctgtggaacctgcaagcacagccgtttgacagttagaggaactacactgatggagtggatgactccagaaaatggctacaaagaagaatgggaggaaagccaagaataaatgctgaagttatgtgactgaaaaagcaataatttaatgcatatgctttggggattgtgctttcatattattgtgtgggtgggggacactgttggtcggggttagttgaatacagaattctgacattttaatgaacttgtttttgttttatggagagaagaaggagacttggagaatcttccaagacatgtttcagatagtttgagagccaaaagtggaatgcatagggagttaacatacgatattggatttacagagttagcttgttgggggacctggagtgggggttctagctaaatgacaatcaaaggaaaaattaagggttctgctgcaaaatttcagaagtttatttttaatatgattttcccgtttctagtggtttgtttcatttgaggtttctttgatggttcctcccttttctttttgcaaaagttttttttgtagaatttggttcctgagatacagtatacatgtaaacattacagaggatttatgctatattgaattacttcgtatttttgaagagaaaaatagaaattcagaaattgtcaggagaaggggtggtaaaggctaagggctgacttttccaagccacaggttgatgcttctgtaatagattccatgtgtctcttctaaactcaagctgactttggccaagggtgggcaaacattaaatatcctgtcctggaaagggaaggcatttacagggcctggtggcaatcttcctcctccctctgacgccagcagtgccctgccccccatgaggtgagccctcctcacccctagggtgagtaatttgtttctaccagtccgtggctccctttagacttcctaacctgcattctaagccttccccagggaaattcctctctaagaaccctgggaagggaagtgagaagggcagagaccccactttctccctgctaccaacattagccaacatttttccactgtctccgcaggcactgccggcaaacaaccaaatctgggttcccatttcctctttccccacgtccacaccacccccacttagtcacatatttggcattagctcatactggatttttggagctgggtggaacctcagaagaaactctcttggttctgtcttcaggctcaggcaggtgaaccatcaaagcagacaggacaccactgtgtcattagttcctggattcccatagggaaagcattctctacctcccggggtcgcagcctccagggattcagcatgatgggaaattatttttcctcctggccagcactgagctgagaagctggctggtctggtcccttcgatttgctcttaccatgccaaatttcccaccgggcatacctccccatggagatgctggactgtcccagtcttcagaaatagagacggatcacaaagaggtgaagtgtagcaaacaagccttccttgtttctgaggtcactttctcctcactgggcagaacctcccagggatttcagtctctctggatgctaatgggctgccccatctcctctgagagccaggttggcaggagatgagataatactttttttgggagccagccttccaccagggcactggggagacattcttctctggcatttagggaacagcaattttcacatttgtctgctctccgaggtggacagaagaggctgattagagcctgaagccatttggtagcctcattcataattgcttactatgggaaccactggcagacttggctttcatgcctgggaaggatgagaccaaagcctgacccgaaagccagcgatcgccaagatgagttaaatgaataagcaaaggaagccacttctttctctgctctccactcaggccttgccagccatttaaatagtaccactgtggctgttctctgaacccatttcatttgccttcctttgggttattgttttccccttttagacaaagatttgcagctcccttcgggattcaattgcaacttcgatttcctcgaggagccctgtggttggatgtatgaccatgccaagtggctccggaccacctgggccagcagctccagcccaaacgaccggacgtttccaggtaagccagctgtgagtgaagatatgaaagagttaaggccagcttgttccacatacttcaaccccagattcccttacaagcttcataacttcccaccgcacagcaatcctctattctttgcccacaaaccaccacagtctttgctcaagacgtcacctcaaagaatagccagttggtggttcccagcctctcttgtgattacagcacagcctggaagctgggagggagaagcggaagccaagatagaagaaagaggagaaagaaaaaagggacaattgggaggccctaggagatggggcacgagtcagtgtcctcttgttcccatagccagcacccactgctattatcacagagccccttgtcaacttcgagctgggtactgttcctaaaatggctcattgggagatgactggccttgagtttgatttatacgtctctgagggtgccactgcttctacaccaagtcaatttgagggaccaaaatgctgccacacccatgggtatctagcagagctgcctggcacttggcctctagaagagtattgctgtaagtcctggatacattgttaagcccaccattttagtttcagaaagccagatttcagaagcttctcctggcactgctgacaagaaggggttgcctctatcccttctaaacaggtagcaagagttgtctgctatctctgctgttacgtgctttcacagcagtatgatggtaaatgtttaacaataggctttttagggattaaaaaataaactgctttttaacgtttgtcactttcagtggtgtaaatacccttaccatagctgagcttaagctaccaacacaacatcaatggagatggagttgagaagtcagtaagagagcattatatagtttttttttccattgtgcaaatacagtagacagaaatgactccagaagtatagctactgataaaatgtattaagataactagcaagtgttgagttttgaggatttgttacctttgttttttaatacaatttattgaattatagctttatataatttaatttttactaatgaatacatttaacaactggcttgcaaaacacttgacaagcagctctcacaagctggtacaccttggatctagcacagcactgagtgactttgaattctcctgtacttctggcctggacctgagacctccataagcactggagaggagaggggtgaattccggaaatttagtagatcagtttgccagggtacaataggaaaaggctagaaaataaaagagggaaagggaccttcccttctgcaggcttccttagaactgcttctcaccccaagcactggcgtgtcccttcttcccggtgggggcagtgggacagatgctaggagaacacttggagctggcctcctgacacagtccacacttgcttccctggagggtcacagtgcctgatccggagaaaaacattttcatatttcaagtgtttatctcttcagcatttgagtgctcagagagattaatatctgaagatcaccacagcctcaggcaaaagaagagaacacttaccccagtccagccttaatcaccctcccttctctgttcactgcaataatgtttaattaatataatgagcctcctgcacgttgggaaaaaatacttatttttataacccagcctggatttttcatttcatttccactcctttgagactgcatccaattaattcatggttgttcccaacccccatgttttatctgaatgtaaagaaggtttgtggggtctgtgtaggtgtgggtattctagtgttaatgtgtgtgtgcatgagtgtgtttgtggtttctgtgcatgggtgtgtgtgtgtgtctgtgtggtatgtacctcagcagaggcgcttggaataaaaggatatagccggggtcctctgcaggctggggaggttggctggctcttattcagtgtctgtcctcaggttcattctaatgattctggcctcctcccttgactcttctaagcatattttctctgggagtgtctgagggcagccctacccaggccacaaggccaccaattactgagtcacagctccaggggagcttaagtgacctccctttgaccctggcctggacctctgtttcttcacccgttcaccaccgcctcctcctcgtccagtcctggccttcacccgaaagcccctatggttgacctttgctactggttgggaattctagtctttgtcctccttccagttgattcattataccctgtggtttgggagggcttttcagagcaagctcacaaagtgggcagaattccaacctttggctgaatggatggggacagagagaaaattacggccataaggaactgctaaatctaatgttgttcctcccttaagatattgaaagggaaagtaattattttcctattccagaggaatcccgaagtttgggaaagtggcacttataacctgcctccaggaaacaaaatcataatattgttctcagagcccttccctctatcctctgatgactttatgaaccgttctctgtatttcccattttccttctccctacagagcttgatattgggctttaagcaggagaggagagaaagccctttctgttcagggtggtccttacttcttctccatagggaaaaaaaaaaaaggagggggaggccctgaggggattggggagaagggaagcagctggcttggttgggggcagagcaactgctaatgggttcagagcggctggcgcccacagagtcagcctgaaagcctgttgtgtgccacactttgccatccacagaggggaccgtcccactcttcacgagcgtgtgccatatgcttcatcccctgatgagataggcaaacagaagtaatgaaatttaagaaaggaggtgtctctgtcaagtgtgaggggcgtcagggtgaagagaaaggtggatgggagaggagctagccgtgttgaagtacccaacacgggccctatgtggaaactgcttacattcctcggatattttctgatttcattattttctcatattttctttctttttttttcctttccttttccttttaagtaagcaattagttctgttctttttggccagtggttgcctaaggctgaaaagcacccactggtttcattccactgtttttgtttttcaagatagtctttcaagccagtcagaatttctgtttttagctctttgcttgtggcttagctgcctggagtgtgttcacaccagcctctggggaccctgttccaaattcagtgacccctgctagctgcggaggaacactcagtgttctctaagaggccactttggctttcctctgtagtgacaatgacataggaagcacccccttactaggagatggcatgtttcctacattctcaggtgctttgaacatagacagagttttgagaatgatcaaagcccagcctttaagaaccgagacaaaaactcatagggcgggcaggtatctaaagctgcagcattgaatattgtagccatgagccatgtgtggcaattttattttaattaattaaaatgattacagccaaaacttcggttctgctgtcccaccagccacattccaagggcacagtagctacactgtattggtcagtgcatagacagggcacgtcactgtatacacggcatcatcacagaatgtattggacaacactgctccagtgctttggacactcacatgagagcaaccaccaggggcccttgatgattctttagttccctggttttggtatgaaccaagaagcaagtaatggagggatgtgtcttctgtgggatcccttgatggagtgttcagtggctggtatctttatagctgtctcattctccctcactagataactacagtaaagtaagcaagtaacatggcattagatggtgtaggaactattgcgattaatcaaaaagagcattgtaagtaaatattaatactaagtaaggtcaataatcatcatcattgtgattgttgtgtcatttttattgtcaggaatgagacaaagaagatgaggtaaagggtactaggccaggtcagcttcagaatcctccagtgtgtgttccccctaaatctgtgctcttttattcgtgggttggccttgtgaaatctgattacagtattacttcaatgactttcaatcatgaaagtgatagaaagaaaacaagcgaagctgatattgaacagagctttgactgcctggtcaaagcctatgggattgagggaacagaacctttactctaggctcaaaaacaagctcaaatgggagtaagtcgagaatcttaatgttataaaatacccaaattttacaaacagtggctggctattccttcaaatgtaagaagtaagattgttaacacctcactggggctattttgatgcagactgagccattgaatgaattccgttagagtgggagaccttagccatgattcacggtggaggcgcacacaagaagattaagtgaagtgtggatgggtatggtgagtggatggttgcagagaaatcagaggaaataactgatgagtgaatttactcataatgggcttgattttagacagtgagcaagtggtgactgaattgaaaagcaactctgagttcaaaagatcaggtgggaccgatggcagcaaacaatccattgaattgctgttagattgaactgtcttcagaaagaggttgctgtggcttggctggggcacagacactgcaaatccagagacagaacttcctgggctctggaccatgatagataattaaagatcaggagcagcttggctaaaagaaagccaatagtcaaggaataatttcaactggaaaagaaaaggatagaggcccttctttaaggaaggtagaaaaacatcccaggctttgcagaaaaaaataacagcaggaagaagctttctttaccctttttttttttttcctgcaaatcatgattggttgagtcccccagcagtgtgtggattgataacgaaggggcagaatgacaagacagcctcaatggcaaaaccttcatgaaagccggcagagtgaaaaaacagctctgggtagattcctgcaagggctaggactgaaaccttcatgtccacaaaatggtctattgtaaaccttgagaacatcttgctaagtttatccaaagtcagtgtttcccttaactggttgctaatttgaggaccttagcagagataggcagaccttggaaggccagctgagggctgactcatgttttaagcatggactatgcaaagagactacatctcctacagcactaaatattctttcagatggtcgttctagtaggagggcaagatgctagccaggagatgtgcgtgttggacagatggtgtgtttggctttgtgatagccaggaggatcaagctggtgatttatttcagggtttggtgaggtgtagacacaactgattccattgctgttgggccagtcgcagtcacgtgttcacatgacacttaagcagctgaagccagatgcggccgtaaatcgccaggtgaaatatcaagagacctttccagagacagcagcaggttaaaatgctgaatggccctgtcctctgtacttcctcttcacccttttgaactcctgttgttcattcccaggcgattgttttccctgtatcattggcaacaacagatgttttgggtcaaggacccagcgaaatgcctcccaagtatgtcaggtccaggaggagaggaattgtatctctgggacattatttcttcaatctctttcagcaatggaacatatttcctttccattgtctttttcttggaagctgtccattgccggcatcatagccatcagctacaagaacaggcagggctggttcttagctggtcagttgtcacgttcaggcgacctcttgacaatccaaagggctttacctcaaggttcaagtaaataaaaaagtagccccccgcccccaccataccagctcttttgacggtccaagtaatcagtagccactgtatacctagaacatcttctgtgtctgacagtggtgggccataaatcgggagattccagaagaacaaacttcagttgcagcacgtgtttgatctcaatatctatgtgtgggtgccatgacttaaaagagctgaagcatttataatagcttggaagaagggtcagtggaaaaccaacactgccctagaaagtagacatttgaaccatgccctaggaagtagacatttgaaggggcaagggttcctagggaagcaaagactacgagtcttaattcttcacaagtgaaaatgtctctaagttggaaaacagaaattggctatgctccatcaggggtagaaggaggaaatgtctctaaatgacagcaggaaaactttaaactgaatttaagaagtttctgatggttagggttgtaacctagaaaacacactacagacgtggcctatggaaactccttctctggagaatttaaagcaaagggtggacagctgttcttggatgcttttggcacggttcctccgggaggcaggactggcctgccctaagatcacttgaggtcccactcttgttccaggatcatgtaatattttatttcatctactgtgaagcaacacaaaagacctgtggtgatggaaaacttggggccggctggtttctggagaaagagcagataaggggaaccagtctttgtccagagaacatctttactgccctcatgccaaacatacttctttttgagtcttggattggccttcctgggttattggtggtctttctatcctttttgtttcctagtaaaataaaggcaagcataggagggagtgtgtagagtgatattaatagtaacaacttttcctgagctcttaatgtgtccttgttactgtgcaaagcactttacatggctcattccatttactcttcccccaactctatgcagtaagactgtctttgtatccattttacagatggaaagactgaggctttaaaagcttagtgagttaggctgggagtccaatccagatgagaagctatgctgtggcaggtttactgagtccaatgaggattcaaatcctacgtcactccaattctctgagcctcagtttctttttggtgaaaatggagaagatggtatttattttgcagagctagatttcacagggaaggtgacatcaggggaggcaggtaaagcctcccgtgtgatcgcgcacaggcagcaggtgttcaatgtgttcattcctttccccctgctcttcttctcccttccttgggcttttcctggtctgagtcattccttcatgatgtccctggttctaatcaggcctctgtcagtgacaggcgctttgcagctcagcatctctctgactgatgtctactgctaattccttaaatttacatatcatctttcttccctggagctcatagcacttaacagacaagtggggcacaaatgatttaacgaagtgaaatccagaggcctgctcgtctggagattctgcagactagtggattagctcagatgtcagcactgaattatgatccttcagctgcttgtgctaagcatgtcactagcattaactccctggtcttgcaatgttcccctaaatcatgcatagagattgtcattttatcgtgagagggagatgggagagaaggagaaaggagagaagaggggaaggggctacctggtggggtgggtcactggaaggggcagactgtgaaacctttggcctggctgtgcctggagtttcagtaacaggaagggtaagtagaacagacccagatacaatccattcagcccagttcttcacacttccacacacatttcacttaccaaattctaaccatgatgccatgatttccctgccgcttaagaatgtaaattcacacaagtgacagtatctctgccaaacaattttcaggcagcaagtgggtcttatttgtgaaactgtgaaggaagaaggctgaataataaatctctaaaatctggtttcctttatatatgaggtggcaacagtaagggcttggaaattaccggaagcgtgggagcatttaaagggttctcactggtgtctcggtacactgggtgcttccacaagccaccttgtcattactggtgcacctcacctttgaaagtggctgttggcttgggagggtagagggaattgtgaagggattatatctaagggattatgagaagctagctgattctcctgtcctcatttccaatgtatagcctcatatcattctttaaccgtgtatttatcattctccattcatccattcattcatagaaacaaaattttcttgaggagtggcatatatatagcactatctaggggtagagagaagaagcaatgttaaaccttattatttgtaagaccagcatttacaatataactggggtgataaaaaagacatgaaaaaaccagttaaattataatgccaggcagtgagtgattacctgctgaaatccatggaaaatggcctgcctgaagtccttttaaaaacataaaatcagcagtacagtcagtaaatgctagagttgttgagaaaagaagcggattaatgttgcatgtgccagaatagttaggagaagaactagccaaagggacggggtagatggagtggttcagggagtggagaattacagctaagaggagaaaaagcagcaacgggcccagtggggaagccagtttgcctcaaacagagtgtgattgattgcaaggacttggggcaagctacctgcagagcagctgaaataaagaacttattgcatgaaggtggaaaacctgcagtcaggggtctcggctctgccattgaagttgcctctctaccttggacaaatcactttaacctttctgagcagtttcttcatcatgtgcaaagtaaggttagtaagtcctatctcacaaggatatagaaaggatgacatgaaatattgcatgtaaatgtgcttgtaacctgtaaagcattatgcaagaatgagctttaattattatcattaacagcagtaatagtaagatctgataggggaagcataggtttagaagatctttgagggtctgatttggcatcagtgtatcctccctcagcagacaccattattaattctcttctgtagacagctgccttttagttatctgtgctgattttggccttgcagaggtcacaccttgtagggtatgtagacagatgtggctttggatggttgaagaggcacaaactggaatcccatatacgcatactaaactggtctcatttgacttcagggaagcatagcttctgaagcactaatcccagagagcctaaacaggaaggagcttaggggagcagggaggtaggtgaggcagctggggagtcaagaaggaaagagctgtttctgggccactgatgggaggtccagcacaggctcagctctcacctagaaagttgaggtcagcaggattaacaacagcaaagcagtggtccagggagtattgcattgattctaggctctagaatcctagcccatctaccctgacaagtccaggatattcacagtccctgtggagtaagaaagctctgtgcatctgtcccaggttaacatgacctcacactaacatgatcctaaggcatctgacgtgcccacattccatgctgcatatgtggtagaaaagtggccctgccatcttgcagaagtattcagcctaagacgcccctatgtttcagggccaaaaagaggtactgagatttcctcaccaaatgccaccttgttctctgtacaagtggccagaatggtcctgtacaagttggatttgaaggtgcaggtcacacctgtgttctgcaaggcacgtagtctgccaacagcaacaagaactcggtcttccacatgagtgtctgatgaatttgaaactaatcagccaaaaaggccattctccaaacatttggattggtaaacccttaatttcccagaacacatatattctctgctaaacacacagcctttgttaatgataatgacagcacctttatcactggagccatatgtgcctggctgtctcagaaaggccaagttcaagcctccctgaatcatccctttcagctcccaccctctgttctgtttgaaggtgacactgggcttctgagtcacagtcactagagcccaagcatcatctaggagcactgatggagacagaaggttttaaatgtcagccatttggacagtgcccagccaagatggccagggctggaagcatcaaccacctggtcatagtcaccctccaatctagcagccccccaccccctataatctgtccccttgtaattcagttcatcagattgcactggccctttgggtgagttaatgatgaataagatgtgggtctggcctctcagaatctagagggagaagaagggcacgcacacaaccagccaagacataaggcagctgtgccgggtgctccatgtgaaagagatggaaaggaaatgataccgagaaataggcaggagggaccgatttgacttagagactcttaagaaaacacagcatttgaatcaaggctctgaaggagccttaagaaagggtcacagagcctggagaacaaggacatgaataaaccaaagacaccgaaactcagtcccaactttcccttggagaggccacagcagcacactggtgtctttcccgagtgtttatggagaacctctgtttgggtttgtttctgccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccaggtggggtgagcaaaaagggaatcttgtgatccgtatttcaatatttcaagggccgagcccattcatcgttagggaacgtggttaagcgctactgttttcattgtgtttctcacgttgccatggcaactgaatgacactcttatttgttattcagaatatgcctatctctacacccagacttggttctttgttcctcctgttgccttttatattgctgaaatcttctccaacaaatgtttctcctctccattttattttagattgctatcaggtaggctgacaaagggacacagaagccagagaaataaacacaaacaaaccctccacacacaaggaaagaggcctgtggagccccttcagatctggggaggaaataggataatctcccagacctgtcccaggcagcaagaacacaggaaggggagcgggggctgttggcgctcagtggccggcagacatgagaggctccagagtgagtgctctctctctctcaccagctcccggaatggagttctgttatctctgccccacagagcaggagactgaggcacagatgggtatgttcagccgtggttgcaacttgggtaggagtagacacactgtggaagaggtgactgagaaccagccaaagcattaaccttctcctccccagacgaggagcagcaacagatggctggtgcagcagccaactgctcacccagcttgccagaggacatgtgctagtttgcagagaggaacctggggagggcgagcatgagaaatgactgaagaccacagagccgaggggcttctgtgtacagcctgcagtccctgtcccttgaggttgcaaggcatcctgagaccttccccacccccatctgggttcccacttactcacctgagtgtgttgtattgtaactacctgtttgcatttgtgtctcagccattagatgggtgagcttctctgggcagagatcttgtcttactaggttttgttactatccttatgtccagggcatagtaggtgctcagtaaatggctggtgaaaaaacaaattcttttcctcctagttgtaataatgaagccctaaggcaacttataataaggagcacaaatcaaaacctatgtgctgtatttctcacattacccccacctacttgtgtcttctgagttttcaaatacctggattgggcatttgaaagatttatgagacaggaacctcgaaaatagtgagggaagtttcaacccccctttcaatagtctctgattatggcccttttaatcaatacattctagttactggacaacaatatccacccccttgttatattttcttatccccttaaatatgcgtttgatttgaacaaactcattttgaattaagatttcaagagctgtagccatgtggtcaacagatgtgtaccaggtgcaataacacacacacacacacacatacacacacacgctttaagctgcagctaacagaaacttggaaatccttgcaccgtttggactaggagactcagttaaccatggctcttattcttccggcttctagattgtgttcgagggagtgatagggaaaggacgttccggagagattgccattgatgacattcggataagcactgatgtcccactggagaactgcatgggtatgtgaatatctgtctcttcatggttctttcaaataagaccccaagggctgggataagcaagaggaggcaggacaccattttccaatgcagtcgttacccagtgggtggggcagccacagtctctgcaaggtaaggtgtgggtgtagttgtgtcttaggctgggttcagggtgggaaggggtgtgaggtaaggggacggcttatatccctgttcccaatcagaaatagacatgcactaagtacatagaggttcagggtgccaagaccccctcagcaaaccccagcttttagcaaagaaaatgctagaggacgagagcaactgccagtcaaaattatatgctggaaaggtttgatggatttaatggaagccttcactggtgagcaaaaatagtacatatgttatgtaagagtgataacacaattacctgagtagttattttacatgaatgaattgcagagcaaactgtggcatttgaagtaagatttcagatttttctttaaaacgaatacctctaatgcccaagatcccaaagttgttgtaggattaaacattgcaggccaggtgactggcacgagaaggatatcataaccatcatcttggtcaaaagcacctgaacagccagtccacctgagaggcacgcattttcttcagggtctcctgctgcagatgaggtcaccctggctgtgtcccatcagagccatggacatttcccaaaccaagaaaggaaccctgagaaggcatgagggttgctttcagtcagcagagtggctgcagtaactcaccaactgcctttcttggcacacgacccctggtgtgtgtgtgcttgatgatgtcagaagcacctgggaccaccccagtccctccgggcaactctcaggccccaggcatctaaaagtaatccaggctctgagaaagtaatcagcagtaagtaactgattacaatactttagggacccatttcttgatgaaggactttttgttccaaagcaactttgagaatcccccctcctccgccatcaccaccccatgatgatgatgtgttagagccagcctagaacatgtggaagatggggggccctctccatggagtggtacaaaaaaaccgagtgcagtcatgtttatcatcatattcatccaattattcactctatgttcacccaattgtttcttgcctttaactaagtccaattttttgtttgtttttttcagaacccatctcggcttttgcaggtgagaattttaaaggtaaaaaaaaattttttttttgcatgctttttccttcccccatgtgatgtgaatttgatggggggaatcaacctccaaatttgtcaaatctcgcaagagaaaagagacgccacaccttcctgccgctagatggcactagcaacacctgtagatgcgggaaggggattgagagcctcactgtctcttgtttaattaaagtttagaaacctattaatagagacaaataggttacagataaacctttcagccttgcattgtccaacggggagcaatgaggctgaaaatgcaggggtggtgagaaaggagagactgtgggaagactgaaccaaaaaaaaaaaaaaatcagtataaattaaaagtgaaatgaggtggcaatgatttattttagcctgaagatggtttctttccagttccagggtaccaaggcagcggtttcagttaaccacagagccgaggggcttctgtgtacagcctgcagtcagtacctgcagtcaccatacctcagtgaggtacggtggcaggctgcttgtaagagaaggaagttaggaaagagacacagaagtggtggcctcaggagaaagagttgccacatttaggacccggtgtccagtcaagggaataaggaggtgcattcgatgactggagctagagcactttaaatgcaggactgaaaatcagaaaggacgtgttctcccccgagaaagcagagagagcagagcaaagtgagaagaattggggatgcttgcctcatccaggttataaaaaaaaaaaaaggcctccagccttgggtgatggcaatgttgtttgtgctgttacaatgcagcagattttacattttgccctctttgcaaacctattagcggacactgctgaagttcccacaccggtttctaatgccaaacatttaggagccactctaaatgcgtcactgcagttggcctgagtgtaaaagcacacacaaaaacaccctcaccaaatgatgggggttcttcatgacctgtttgatgccagcaattgtgaggattgctgtgccctctttgtactggctgggcttacccctacaagtggcagcattgcagagataagggcagccatttttatatctgccgtctagactcgttatcttcactctcattaatctgtccagctctgggctagaaagagatgaattcctggtttgccacctagatatgctccctgactccaaatcatctcacccaatttgccactcatcagctctaagacagccagtgaggaacaaagctgcagacgacaggggaatgacagaccgacatagaatatattgcctttcttacccttcctcgtgtccctgaaccccatgcccactccctgtaccacagttctaaaagtattaagagtattcatgtgcatacactggtgctctctgggggtgaggtttatgttaatgtaaatccaaagtattggaggaaagctgagagccaaactgaacgactttggattacagtcgaattcgagttctaaccttcaggacccaaggtaatgcttatgttggtgaagtgaaagctgtggatgttgtttcgcctgactctctttgggttgtggagactcacagctcccagaaaggctgggtaaagacgtgccagcagctgctgcagacactgttctgtgtgcacaccgtgtcgggccatgactgacaagtacagtggctaagtgctaagtgcttcacttccgtaagagaataagcagaccagggcacgtacactctccttgaaactgtgcttaccatgaggcttcacaggccagtcatgctctcttgtaaaaaatatatacataaaatctcatctgagcagcagtgctcatttagccaaaataaacacagggcttagtaacttgaaggtaagaatttccagggtgctcctggtgggccgctttgaggctaagcaaaggcagtgcacaagttgcatggattaggccatggctttcgtcctggaggatggcaagcatctttgggaagaagaaaccaaggcttggggagcagagacttggccaatggacacagtaaagagcagaatctgaattgggaatggagaatttcattcaccttggcacgttttacatggagatctgagttggtaaccagatgaacctagtgccatgggtctcttctttctggctgagacctgtttgaccacagcatgcaactctgccttgagcaaacttttctgtttgagagaggagaggactgtgtgttccatctaacctagtgactcatatactattcctcttatggtcaggacagcaggagtcctctcttgatccgggcataaaatcagccttttcactcaaaaaatggaaacagagaaatcagggggcaggcaaggtatggaaagttgatgttgaaacactgccaaccataggcatttacattgttatacatttttcaaattagagtgtttttcttttcccttataaattaatcatgcaacaaaggtaatctcattctttgggagcaatcactgtacaggtaaatctttagtgaaatacaataaaagtggcctttggacctggagttattagatggtcgcaatcttttatatttggaagtatctttcattttccgcctcttactgatttcttgccatgcaatattattttaaatttaaatcatcctgtgttttctgctgtgtgtgtgtatatacatacatacacacacacacacacacacacacacacacacacagacacattgtgtgccaggatgtgagtcagtaatgaagaaaagcctggaagaaaaagagatctgtgttgagaagggagaaagagaagaaagaatgaataaactgtgttgtcatgtgattttttaaaaagacccttttttgtggttgttatgagtcacattttaaacaatgtagcctgggtgtgcattcttttcttttcttttttaaagcagtggctataaacatggtgccgtcatgtatctttttctaggatttgagctttaacaaatgaaaaaccgtgtgtataaaggggggaaaaagaaccgaaaagtggtgtaattaaggtgatggattatttcctcttacccaatactttcttttttcaataaaggaaacaagaacaataaagaagccagtaaaaatatatgaagcccataatcagagttctggggtttgttgaccaggtggttatttttagcagctcaccttggaggcaagagtttttgttcgtgttagaggctgtggtttctgagcagagcacgggcagagagacgatctggtgccctacctgttagagactcacggaaatcccagctgggtgcacctgtggaaggtggttgtcagagggaaggattcagaatgactgtcctacgctagtggatgctaaaaggaacatcaatgtctcccgtttcagctgggaatgtggggtttatgactcagaccattcctaaggtccaggggccccatttctcgggtctccctaggtgcctttctgcagttctccacagttctcatccagacaaaaccaggagaaagtgcacatccacagctgtctcttgggcatagaggggagcagtattaagagaggcccattttgggggtaatgctggctggcatttgactctattccttaggctttaagttctgtttctttggtgccaactggccaatctctgcattttgcacccccttctctcctttcccattcccaccctcaccctctattgcctgcctcccaaggctttgtccaccagggtaaggtcccccatcccagggcctggcctcacattccctttctccctggactcccttcctcccacgcctccttctcctagaagcacttctgagatgcagagagggttaaatggtgcttttgcacataaccgtctgatgaaaggcagagaagtgttcctaacccctgccggggttccagataggcagctgtagtgtgtgaatcctcctccttgcccccacccccttatgtctccagctgccagattaaggctaggtgttgctgagcaagaaagcatggagatcagatgtgtgaagcgggtaactgcttggcggccatccttccccaggggacacagaggtgttctttgtgaggttcgctggagcatgccacctctcctgctacagaggcctgacacgtcccctctccatcagtttaccactcatgtaaacaactgccgaggccagcttatctatgggtggaagaaaatgtttttcaccaacttttctctccaagaacacagggacaagactcagtttacagaaagtagcataagtgccaccaaagagtgtgaagcgtccgagacttcagccagtcagagatctgaattcggaggcatttaaaaatgcctctagatgtgggagcaatccacatggtttctgccaacttactgaaaacatcccggcgcctcccgccacaccatgctcataaggcagatggaaagagtcgtttctcagggatgcctttgtgcttgtgcgtcttttttccaaacacatcagagggcgtgaccacattcttctactatcttctgtaaacttctctagaggagccaacctttttcgtttgtttaatctcacaaattaaataaacctttatgtgaaatgttcctccaccagcacttcatttttaacctgtacagaaaggactgtgcagacaggccagtcctaaaacaattctgacatgcaatgagccttttttgaaagagaaagagagaaggcttacccttggtgtctttcaaaacacttcttctggaaacctgggtgactcccccaggtccagatgatatttcataaagcagctatagtatatgctttctcatttcagagattcagtgagaaactgacttgactgagacacgccaatcctcagacaggttcagacagaaataggaggcagaaaggaagaggactgtttcctcttccctccctacttggttagagcaaggaatctgcaaacttgttctgtaaaggccagatagtaaatatcttgggttttacaggacatacagtctctgttgcaagtattcagctctgccattgtggcataaaagcatccataagcaatatgtaaacaaatgagggtgtctgtgttccaacaaaaattgatttacacaaacaggcagtgggctggatttggccaataggccacagtgagctgacccctgggttagagcacaggctgggattttgtccacctggttctagccgtgactctgacacttgctagcagtgtacagttcctcaggggaccctgggccatctcttgggtttcactgaatgcttctctgcccttctccacaattatcctccaagtgaaaccaggagaaaatcacttgtcctctcaagtactcaggtctccctttggagggtcatgaggaataaacaaaattgattcatgtgaagcccgtagaccaatggttaatacacaggaaatgtccactcagggtggccgttgttacagacacgtttcccaattgcatagtgaccctatttgcagataggaatgaccggaacactacctcatgtgtaactgtttttcttattttctcccatgcctggtttctcaaactttattgtttctcaaaattcaaattctttgtgtttgcattgcttttctccagggggctcagaatttttacagatgggagcctgtgcaaccttgcaaatgcacttggagttcagttattgactatttaagtatctgtttctgattatctcacacaatgggaaaactttgtagagaatctggggtgggaattaatgaaaaatagttcaggaattgaaagtgttttccaggtgaaaaaagacatgtgagtaagcggtagaaattagatcaatcaaagggaaaattcaggtcaacagatcaaccaactccaggcaaggttgaattctcacctacactttcacccacctagcccaggctccttttttgtcaagcaatggctcgatcacccccagatggctgaaggggcaagtgaagctaaaattgcacaactcagcaattcgggcatctggtgcaggtgacatctgcctaaagtgggcacctttttctaatttcccatagaggtgccacatgagctagcaaaatctctagcactttctgaaaataactctccagggaagtaccagtaggtcatcaacattttccagggagtctgaacattggtccaaatatattcccctatgccatccgtccatttatccatccacctatctattcatccatccatctggcattcattggattgctgatgttgtctgggaaggtgctttgggtatggatttaacccctattgatttatcgtcttccttttctctagttggcaaaccacagcctcattagcatacagctctccaaggctggaacagggccagattctaaaccagcacactccacctgcctttggagttgagtctttttagctagtgaatgttctgagaaacttctagcccccagctgcaagtcaaccaagagttgcttgtaggggatcaggaagggtttgctagtcatatcctctcttttctaacattaacgttatttctaacctcttgacattaaaacatgaattcacatagtactatttctcatttctccaaacaaatgcccaaagaaaatgtttaaggagccagtataatgtcccccaagtagcttttgtcactgaagttttctacatgttgataatttcaggggagagaaggataagtagagaaggagaagagggtcttacttaaagtggagtttgtctttcaagtagagcaggattctgagagactatgtctgtgtctctgattctaaatatgtaatccatgtactaggatttcaccttcctccagcaggtccccttgattctctccattgtgccctaacattgtctcttatcgtaagaaacactgtaagagaaacatgaaggcttcatccttctccagcctgagcactttaagccataggttgtgtattttgtgttggaaaccagcattttggctgaaggaaagcagacttttgaacaaagatgatgtagtgatggagggaatgtgggtagttgtgaccatgttctgcttgacaaaaatttctgctcccacctctgtggtctggtcaggtacttctttagagggaaagctaatccctgaggatttatcacctcccttttcttgatgggtgagctgcagcctcattaggggatggccctcactgtggagccacatgaaaatcagagacaaaccccaggacaccctttggggagagaagggatgtctctgaggaactctgggggcatcccttaacactttgatgtttcctgtgcatttttgtaagctcatatcgaaaatccagcagcaggatggttgccaggcagcagatcctcttggtgacctgaataatgaattgacaccagttgactgtgacttgcaagctggccacttcaaggagccatttccagcaccttgctttctcttcctctctttctatgcataatttccaccatggccacaaatatgagagagagagaggcctttctcagctatggtaatgaaactagtaaaagacagaattagtttggggacaaagacaaagagggcaggcaataaggtgggagaagaggaagatgtataaagggacattcaggggatcctgggattctggggtcatttctaccccaggggttgtggatgtggctgtcaaggtgtgtgcagagcaacacatccttgtcaaagctctgccaatgttgtgggacttctggtcacccaagaggtgccaatgaacctgcaccctagcggaaggggattcatacagcaggagaaagcagtgattaagagctaagaagttgagcaggctttgaaatattttccaagaaaaatgttctcatttttctatcacttctgagaagacattagaaggtctgacccacctcccacctattccccagatcaaagagaggagttctgatgttcaggctgcaggaattagagaacacagactcagaaataggagtcttagcctcagttcagtgtttgattcaccaagcatttattgagtgccttctttgtataaacccttaggtatggatgagagcaagttcctcatgatgagagtgagttcctctgcttaaggagctctgaatcttagggtgggtagtgtaaggaggcatgaaaatagaaatgagccccgtttgcatcttgagcagagggggaccaccctctgctcacagggtaggaccactaatgcatgaaggagcccgcagcacttcccacccatggctcccctgctggggcaccccatgagtagagaggatgcatctttccggcttaatgcaaacagctagggaggcatttttcataggagaagcatatatcatttttcagaagtaaagatcatgtctggttttggcaagctcaaaagctcctagtccctttctgggccagattctcatctgatgtaaatctttgggagaatcaagttgtaacactgctttgcatcaagtgggactccagccagtctttccccagagttaccctgggcttaaatctactacatcatctccatagcaaccggcagcggccagtgaacgtggttgccttctaaatactctgccagcttctcttccctgctctgtcttttctgtcattaagaatgatttccctccctctctctctcactcactcactctcgctctcacataccctctgtcattttgtgcccacattttttttgttgcaacttcccttccaatctgcttttaaaaatcctccatccaattaaaaaatgaggatgcattagtcatgacttaacagtggtgattgacctgtctaggcaagaccaggctaatttcaatgggcacagaagccttggcaagccaaagtggaatttaccttcaagtctagccagcttaattaatacattgttgctgagaatgctggccagccagaccaaatatggtgtttccaccactcaggaaatctgcctcactgaatcccggaagtcatgtcagcatcatttacttgtatgtatttgtgtatgtgtatgtgtgtgtgtgagagagagagggagatggagggagaaagaattagaacacttccatatattataaagtgattgtggttgaacagaaagagaagagatgtgtaattctaccattcttggttgaatcccatacttactatttaactagctgtataaccacttaacttaacctctctccacctctgtttcctcatctgtaaaatgggtctgacaatagctacctcccaagggggtaagtaggaaataatgcaatcgttgagaagtgcttggcaggtgctaaggactgagtaccaccttagtcccccagacccttccctgtatgtcccaaagcatgtgtgtgtttctttctttttttaaattagtcttttgattagtctgcatgctctcagcctagcaacactcttctgtgtctctccaccagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatctagctctggctgggtttctgttggctgtcattgtcatctccaggtacctaaagaaatagaggccacatgggatgcagtgtggcttctcccatccctatccccaacccacctgacccaagagaaggttcccctagcacactcaaacaagacccccttgtcttctggtgtctttgaaatgtcaagataacagccactgggtgtctgcggaaccacctctccagccctaaagcaaatctgtctcatgttgccttataaaagagaagctcataatgaatgtttagcctttatcagttacatccaatcttggaataagtcatagagaataacaagtctgggactgacgtaggaaaaacagtagtctgtttaagttgagaggaggaggaggtggacgagagaagggaggagagggaagaactgaaatgtctcctcacccagggtggttattgggcccaacttgggatggggttgagtacgaaggttaaaaaacatatactttggtattatattggtcattgtaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatactgtacaaaggatggattaaataatgaagtcaatttcattgatagaaaatgcaaattttaagattctcagtgtatgaggtctcagcctcgggagcatttattttttactttcctgctaaaaatccactggggaggtataaaattcactccaaagaagtttgcctgggccaaaagcctccaggttccttctgagaacaaaatactaatgattttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatataccctgatgattccccttctgtaacagaaggtgacaacaactttgtgaactttctatatctttatctgatgccccaagtggcatcatctttatgtacatgccttagttgagaatatgagactgctctaatctttgtgaatgccttcacacttcagctgaggatgtcaccttctctgtcactccccatcctgcaacctctgcctttgctctgtctaccccagcaattttcatagtgttatccaggtactgtgctaaaaggtcagctcttctgtaaaatgccatgcttcgcagcttcaaaaagcaaaattctgtatttcatggagggagggaagggtcattctcttctaagaaaaatagactggacaggcgaatgcatgcatgcatgtgtttagagttgcttctcagaagacaaagagatgatagcaactattaaaatatgaatgaatgaatgagtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagttgatagccgatctttaagaagaccctgtctttaaaatgaaactagcaggcaaacacctaaataatcgaaaattaccaaagaacaacaacgaaacaagaaaacctaaagatttttacttcctattcttattcctttccttattactgtgacaccccttgcattgctcagttgcctgtgtgtcaaaataacttgtggacgttggaaattatttgaaaatgtattgtgtggaatgtaataaaatgatgatatttttatacaaacatgtgaggttttttttccctttgcctgtgagaacaaagttgaaatgtaggctttgagcaaactgatgcttccaaagtttacacatcaccttctgagctacagggcatttctgtgggaggtaggtgggttttctccttgaggctgaatgccaacttttccttctttttatttttattactgcttgttaggatttttatccaatttgtgcagctgagacaacttttatgattggtgtgggattttgcaaaagttgctaagtgctaaattgctaaatgagattccacgaaatttctcttgatgacaaatccctggagattagattctactttcaaagggctccgggagagtggtaccagctaagctgaatcctgtacccagctctgcagagacagatcacttcctttgaagaagcagcagtgacatcttacccctcacctacccaattattacttccacagggatgtgaatctcccatttacgagcgctttcccagacaaaacgggaacttgtagcatgttcagggctgaaagatattctagacttcatttttgaacaggtaatgaagataattagatgatgactgtggacatagaactatcagagtggaacattttatgaaaggaacactataaaactttgaggagaggcacttggggaaacttactcagaaggccaggtctttcttgatgagtatttttctttggtcctcctctttagatggtgacccagttatataaaatatttctatcagaagggaactgggttgggccaggtgggggaaaatctaggaaaggcagcctcccagcagttcatggtttctagatagtggtcaagaagaggtcacattaatcctatttgcagataggatttcccaccaaccccattcatgggatttatcagaggccttctgacaacctgggagccctcctcaggggtccgagaaccatccttaaaggtcctgagaaaatgtacatgttcagaagatcctatttctgtcagagtcctgcttttcatcctatccaaacctagatccaggaaggagtgctttttacagctgtaaaacctgtccaagtgctgctaaaaggagacaggcttccggtttttagatcttacaggaagttctgttagtacagatggttcagtatagatgtcactatctgtcccttgcaggagaataaagtagaatgtcagtgatcagagcattttttgtttccccagtgacaagctcaattaccccttttgtctaaataacatttggctttccttaaagccatttgttcccattagtaaagaatgaaataaaaatatctcaaaagtgttgatttcaaacaaagacccaggctcagtcaacatttccttgagctgacctgggaccaaacttgccggactgaactaaattagccatcacttatgctttgttggcattactgtttttggaaccatgtttgggaattttcccaccttggttctagtcccaagacttattttaagggtacttactccccctaaaagggcaaggactgttaggactccaatcttagatgtcaaacagggcactgttaccaccaaacactcctcagtgtggcatttcttatgtagcccaagcataaatgttcagaaattttgtttccatggatcataaataccagatgtcaaggcctaggccggtctgtttctgctcctacctggttctttgtgatggtttcagtgtgtgttctctcttcacccactgcccccctagctcagataaccgaaacccagccaagctgaggtggcacagtgtttattttccttgcccctcttcacggcctctgcagttgttctgcacaaacgtgtggcctttctgtaatctctgatgaaaagagctacatcctgaagttttgacttgcctgcattgtgggctacacatctgagccaaactgcagatctgtaggtgaaggcttgttttttctctttaattgtgcagatcactggggctctcacagctgtaatttgcctttcatacactttagtgacagcccaaagaaaacacaaaacaaatccaaccagagaaaaagggagggggcgaggggaacaccagctgatgatcttacaatcagcagggaaaagaattgcctcatacaaataaattagtagctaggaatagtgtaggatttaattaatcctgacacagatcaggtgcaccacagtatgtatagaggtcagatacaatcagaaacccacacccttaggggtcttcaggccacaagcctgggccagagtatgtttgccctgactgcttggaggtgttctgtttggacccaaacctaaacactgaagagcgacaagatttgggaaatcgccaagagcaaaaccttatttagcatggtatggaacagtggagaatctaggtgcttcagcacaaccaagccgaagccattctttccccaatcccagtggataacagacctagaatcatctcctctctactgggtaaaacagttgttcttggccttttctgccactgacccctgagagccccaaaaagctaaagtcccgtgggcattggaccaagaaataggaaagaccatttgaacagtcaacaacagaggtacttgagggaggactgagtgttatgtgggaaaacctcttttctcggagtttcattgcttgagagtgtattgatactgatgatacagggaggctgctggagggagactttatagtaactggctgggtttctttaactcacaagttaaacatgctcaaaaagtgcaataatacagaaaaagccaaagtcgatttcattgttgaccaatcccagtcacctccccagaggtaactgtgagggatggtttgaggagtatgtttccaggccttgttttatacctttacaaacatgtatgttcatgttgagttatgtggtttggttaagctggggtttagtttggtttcatttggttttgtgtaaatggtagcacagtgtttgcttactatattggatgacttgcttcttttcatttgacatcttgagggtaattcagtacatactaatgcatctaccccatcctttatatctgcagcatagcattccatattgtgttgatatgccagagtgtattaactgctcccctgttgatgagtgttcagactgtgtctagttttttttttttttactattataaacaatactgcaatgaacatccttgaaattgcttctttgggcacatgttttacaaaggatagaatttctgggtcaaacacatccctgttttcattttagtaggtgctataaaaggctgaggtttgccgtttaaaattaacctgtccctgcttgagagcatagcagaaactagtggacgtcctggctgtagagcccctgccacatctgcccaacccatgtgatctctatgcctatctctctttctctacagtgggtgtgttgcttgcaagagaagaccttgggcacttttagctgaagataattttaaactcagggagtgtttcttcagaacgttcttttttttaactgccaacttacggggaatatggacctggctctaagtgtcagctccccagagctgtggtggctgtgtcactggagttaattctgtccctgggttcatcaggcagagtcctgttctccatgattaatgagttccacttgctttcttcaaagaatgcctgtgctgtgccatgctgttatttatttatgttttctactaaaaaatttatgtaaaaaacatcccttaaggtcagtatgcagtattgtgctgcagactaaactatcccagcagccagaggtaaacctacacaccaagaaaaagtctcaaatttgagaggccttggaccacaggcccccacactggccccaagaggggcagaccttgtgggcttccttctgaggaagttcagggctgcaatacccaaaggaaaggcactaggcagtgaggtggttttctagtgggatgtttataggcataggcaaagctactagcccccacaggggccagtagcaaggaatggcgggtggaggagaagcccagagacctgtcagtccaaacaccatttctagcaaaagcactgccctcatttctgtggtgtgctgagagaaaagtgtcataacaaagtggctttgactttgaacataatggagtgtgtgtggctatataggtccagtgtgtgctttccctgacctgccaaaaatccaggaccattgcctcctgggcatgaggtatgagtatttaactcaggaaagaaagcagcatgagttgagatctggatgaactagagtgcatctctctctgacacacacacacacacacacagtgccttgttttgtcttctctgtgtaattgcgcaaaattaaatcctttaaatatcacgaacattccccaaaacaaaggctctgctccagaattggaatgatagtataccatgccacggctttcagcaataccagtttctttctccagcagcaggactcattaacaggatgcctggactggacttccctgcaacttattaaagagcagccagctccagtaacgatgggtgtgcagaaagccttgagctagaggcagccttgaccaaagtctcattctccaaagcctgctagttattgaagcttcatttaagcacaaagaaactttttgtctctttgtgttttcttgctgccacccagggcctgcgagaacaggcatgaggatttcaggggctggtgtgggcctccccatggcttctctagggcagccccacagctggcattgagagtgagatggtagttattacaacctagatggggccaacatgggtgtgtgaaaggagccccagagatgcctcattcgccttggccaactgtggcctaagaggatgagccccatattagtgtttacaggggtcctgggcccacaaacccatcactgctttctggctctgcacctcctgatgtggctagggtctccacctctttctctgtggaggagctggtcaccactcatctgcctttgtgccaggtgcagtttgtctccaacctccaaaatcccctttctgcaccttccccttctcttgctgaccccttttcttctctggcatccttacactttctctttcccttcatccatcaatgccttcttcaaaaaagcatgggtcagattccttcacacaaatgccgcatggctacttcctccaataattgcatttttacaggggaccacacctgaagccaggtctcttagtaattacggtccttggccaccagcaagctattgggggaaatcatctcttgaatgggcagagagaggtacatttttggtagctgtaaaatgatatcacagagtcattcattctcattcattcttgtgttcagaagaagagcccatcttttaagtacagtgaattctgttagtgacatacaggtgtacagtttcttttcaaggacctacaaaataaaaggggctatctttcagaagatattcttcttcacattggaaatggatgcagttttgattcttcaactccattttctcacttgtccaaggttgtaccaaaccactccatctgagtgacatagtgatgtttctaacatccacacctcaaatattggaactagaggaggggagaaatttcaaagcccactggaaaaaaactccctgaaatatgaagatacatgactttttcccctagcatcccaggaaaaaaaataagactacacaagagggggaaaaaacagcaggttttccttgaaatgctctgtttttcccaccctcatgccctaagagaaggtagccaacaaaagaaatgaaaagagccaattgcttgttcacatatctacttacaacaatggagaatagctgatttttcaaagacttggggtaaaaaagaggttctagaattttctttcatcagctttgctgtgtttttccagtctgcacaattgtgaagcctatctttatagccaaacatgtctctggctgcatttttcttcttttcatgccattgttggggctcattggagacattctggcctcagctgctcatccgcctccacacttgaaagtattactaggtcatttcacagtcttcttgtttgcagtcagtatttccaattctttttagtgtttccttctagttattcaactaaaaataatagaaacgaatggctaaattcaagatcaaactcttccagtaatctcacaccaagccccctccttttttttccgcacttgaaaccatttgaaaaattccaaaaaatattttttccatgaccgtgcctagatttggctgtagcccaagagataaaagcctgtgataaaggctcttctgatggtgcttctaaactcaagccaaacccagcaaggaatgaatggctctcaagtagcccgacttcttaacagaggagatttggcaaagtttagatcaacacctgaatgtttggctccttattgcaacttggatgaacaaactgaattgggaaattaagtgtggtggggaaggcggaccttcagccaatactaaatattaaactgaattaaaccgaattttgaagtgccaagaagaatctccttagtcctttgttatttatcttttactgaggtctcagtgttgtatttcctgctgggattaaaagagaatggctgagagaagtttctggaggctactcatctgaaaaatccagcgatttaactggcccatggggttcagaaacttggaatcaagttcaacaaaggcactaagtggccaagagcttatcccaaataaatcacagcccccaaacaaggtgttgaaaatctatggcttactctcagttctactgctgatttattcaatgacttattgcacttctctaccctccctcctcaatttcatctctaaagtcaaagtgatgacacctggtacctgtgaaaatgaatgatttcagtggtttcctgtgtgtaagaggctcttcgatccttgccttcaaggctggttgaaatgtggtaggttaagtggatgtgctaagactggctttccatgaggttttctcagcccagcctcagttaacacagaggcttaaaactataggcacaatttacccactttgtcagttcctcagtcaccaattagcaggactaagtcctgagccaaacgggcaagtattgaacacatagaacctcatgggttctcttgacctgtcctttttgtggtcttctctttctgtgcacaccttaaaacaaatggtttcagggagtggccactcccaggagaggacagagttagggtgaagaatggggcagtgagcatcatggggcaatggagcccttttgttcagaagttgccttgtctccctcaaccatcaccctcttcaaagaaccctcatcagaaaggccctcgtacctttctcatttccttcctgtaaagacaagggaattctagaggagaggagagcatcagtgtttactttacagaggagcaaacagagacccagggaggtcaatgactggtcaaggctctgacacctgaggcagaaccacatgggaggtaggcattccgcccccagcctagggccctccacatcccacgccgcttccttcagtgcagggtgatgctgccactgaccaggcttctgagtgtctctgctgtacactccagatgacaagcctgtcatcagcttcaagcagacctcttaatccactgctcagggttggcatggaagggactcttcaaagaaaccagcacattagtgacctgaaatgatctgtgtcccagggctgtcttaaattatttacccaaaagtaaccagtggtttggggcagacttctcactttcctggccatattgtgaagctcctttacaatgcgggaagtaaacagtgtcgaggccaatatactcatacaatatgctctgtgtagacacagagcgaaggctgagaattttctgtaagaaactgcagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtgtcagagaaagagagagtgagaaagaatggaaagggccataagagagggccttcttatttgaggactaaatcattctcagtaggaatttccaggcagcaggttggagtgtcttgggggtgtttcccctgagcagcatgtgtggtcttacactaccaggcagtgttccagggaaaagcttatttcattagaagaggttgggtttgtgactggatatggcgttcaccctttgtgccgtagtgttgcaatgtattgacaagcacactagagaatatttgactcttccagggtggagggtgtttctggaacagtcttgtgggtgttttcataactagccaccctggtctctcattccaaaaaatcaggacagcaggagatcagtgagaccttgaatcatgcctcaccgtgtacctactctgtctctcgatgatgcagagagaagggacactgaccaaaataaggtgactttttggcctgagactgatcttcatatgaaaatgaccagagttttgtgaagttgggttgtatttgtttttaagcagtagctactgtgcccacttgattactcaagctctgtaaaaccccttcccatcattcattcagagctgacctctttctctcactgtgctgatctgcaacagctggggaagggatgggtgttggagatcgggaaggcagaggtctgactctcacatagatatatgcaaggtggaagatttgtggcaaagctaggtgatcgctttgaattccttgatgagcctgatacgaatgaatgcaagccaaaagacaagagatcaggtgccatgtttgaaagcatttctatcaatcagacagataaagggaacagaaatcccccgatgcccaacttgcagcagcctcaattccacagtatcctcctctacactcccacattttccttcctgatagtggcccaggctcatttgcccaatccctgccctggactccagcagcacttgggagtcctctccgcaatgcctcactttctttcatgctaatttggcatgggtgagtcttcacttcccaaccaccctgaagggccttgatggtagacacctggtcccttacatctttattttccaaagtcatcagtttgtttcctgggcatgcagtgagccctcttactaagtggtgttaggctggttagttggttaatgaaaactgccctttgaagaacaatgtaatttagtttcctgctctgggtgatgcctgtcatggaaagcatgaaaccccaaatttcagatccccacttcttcatgttcatgagaagcccctcaaagccctactctatcaaagtagtgagccagtgaaacaggcaaccaaagtgtgtatccagccaatccggatctgagataaggcagactcttttattttattagaagggggcagtagggatatggtggtagttacagtgtcccagccacacccaaagaacttgaatgcagactggggatccaccctggccctaatacagttatttgagagtcagtatttgtagtcaggctgacctgagactgaatccacatgggggcctagaaggaaacagggtcatgggagcacaaaggttgaaagcggaactcgtgtgggtggtaagatcccttcctgacctgcattcttctagaggtttggcccattccactctccctagcccatctcacactcaccaacacacccacccactaaaacagagtcctggaacttcctcttcaagttttccccattgaaaacaaaattctgagtccctggttcctttctcccactctctcctgatgtctgccctgacttcggcagctaggtctgccatcctgtggctgccatttcccctttccagggagctgtggcctctaccctctgccttgggctcctagctcatcattctcccctctgcctcccagaggccggtagctttacccgttggttctcctggtagcatcttacctgccacaccttgcctattctttgctagaactacagggacctaatgagagaaccacattccttcctgctggcctcctaaggaaacaggctgcagtttacctaccaggctcaacagaaaaggaaagtggctggtaaagggcaaagatgcttttgagagagagaaagctcttaatcaaacacagatatcaagaatattagcaaggggactagagaaaattgctatcaaagtaaatggttttttgtacaaatgttccctttatttgtgttttccccagtgtgccattctttctttaaggcttggtgaacagatgtgcttttgaaaatgttgattaacttatcctttttttgacccccttcccactcactcaaactcaggggagcagtgattatataaaaagccaagtcaagccactaaagtgttcttcttcaccttaagtagcctttgattctccaggtgcagaaatctcagctgcatctgggcaattgatttcattgagtcttagaaatgggccaattcttaggaaatcatctcatccagtcctcaacctccagagacaagaggccgtgatctcctgtgataaaatgttctcaaaatcattagcatcattttaccctttttcctttaagatcaatgccacattcacccctttccagccagtgatctatggtatcctaagacttcttccctgagggtgtgagatggagcaagatggcattctagcctccaagaattcatcacatccttggcagaaacaagatccctaaaagcaagcataggatttggcccagaagtcactggcaggagccccgtggttctcatcctaggctgattcacatattcttatccagtgttctgcctcttttactggtgaagatgttaagacatatgagcagcccatcaaaccaattaattgttggaaatgtgacggttttcttccatgttttttttttttttcatatggaaaaaaaccctgtgggttgactttcacaagctcgatttgatccctgtgacaaacaccaccttcctcttgttgattcatgttcacatctcccttccaaggaaacaacctgctctgttggggcctggaggagaatgcagggaatgggcgttgaggtggggaggctggcgtggcctgcaggtgccacttgctgtgctttaaacatgcaaggaatgggctggagttatggaggattagtgccatgtggcatcaatcttttaagtggggtcttggcaagttgttttgtgcatcccttactagggaccgagggggatgagaatgtgctttagcactttggccagaaatgagaaagacttctaacatgattgaaaccatggcctccaggaaaagactgaatttcaaatgtgacagtgatggatcaatgctcagttcagatcatggtcaagtagatcttccccgagatgtagtgctgatgaaggaagctttcgggatggtctaaagttctttttctccctcttgtctgatacttcagccgtttgggattttgattttcttttaagccttgatttttggatttcaatttatagtagtgacttcaagattgtttatctgacttggtggaacaaaactctgagagggccatacacattcactggggctgtcttgagctgacagcttggaaaggcataattagcttgtgagataggaagaaatgataagatgttgctctttgccatgcatttgatgttctctattaatgttttaccattttagacagataactttcagtggttctgatttctataagttggacagcacagtgaatagagagacctgtattatcaccctcccaaattatcatgaaaaagaaaaagatagacagtgataatactggagaaaactcatagtaaattaacttagcctggctagtcagattggatgcccatctttgatctattctaaaccacgaagaaagctaataggaaaaatagacttgggaaggatgagaaatattagcacagatatgtgaaggtcaacaggcattatgacatgccttccatttctgctcttaaattaaaacatataatgatgaaacaagacttccttaaactaccatatgtttacatgaaatccagaggagaaagactctgatgcttttgtgcccactgagatgcgtgcctatgaagaggtgcagcatgatacactaaatggacatcccagtaaaggcagctgctgttgggcataagatgccattgaaggtgccttaaatgaaacctgtgttcctaatgaatgccagtcattaaaaaggcacagtggcaggggttgcttggcactgaagacccagagtttcttcttagttctgtgttactggttgtggttggaggaagacacaggtcatctgaaggagaacaatccagtaatgtccataatgaatgatctagaagtagaggtgattctctagctgcctgccagaatggggagtcattctcgtaaagattgcctccctgccttttagccatggtgatagaacttgttattaacttgtttttattttctttatattatagtggacatcccagaaatacatgagagagaaggatatgaagatgaaattgatggtgagtactgttatgatttagcaggtaatcgtaaaattcaagtttggttataaaggtgtcaacaaaaataatgctctgggtatcggagggcccaaatctagaactatcagtcagaaatatataaaagaatctggagaaaaatgagggaaccatcaatggatctgtcagggtcaactttagaggtttagaaagtttattgagttcctctgcctaatctgaaacagatcccctctttccagtaactttttacctggatggactttgaatctgaataaaccctttacaagtgaaagatcagctcctccatacgtgtcatagtctgaatcttttgaccttctcccaaaaatggcctgagtgaatgagcataatgtgaatattctcccagacctgctgtggtttctggttccctggcttgggggaaaccttcctcacactattcaagattccaatttggagcttcttgcaagatttcggtttctttttcacactgaccatctcgtatctttatatttattccaagttctatttttccactgcaaacacatatacttcaagaggctagagggctgctgagcaaatatgtagatgtaatttcttccctcaactcagaatagcacaggtctctctctgggcttctctgagtaccagagttgatctccaacagactcaacagcaagattccacttaaagaataactgtagactaagattgatgaatttaagaggaacagtttatagagcagctgcttttaacctgcctttaatcagaaacttcatgcgtagttatagaaactggagtgactaacccaaacagcaccttgttaactgactgcagactctccctgcaaaacccagtccaacactccttttatgggcaaaagtgcatgaccaacctacatggagagaccgcagtagatcaggcagaggcgcactggaatggagtagaaagggcaatgggtaaggaggcagaaagcctgatctccattcctgctttaactgcttgctaagcctgtgacctggagtgagttacctagttgcctaatttctttaaacctcagtttcctcacctattaaaatatatataatatcctgccttcttcatgggattattaggatatttcaaaaaatgatgcccagatgtgggcatgccttggccacagtgtagaaacgtaattagattagtctgctagggcttccagaacagagcaccactgactgggtggcttacaacagacatatattttctcacagttctggaggctagaaatgtaagatcaacatgtggacagggttggttccttctgagggctgtaagaaaggatctattctagctctgtctccttggcttggagatggccattctcctgttcatacgatgttctctcatgtgtgtgtctcagaatttcccctttttctaaggataccacttttatcggataaaggtccaccctcatgaccttattttaacttgataacatctgtaaaggccttatctccaaataaggtggtgagggttaggacttcaatatgaatttaagtgtctgggagggggatacagttcaaccagtaacaataaggcacgatgccttattattaaaggaggtctgatggctgggaaaaatctgctgcttatatggccaggaataccaaattaggaaactcatcatgtgcaaatagtcccagactgtcctttcattagcttgaggaggttggaaaggagggatgtagaggttgccttgaacacaaggccatcctaggtgctgtaaagccaccccaaaggtgctgttaaaatcagagcttacctaatgtaagtcaaattatttatttatttatttatttttttggagacggagtctcgctctgtcacccaggctggagtgcagtggcgcaatctcggctcactgcaagctctgcctcccaggttcacgccattctcctgcctcagcctcccaagtagctgggactacaggcgcccgccaccacgcccggctaattttttgtatttttagtagagacggggtttcaccgtgttagccaggatggtctcgatctcttgacctcgtgatctgcccgcctcggcctcccaaagtgctgggattacaggcgtgagccaccgcgcccggcctcaaattatttaaatatcggatacttagtacttactatgttgcagacaccaagcactttacaaatattagttcatgtaatcctcctaacaacccagttgaggcagattttactattatccccatttcaaagaggagaaaactgaagcaaagagaggttcaatagcttgcccaaagttacacagctaggatgcggccaggctgggctttgaacccaggcagtctaattccagagctgctgctgctaactactgtgctctgaagagcctctgggctggggaggctcagtcacttcaccctgacataggcagtgcctgcaatctctcatgaattttatgtatcgcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagat

SEQ ID NO: 38526 - DNA, 23245 bp, Homo sapiens
gagtctgcggccgccaggaagcccagattcgagtgtccggagagtaaccggaagtgctgtccccaggcctaggggcggcgccggcggctgccagggtaagcgcggcctgcggggcccaggggtgggatgggtgcgcggtgggacccaagacccacggccacagtcgagtgggagcagcccctgttcctggacactgagcatggtctggtctccgctgacggcggacggaggactgaaagatggtcaatgaaaagttgaaagaagagaaccttagtacggtagttcctagagatagtaaacactgcaaggcacttttcaaagcaatataatctttcatatatatcgaggaaaaaaaggaccttgaatggatttttcgcttcatcttcagtgcagaaattagttatgttgcagttgaatctatctgcagaaaaatctggtttgtttaatcttcctataaccatttctttttggaaaatggaattacagataactttatattatatacacttatcacatgcactttggggtttgtagtggtagacgaatgggtctttgatcttaggagttgagataatacaaacaaaaacaattagcagaaggagaaaaaacaaacgaaaaacgaggcttagggctttgttatgaagttacagttagtaatagaaagattcttgacattttgtctagagctggtcggaactgatggctaccagtggcaggtacttcctgcaggagaaacagtgtaagcaaagatgggaagaggtaagctatggttgaaggatgctcactagaatggagaggaaatgggaccagttttctaggccagctctagaaaaattatgaattataaatttcacaaggtcatcgtctacattattgatttttcctctaggagaggcaagaattgagtgttgtgaatagttctgaactagagaccttttgaaaccaaaaggaagatggtcttgagtctttcttgttacggtaagtggtataccaggctctgtttctgtataaatgtggatgggggtgtggggtggggcagggtgaaagacaggaaagtatgggagaagatatatggaaaaagagaatgcccctttcttagctcctaagatagcagagtgataaaactgagccctatcctaccaacttaaggctattttctactccttttcaacatgcatgcatattcacattaggcttgcagtaattgctttttgattgatttgtagcacaaagagggtagtatgcctaatgcttaggcaggctctggagtcagaagataggtattgaaatcctggctctgctgcttactatttgtaagttgttgggtgattatctaactgccctaagcatcaggttttccatctataagatccaaacactggtattaatacctatttcatagggtccttgggaggactaaatgagataatccatgtaatcaatgaaaaataaatgagaaatttccaagtctaaggcctataaacaccatctaatttttaaataatgctttactaactttgtctcttggtcccatataccctttaaggataaccatgaactctcaagttgtatgaattagcctgtctgcttggacttttgtcgtgttccagtttattcctttcacttcgaccctaggcaggaaagagtactagtctcttcctaggatggggcaagagaagcatcctgaaggagggtaccctggagctaagacttgaaagatgtatttgggcttgctagatgaaccagccagggctactggtctagtctgttatacagctactgggggtccaaggataatgattgcctttttgttctggtatttgttcacacttttcatttattcaacaaatgtactctaggtagtagggatattacagtaagcaaaagactaagtcctaaccctaatagaagttatattttagtaaaaagacaaacgaataaatataaaatgtataccataaagttgaatggtgataagtgctgtggagagaaataaaatgtgataaagcaacacaggctattttagataaggtagtcagggtatgctgctttttgaggaagtgatcttcaggcagagacttgagtccaataaaggagtaagctgcatggggaagagcattctaggcagaaggaacaagtgcaaaagctcggagatggcctgtgaggctgaagataacgcagaggtgccacattatgtagagcagtaaaaactttggattttattctgagtgtgctagaaaacagtattttaaattagggaagtgtcgtgatttttttttttttttgagatggagtcttcgctctgtcatccaggctggagtgcagtggcacaatctcagctcactgcaagctctgcctcccaggttcacaccattcttctgcctcagccttccaagtagctgggactacaggcgcccgccaccacacctggctaatttttttgtactttttagcagagacggggtttcaccgtgttagccaggatggtctcaatctcctgaccttgtgatccgccagcctcggcttcccgaagtgctcggattacaggcatgagccaccacgcccggccttatgatctgttttgaggtttgacacccagacttattttttaggtgttgacatctaaaaaaagcttggatatgaataggaaaattatttccttatttattcagttttttttttcttcttcttaatgccccacacttcattggttgtttagggcaaataagacatcttggactgataactttagggaataatgtaaatgatttgcctggctgtgacaaaactaagaatcctttattttcactctattctccttttgagcttaacactaatacaaattttaaaagacaaaaccttttatgaaccccccatcttataacagctatttgtctgtatcccggcatatctttacttagttgtgattctgagttggaattcttccttttccttctaatatttctccataatttttttctagtttttgcataatcttcatattaatcattaactggccaaattgttttattagttattgcaagtgggttttgaacaaggctttgcacaagaatcaggcatagaaaatgggcttaatacatgttagtggttttgtgcatgtgaaggtagaattaagaaaataatagaatctaccatttattaagcatctactgagacctaggcattgagcttagtaccggcagtgtctttgttctcatagcaactctgtgaggaaaaaagagaatattgaagttgaaggaaattaagttactaacccaagttctcacagctacaaaggaggagagtgggaatttgaaccaaaatctgcatccagagcttaaactgtcagtattaaccaccaaaataaaccaatctttagccaccatgttttttgaaaaccaaaataaaataccttttaattttgaataagtacagatatacaaaaaattgcaaaatggtacaaagaactcccatatacccttcactcatatgctctaaatgttaacattttaccatgtttgctttatgattttgcctctgtctattaaacaaacgttttagtctgttttgggctgctataacagaataccatagactgagtaatttataatgaacagaaatttattggctcatgattctggagattcgaaagtccaagacgggggctggcatctagtgagagccttcttgctgtgtcatttcatggcaaaagggcaaagagagggtgagagcaagcaagagtgctcagaaagggaccaaactcatctttttgtgaggaaccgactcctgaaataatggcattagtctatgagggtggtgcccctgttacctacatacctcccattaggatctgtttcccgacatcattgaattggggatgaagtttccaatgcattaactttggaggacacattcaaagcatagcaatacacatatacatatgtatagatttttccctgagccatttgagaataaattgtagacatgtctcttctcaaacagagaatcaagccatggaatcctgctctcctatgcatgtacagtactgctagctacatgccatccctaggagaactgagaaaacagtcattcgaatacattttctttggggacttcttttctagaaccctaattgagaaagcctgtcctaaatattcagttgtatatttactaaaaacaaggatattctctagaaattatcattaccattatcggagtcaggaaattaacattcatacaataagtactattatctaatctccagaccttattcaaacttagccaattgctccactcatgttgtttaagacaaaaagaaaaaaatgttttctgtggaccaagatctaattcagcatcagtcatttaatttaattataatgttgtccctattgtgaacatatcttcagactttgtctttcatacctttgacattttttgaatatttaggccatttatttggtagtttccctcagtttgggtttttctgatgttccctcgtgatcagattcagtttagacatttttggcaagataccgcagaagtgatgttatgtttttctctttgcatcatattaggaggctcatgatgttttatctcattactggtcatgttcactttagttgaggataccattaggttaaggtggtgtcttccaggtttctatactgtgaagttactctttttatatttataattattaaatatctagtggggagatattttcagattatgtaaatatcttgattctcataaaatttttcatccagtagatttttgcacagtactcttcttttgattgaacatcgtgaaatttttaattccatcatttcttctatatttgtttgcttttctaatgcaaaaaaactttcccttctatacacttttttttaatgagtacaaattcatggattcttattgtgtgactaatttattactgttattacttatttcaatgttctgcttgttccagatttgtacagtggcagtccttccatcctgaattgtgggtccttctggcatattgcaccactttttgagcacttccttactttctgacacatcaggatggtccaggcttatcttatactttccaaaccgtggaaacagccatttctccaaagagtcttgattcttttcaatgtagaatggtatttagaaacccatgtctgaatgcttggtatactcattactactaggattttattgtttccatgacttctcagcaaacattactaggaaaaaaaaataaacatacgtaatttcacacatatatacgtttctttattctctatataaaccttaaaatcttgacttatactggtacttctaattccagttaaacactacagagttcattctagcctttctcttttctgtttgtagccttcttcattgacaatggggaatctaggtgacattatccatagtatatttacttatttattcggtcctaggatacacattaagtagtgtacccttatcccaacaggggagaaaatctgtactgattcgagttatttttatctttagattgaatatacatagtcccaatattgtgttagagttatttttttttctcttctgtgtagttgttatttatttgaaacacaggcgcatttgtttttatgcttttctcttccatcttgactatttagttcattagttcattcatgtattgaatatgtaaaatgtaacataattctaaaagtaaaaatatgtgtgctgtgtattcatattctcagagaaatgtgactcttctcctccacccaattctgttttcctgtgccatcaattccatttttatctgccttgtaatgataaccaatctcattagtttcttgttttttggggcaagtggagaactacatatataattttttatttttactttcttacataaaatacaacatacttttttacactttgcttttttaaatttataatttatcctggaaatcactccacatcagttgataaagattttcctcattctcttttacagttgcatagtactccattatgtgtggatgtatgtaccatagtttattcaccattttcttacatacagatatttattttaaatattttcccgttacaaacattactatgagtaattttatgctttatattttcatgttattggaggtgaatcttcagagtccatttctagaaatgggattgctgagtcaaaagtaaatgtatatctagttttgttacatattgccacattcccctccggacgagattgtacccatatgcattccctccagcaacgtatgagtttgtttgtttccttacagtgttgaccgcaaaatgcattgtcatgccttttaatgtatactgatttaattggtgatactggtatttcatgtacttttaaaaaattatttctttttttatagacttaccagtttgcattccctccagcaacatatgagtgtgtctgtttccttacagtgtcgacaacaaaatgcattgtcataccttttaatatatgcagatttaattggtgagaactggtatttcatgtacatttaaaaaattatttcattttttatagactttattttttagagaactgttaggttcatagcaaaactgagcaaaaaatacagagagtacccatatgtcccctaccactctctttaccctgacacatgcacataccacacacatagcacacacagcatcccccgctgttaatctcttcaacagagtgatacatttcttacaatcagtgaacttaagttgatacatcattgccacccaaactccataggttacattagggttcactctttatgttgtacattctatggggtatctacaattttttttttttttttgagacggagtttcactcttgttgcccaggctggagtgcaatggtgcgatctcagctcactgcaacctctgcctcccaggttcaagtgattctccttcttcagcctccctagtagctggaattacaggctcctgctaccaggctcagctaattttttgtatttttagtagagaaggggtttcactatgttggccaggctgatctcgaactcctcacttcaggtgatccacccgcctcagcctcccaaagtgctgggattgcaggcatgagccaccatgcctggcttgacttgccagtttttttaaactggtttgttttcttgttgagttttaagggtatatgtatatttttgtatattttggagatttttaaatgtttggaataacagtctttaatcagatgtgtcttctgcaaatattttctcccagtctgtggcttgtcttctcattctctagacagtttatttcatagagcagacatttttaattttaaagtccagcttatcaattttcctccatggatcatacctttgttgttgtatctaaaaagtcattgccagcacaggcatggtggctcacgcttataatcctagcactatgggaggccaaggtaggcagatcagttgagctcaggagttcaataccagcctgggcaacatggtaaaacccatgtctctaccaaaaatagaaaaaattagcctggagtagtgacacatgcctgtggtcccagctactcaggaggctgaggtgggaggaccacttgatcctgggaggcggagattgcagtaagttgagatcgcaccactgcactccagcctgggacacagagcgagacccatcccaaaaatataaagtcattgctatacccgagtttatctagattttctcctatgttatcctctagaagttttatagttttgtgttttatacttaggtatctgattcatttggggtttgtaaattttttttaattgagaagtaagtatgtatgtatttatgatgtagaacatgatgtctcaatatatgtatacattgtggactggctaaatcaagctatttaacatatattacctcacataccatttcttgtggtgagaacataaaatctactgtcagcaattttcaaatatgcaatgtatttttattaggcatgatgtagaactctagaacttacctacagtacaactctagaacttattcctcctgtttaactgaaattttgtatcctttgaccaatttcttcccaaccctgctatgtctcagcctctggtaaccaccattttaccatctgtttctatcagttagactgttttatactccatatgtaagtgaggttatgtggtattcatcattctgtgtctgtcttatttcacttaacataatgtcctccaagttcatttatgttgatgcaaatgagagaattttattctttttttttttttttgcatgtgaatgtctagttacttcagcaccatttgttgaaaagactgtctttttctgccttgtatttattgcctttgttcctttatcatggatcagctgactctatttatatgggtatatttttggactctattctgttccatttatctatttgtctgttttttcaccattaccacactttcttgattactatagctttagtcttgtaacttcaaatagtatagtaagtgttgaagttaggtagcatcagtcctccaactttgttcctgcccttcagcattatgatcgctaatctaggtcttttacctcttcatataaactttgtatcagtatgtcaatattcacaagataatttgctgggattgtgttgaatctgtagtacaagttgggaagaactgactatttgacaatattgaatcttcttatccatggatgtggaatatccctccatttatttagttctcttttttatttcttagagttttcaaattttctttgcataaattatgaacatatttggttagatttatacttaagatgttttattttttagagtgttaatgtaaatggtattgtgtttttaatttcaaattttacttgttcattgctggtatagaggaaaataattgatttgtatgttaaccctgtattgtacaaccttaactgtaatcacttcctagtcccaggagttttttgtcaatgattttttcagatttttacatatatggtcatgtcacttacaaagacagttttatttcttccttcctaatctctataccttttatttccttttcttgtcttgtagcattatctctctattccagtattatgttgaaaagcagtggtgagagagaacattcttaccttgttcctgatgttagctgaaagcttctaagttttcaccattaagtatgatgttagcagtggttttcttgtagatgtgctttatcaacttgaagaagtttctctttgttcctagtaatatcacttattttaatttgcatttctctaattatgagattgaacagcttctcatatatttaagggacatttttatattttgtgtgtgtgagaattgtcttttgcttatttttctatcagatgtttgtcgttttccctcaatttttaagagatctttatatattaggtatattgtccctgtatctcaaatattgttacaaatattttctcttagtttgcccattgaccgttgactttgttcattttttatatatataaaatgtttttggctggcacagtggcgcacgcctgtaatcccagcactttgggaggctgaggcgggcagatcacctgaggtcgggagttcgagatcaacctgaccaacatggagagaccccgtctctactaaaaatacagaattagccaggcatggtggtgcatgcctgcaatcccagctactcaggaggctgaggcaggagaatcacttgaactcaggaggcagaggttgtggtgagccaagatcacgccattgcactccagtctgggcaacaagagcgaaactcagtctcaaaaaaaaaaaaaaaaaaatatatatatatatatatatatatatacacacacacacacacacacacacacacacacacacacatatgtatgtatatataaaagaaaactttaaaaaaagtttttatttttagtcaaatgatcagtcttacagatagaaaatttttggtaccctaagattaatgtagaatttactttagttttcttgtagtatcttatcatttccatgtatacatttagaaccctaaccaattgggagtttatattggtgtgtggtatgaagtgtagaccaaattgtacctattttcatgtggctaccttgatgttttaccatcatttattaaaaagtccatttttgccctggtgatttgagatgtcatctttattgtatactaaatttctatatgtgtttatttctggatttccttttctatttgtccctttatctaattgtgttttggaactctgttgttttaatattagaagctttaaagtttattttaatgtctcatgggtttagttacccttcatagtctgtcttttcattgcttcatggctgtccttgttggtcttttcaaagtgaacttgagtagcaactgtacagcttaggcattggagatttttctttaaagggccagaaagtattgtatttaggctttggtggctatctggtctctattgtgactactcaattctgcctttcaatacattaatgaataagtatgaccctatttcagtaaaattttatttgaaaaaaacaggtggcaggccagaattggcctgtgggccatagtttgccaccccttagtctagtttcataaagaagcttgttatttttattgagattgcattgtttataaatcttaggagggaacatcttcataatgttgaattgttctatgcaagaacaaaggctgtccttccatttattcgagtctatttttgggtctcaggagggagaagttttcctatgctttatttggcatggctatgttttatttatttctaagtagttttatattgctgctgttatacaaaggttgttctctatcattgtgtgttccaattagttattctttatatttatgtaaaaaactggtggtttctgtgtggcaaattttatatcctgctaccatactgaattcctttatcatttgagttagttttagcattggtcctttgtagggttttctaattctactattaaatcacctccaaatagagatagttttacttctttcacacctctaattgatttttctaattgcattgattaatacttccaggtcagtgattgaaaagagaagtattggccatacttgccttgttcctgatcttagtaaaaattattgtagtttttctaacttaaggtactggatgaaggaatgtatgttttatcatattaaaaggaaatatctattaatttccactttcttgagtgtttttatccagaatagatgttgatttctgttgcaggttctttcactatctatggagataatatattatttttctccataggtctgttcatatggggtattatatttagtggatttcctcatattgaaagatagtctaattttgaaccaattttgcaaaaattccacttggtcatggtatattattttcttaatgtggtattgatttttgttagtatttctcacattcataaaaaatgttagccaggcatggtggtgtgtacctataccccagctattcaggaggctgagccaggagaattgcttgagcctaggagcttgaggctacagtgggctatgattgtgccactgctctccagcctgggtatcagagcaagaccccgactctttaaaaaaaaaaaaaaaagcgatattggatattaaaatttttttatgctctcttcatcaggtttagttaccagtgctatccttatttcacaaaaagaattaggaagttgtgcttcattttcggtgctctggaaaatatgtatgaagcattgtatttatttggtctgtgtagatttatagaattatttcgtgaaataatctgggcctagtgctttttatggaatggttcctttataactttttctatttattctctgcaaattggtgttttaagactttatatctttaatggagtcaactctaataaattgtgtttcataaagaaacccttattttatagttaatcatatttatttatatagagatttgcaaagtggtttcatgtatgtgtgtttttcttttcggtggttattcttccttgtcatttcttattttgtaaatgtgtgctttcttcctttttttcaattaagtaacctagtggtttatctgtttctttaagttttacaaaataagtatgattttgatttatcattagatttactgtctttttgttctctagttcattgatttctccttttatctatttttgttattattttgattttttttcccattaaaaaacaaaatagagacaggatcttgctatgttgtccaggctggtcttgaactcctgggttcaaacaatcctactgcctcggcctcccaaagcactgggattgtaggtatgagctaccatacctacttatttatttaaaatagaaattgggtctcattaatattgcccaggctggtcttgaactcctgggctcaattgaaatttatttttttcttagcttttgatctaagaatttaacttgttcatttaaattcttctgtttttattgattaaagaaatataggcatgaactggtttaaatttatcccatagattgtaatatataatattttcaattatgaatacttaaaaattttgttaactttttcattgccccttttactgaatagttttttaacagtttattttccccccatttgaaaggacctttggtcgcttgatattttaataaatttctagttttgttgcagattgtttcttgtaatgtttctttgcgataatgatgcttcctttattacataatatatgacagatttttgtggatgattcatgtgttcttaaaaagaatgtgtacttatcaggacatacggtttaatataaataagatttacttattaattaggttatttaggccttctgcatcattacttcttggtccagtttgtatgtcttttattgagagtggtatattaagctttcctattattaatatttttatctctgtttctttgtatctgtttctctgtttttcctttgtaaatgtgcctgctgtgtaatgtgatacatagataaccatgactttagtgtaatttagaaagtattattatgtttaattcttttggcttgaactctactttgcctgatatcaggatcaaaagccctacttttattgtttctgtttgcctagtgttccttttcccacctccttatttttagcctgcctgaatcactttgctttaggtgtctcttgtatttagcatatagttaggtcttgcttgtgagccaaaatgaaaatctctttcttttaataggtgtgttaagctcatttatatttattgatatagttgatgtttggttttaacaatgtcatattgttataactgtattttgttacttttttttctacgataggttttcatagctctttcatgactttctgttttgaatgtttgatttttgttatattagctacttttgtacttagatttatttatttatttatttatttatttatttatttatttattttgaggcggagtttcgctgttgttgcccaggctggagtgcaatggcctgatcttggctcaccgcaacctccacctcctgggttcaagtgattctcctgcctcagcctcccaagtagctgggattacagggatgtgccaccacacccggctaattttgtatttttagtagagacagggtttctccatgttggtcaggctggtctcgaactcccgacctcatatgatccgcctgcctcggtctcccaaagtgcggggattacaggcgtgagccaccgcacctgaccatacttagatcttttttaatgcctttagttcattaaaaaaataaatttttatatttaacctttaattatttggtttttaagggtttctaaaatttttcttttctaaaaggccatttcagcttcagatggttttttagtttaatagtgtactttaattctcacctgccataaatacaatatagtaatcccaccttatttgtgggggatatggtccaagactcccagtgtataccagaaactgcagatagtattgaaccctaaatggcttttttttttctatacatacttactgtgataaagttttttgtacttagagtgggtttttctttctggcaatgaattttaggtcagtcttgcccactgctagctctcttctctttacctctcattctcagattgtccttgctctccttgatagcttatggctagaatgtgagagacagctatatgggatttggtgacagtgtgggctttgtatagtacatttgttcttcttattcttactgcttttaaaggatgtgttgagagatttggatttctgtagccactgttatcccctctgactgtgttttattaccacattctttatatttcctctagagatattttccttttttttttcatatttaagtcagttttctgtccactgacttccatggccaattttaaataattggtgtgcaaacaccgcatgttctcacttataagtgggagctgaacaatgtgaacagttagacacagggaggggaacaacacacactgggactgtagcaaggtgcggggggagggagaacatcaggaaaaatagctaatgcatggtgggcttaataactaggtgatgggttgataggtatagcacatgtttacataggcacacatttacctatgtaacaaaactgcacatcccgcacaggtaccctggaacttaaaataaaaataaataaataaatagataaataaataaatggtgtgaaaacttacaggttttctgagaagtctcagttgacaattacgttttacaacttccctcacttctatatttagggctacaccgagcttaggccccatactgaagaggaccaaaagggggaaaaaaaagaaataaaatcactgctggttgaatggcatttaaaattctgctctttcctgacttgcatgctatgtgctttttggagttgtcaaataactgggccatacattctgtccagacttcatagttggattcaatgggatgacatctgtgacatgtatttactccatcttacctggaactagagccataaaacatgtcattttaatactagcagctataagctaagtgtcatagagagcctcagctgtatggccctatatgttgcctgggtccaagtagttccatttttgcttctgatcctcagtagcaggaaggttgttgagggaactgcaagtcccattaacctaaggataaggcaggttaaaacttctagagaaagacatcaatggttaagtgtggactctctaacttctttttgtgcccctaattgaccacctcctgggttgtttgtggttgaaatataaatcagcttagggtgttataaattttgaattaccaaaattgtgatgattacgtgggttgcagtggtggtaaggtggtaattttgttataatcccaaaaatactttgtagtccctattacactttggatcaggacagcctgagttcctgtagggaagataatgccttcgtgttttcaagataccaccaagatttagtgttaggagccctttccttcaatgttgttatagttgcaaaggaagctatagattgtgcagatgggttatagattctgtattgtccttttctctaaagagtcatatgggatgatttaagactctacagaattgaatttaagggattagataagaaaacccatctgttctttttaactgtagtttacccattgttaaatcctttgagtgtaaatgatctagtgctaaattctctcatttatggctttttatccttgtctttgtgttttacagaatgctatcttctttgagaagtcaaattgtcaggatcaggaatgtatgttttcttccatctggattctaggtaagctgcagttacttcagtattttgaagtatcccttctctttcccagactccatctcatcagagtacctcccattctttgtgacattcagtccttttatcagacaaggagagaagtagaatttcaatgagaattcatacatgtactcagcagatgcttattaagcaccaactttgtacctggcattactgtatatggtaaggaaagataaaacagacatccttgtcatattttagcaatagacaataaactgaataaagtgaattatatagtatgttagaaggttttaagtgccatgaagaaaagtaaagcagaaaaggggaatagtgaatgctggggcatgaagactattcacaactttaaacagagtggttaggaaaggccttcctcagaattgacatctgaaaaaatagtctttgaaggaattaagagaaattcatacacacatctggaggaagaaagctgtaggcagaagaaagaaagggcaaaggccctaaggatagtatgtttggatgaggaacagctaggaagccattgcggctggattagaacatgcaaagagaagaataatataaaagggtgtcagagaggcagtgacaggctagcagggcagctcaagtgggcctcttgggctattgtgaaagtaagaaataagagtggtttggactggaatgtaacaacagaagctggtgagaagtggttagactctggatgtgttttgaaatggagccaacaaatttgctgatggcttgattgtgaggtgtgagaaagaagagtgcaggatgacttcaaggttttagcctgaggaaataaaggatgaacttgccataaactgagatgaggcaggtgataggtggagtagatctggaatccagccccagtataagtcctttgctcacttcctttgactataaggcaaaaacagatacttgccatttagctctgtaaactgaatttaataaaagaaaataggagtaatgcttgtgatacgttaggctttgaggattgagattatgacggtgacagagtatactgtggacttgtagtctaaggagttctgtgataccgtgaaagtcacctgaaagatgtaatttggaccaaaaaaaagtaatttctaggacagttcatagatcatggagatatgctcaaatatttctgaagggggcctacccctccacacctgtgggtatttcttgcaaggtcctgtgggtaaggtggagacgagagactgagaaaagaagacaaagagagacaaagacagagacaaaatatagaggaagaaaagtgggcccaggggaccggcgctcagcaagtgaggacctgcaccagcactggtatctgagttccctcagtatttattgatcactctctcactatcttggtgagggggatgtggcaggactataaggtaatggtggggagagggtcagcaggaaaacatgtgagcaaaggactctgtgtcataaataagtttaaggaaaggtgctgtgcctggatgtgcacataggccagatttatgtttgactttacacaaacatctcagtgcagtgaagagcagtattgcctccagcatgtctcacctccagccataaggcggttttctcctatccaagtaaatagaatgtacaatcgggttttacaccgagacattccattcccagggatgagcaggagacagatgccttcctcttatctcaactgcaaagaggccttcttctttcactaatcctcctcagcacagaccctttacgggtgtcgggctaggggacggtaagatctttcccttcccacgaggccatatctcaggctgtctcagtgaggggaaatcttggacaatacccaggctttcttgggcagaggtccctgcggccttccacagtgcattgtgtccctgggtacttgagactggagaatagcaatgacttttaccaagcatactgcttgcaaacacatttttaccaaggcacatcctgcacagccctaaatccattaaaccttgagtcaatactgcacatgtttctgcgagcacagggctggggctagagttacagattaacagcacctcaaggcagaagaatttttctgagtacagatcaaaatggagtttcttatgtcttcctttttctacatagacacagtaacagtctgatctctctttcccccacatatttgaaatgtaggattttaatcactgtatttagcataaacatgtctgttttgtttagcttgtctacttcagttttgacttccctattcttgttagccttgcagtgcatttttctcccattatgtcccgcggtggtcacaatactacatttcttgtggatctgtgttttgactctgaagaaattgcactactcccacctcattcagttctttctcctatccctttaagttttagaacagttctgagttgacatttgaaatcttggtatatctttttatatttataaataacttttacttactacaataaaattgagtaaaagtagcagcctctgtgcctttcgcaaggaaagcatacaaattgctgaatggaaattagaaaactgttgttaacaaattgatgaaacagaatgttatgtatcatctcattacccagaggtaaccatgttagtaccatgtgttttggatccttttgacttcctgttttctctgagtgcacatgttcctttgtgttctggtccattacacttactaatttgctgtattcagtgagctttaatatcatttcctttacaaataggctccaatctaatatctagtttcttggattctggacctttttgataatttaagaaaccgtgtaccttctccccagaaaagtgcacatatactgtacattttgcagtcaaagttttcataaattacctgggagtctgtggatgccaagtaagaactcctcttctaggtttgagtgcctactctgtgccaggcacttttctgagtgctggggaaacaatagtgaatgaagtgagccaaaaatccctgtcttttaggggcttacattctatggagaaaaacaaaataggaaaggagaggagtgttgtttttgtgagtcagctgggacggagatgtggtacagtttagaatagggtggttggaaatgacttcactgagaatatgcctgttgagcaaagatgtgaatgaggtgagagagagagccttgaagattcctggaggaagagcccttcatccaggaagagatatcaaggataaagaccctgaaatgggagtgagtctggcttgtttgaacaacagcaaagactcagggtgactggagtgcaatgagtaagtagaggaagagcagagaaatggatcagagtagtaactacgagtcagatttcttaagagcttgtaggtttctaacagaagcagttttggtggagtagtgagggttgattgtttaattggagtatgttccagaaaccttggaagacagaattggagacaatgagcaggtttatttatttcaaagcgttttactgcggagaggaacagagaaatgggacaacagcctgagtgtgaggcagttgagaggtttttcttgttgattgtgcttttgtttttgagaagagaaataatattggaatggtccaatacgaaggaataaattgataatgcaggagagggagggtggaattgctagagtgatgtccttgtgaacaaagggggtatacagatggaaaggctatccttagattgagcaaggaagtttgtcatccctggtagctgaaggaaagatgcagtacgtgaccacacttacaagaggttggttgatgtggtgggggcatgtggaaaggattttggtttttgtgtatgtgttgttgttttgcttgcttgcttccattttcttggtaaaataggaagcaaaattatcaggttatactctttaggtgacagacgaggggtctgaatgtatgagggagggtcaaacatgaaaagatcactgaagagagttaagtgtgaaggatatggaaaatggctttttttcttccttttatttctgttctttagtctatttttggtaattgataaatgcattgacttattactccctctgaactctcttgtatcaacctaacttttttttaagatacttgatcctttaggtgtttctgtatgtgtacatacctctaaaccacagaatgaggaggaaaaaacttttttttacaacttttcaccatgtaaagaaaagcctgttataaaatctatgttccaagcctagacttgtatctataatcagtcaggatttttctttttgagcaagttatgtgcttatataatcatatcaaagcagaatcttaagcccctttgtcataataacagtgatagtaagagccaaaacagagggcttaccaggagattcatagcgatttaatattccacagaaccgtgtaaggtagtttctattattaatccactttacagatgaggaaacgaggcatacagtggttaagaaacttgcctgatatcaccactacgaattagagtcatagaaaccttacttttctctctggtcacttggaattctaatgatcattaactactttcttccaagctttctgcagaaaggactccagagatactcattcactgtcccttttgatttgctttcttcatgagcaggcataataattattagtcttgtcttgatttctcaactgaagcaaggaaagatgaagagctcttgtttaaaattacccagattcatagagaaaagagttcttacttgcagtttcccatatgtattgctgatcagttttatattagcaaagagtaaaagtaaataactgatttcaagccatataaaacctagaagacttagggactctgatacagagtttgtcttttctgcagtgattttaattttgagaattcttttcttagtcataggaatataaataatatttctactttgtctcacagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaacctt

SEQ ID NO: 38527 - DNA, 7687 bp, Homo sapiens
ggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtagggtggaaaagaggcggtgaggtccccagggagcttccggggtcgaggggcgcggctgatcggtttcccccgccgctcacaggtggggacgctgcacaaatcgctggttcgtgccgaggcggccgcactgagtacgcagtgccgcgaggcgagcggcctgagcgccgacagcctggcgcgggcagagccgctggacaaggtgctgcagcaggtgagcgccggggtgggtggcggcatggcctggacgtgaggacatttctgggcgggattggcggccggaggctaggcctggcgtgccgcaaccaaccggtccaggcggcaggactgggctcttgtttgaaactttgagcgactctcgcgtgtgcgtgcccctttcatccgcgcgtgccagccattcccctgggctccttacttttcaaccattgcaggaacctactcctaccgaagggatcgggacgcaggctttgggatccatccccagttcccgcccggggagcgaggccgagacgcctttgggagacctgctgggtcaggtctccctgagccgcagccggaagcgaaaggggtcgaggggcccatataggtcacctgtccttgcggcccgcgtcttcggcctgcttgggagctgctggagcggaggcgtagggcggtgtcggccctagaggtagacgccgccaggtgtaaactgctcgtctaggcctgtcccggccggctggccaggcgtgggcgctgtcccggcctggcctgggggactatctgcctgctgagtgcaaaggcctggggtgcctcctgccctagctgaagtgggaggtggtttccattgctgttttcttttccttatcttcactacggcgctcattctatgtctgactcttgagtgtaattagtgtaagtcctttttatacactcacgttctttcatcttccaacaactcttgtggttcctgatgaggaggcaccacgatgatgattccttgtctgttccagaagggctcccggcccttcacttggggagtttgctggaggagagctgggttgccttgctctgtcagccccaagttgtaaagtgtcacagaattggcagggagggttcgtgggtcactgattagtgtttatacttctccagcaaggatggaggctgggggagggctgggcagcctcaggagtgccaccccctctatgagcaaacagctcagtgccagccggtcaataggatgtgggtcaaagctcatgctgcccctgatgtccaagtgtggagctctgtccttggagtttctctgcccctcggttggtcagacctggaggcggggctgccattgaccatgagccttctgggcctcaggcaggcctgggcctcccccacctgtctgagggtggtacccggtcaaagacaggtttaacctgctttgccccgccccttcccacctgcttgtcccactccaggtgtttgctctggccccactccaaactcctggagtgtgtgtgttgagggcttcggttatatgtgattgccctcatttggcctggaggaggtgacagtggactggaacagggttggggggtgaggggaagggacatagggctaggctcaacaggcgtggcctcttattcccaggcaggatagggctgaacatctggctgaaccagctttgcagcctgcctccttcctcctaccctcacttcctgcctgcccagctgtgaatctgtgtgtttctctctccccattccctatccccagttctcacagctggtgaacggggatgtggctttgctgggcgggggcccctacatgctctgcactgatgggcagcagctattgcgacaggtcctgcaccccgaggcctccaggaaggtatgctcctgaaggaaaaccgggtggggtggggtggtcagtaaggttcccagaacccctcttgtcctgagggtgggcagggcgctcatcctcaatcctatgtgcccccagaacctggtgctccccgacatgttcttctccttctatgacctccgaagagaattccatatgcagcatccaagcacctgccctgccagggacctcactgtggccaccatggcacagggtatctgtgacccagcagggttagggtggagaagccactgtgggtacatgtgtctgagtatgtgcatgctgtgggtgggtaatatggacacatacaagactgcgttatctgctaagtccctgagtgtactgtgtcttcgtgtctgtgctaggatgagtttggaatgtgggtatgtgtctgtctatgtctggactgggaatctgtatgtgcacacatgaactgggccaaaacaaatgtgtatgctggtctccagcatgtgtctatggaggggagttgggcccaggagtaaacaggattagtgcttatgctaagatgtcttcactgtcacttctctgcccataggtttaggactggagacagatgccacagaggatgactttggggtctgggaagtcaagacaatggtagctgttatcctccatctactcaaagagcccagcagtaaggtttccctcactgcctgtcacctgttctcagggatgacaaatgcctattgctcctccccactgtgaccttctctaagagaccacgggggaatcctctttgtcatttcttttttttttttttttttgagacagtctccctctgtagcctaggctagagtgcagtggcacaatctcagctcactgcaacctccactttccgggttcaagcgattctcctgtctaagcctccagagtagctgggattataggcgcctgccaccatgcccacctaatttttgtatttttagtagagatggggtttcaccatgttggccaggctggtctggaactcctgacctcaaatgatccacccaccttggcctcccaaagtgctgggattataggcgtgagccactgtgctcggcctgtcatttcttcatctctctcaattgtccactttttgcagaacttggtggggacacccctctccaccagaccctgctgacccccaggccatcttttctcaggtcaattgttttcgaagcccgaggtgataaagcagaaatacgagacggggccttggtgagtgtgggagcaggggctgggggtgacaacagctgaatagctctgacagcactgtgccctgcccctacagcagcaaggctgatgtggtggacagtgagactgtggtacgggctcgtgggttgccgtggcagtcatcagaccaggacgtggctcgcttcttcaaagggctcaacgtggccaggtgggtgtggcagggtgggtgggcccaattggacaggcctacccaggaggcactaacagcactggctccacaggggtggtgtagcactctgcctcaacgcccagggccgcagaaatggcgaggccctcatccgctttgtggacagcgagcagcgggacctagcgctgcagagacacaagcaccacatgggcgtccgctatattgaggtggggctttgggctgggagcggagcagggccaatctgagtcaggcctgagacccatgggctgctgctctctgtacccacaggtgtataaagcgacaggggaggagtttgtaaagattgcagggggtgagtatactgcaaacagggcctggctcccctggttcttgatccatttcacttccccaccaccccttgcctgcctgctcccctgcatgggtgagtgtctggaggagcatgagtgaagtcagcaggcgactctcatacacaggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtgagcgcccagggctccccacccccagatgtactgttactccagggcggccctctgtgtccctgccctacttggcatgaccagcctgttgctgccttccttactaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcaggtgaagccactgcttggtagggggaacacataaataggaaggggtgtgtgttaggggtaaggcactcttacacatgacaaactgctcacaagatggtgtgcacagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgtgagtgccctaggggctaggggaggaggaggcctgtggtagccaggctgttgtaagcccctaccttctatagcggggactcctttctggctaccccacccagggcagtgctgggctccgtgcacatgcactttctacttccgtctctaggcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaaggtaccctgcagctaagagaatatcacagtcccactccctgtcccaatctggggaaaggtcacgatcccctttctggaccagataactcctcccttgagatgacaagggagtaaggtggcagctggctaatgccatctacaaaacagatcgaaaatgactctgtagaggctggggcttcagggaggaactgaattaagcacaaggcagaaacaagggaggagggaaacaggtctcggtctaggccacaggtggcatgcatgactaaaccttgtctctcccaccctagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccaggtgagattgtgtggccggagggcctggcgggtctggctgagctctctgccctaaatctgtgtcccttctgtagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaagtgctgtaaacataactgagaaccagttcctttactaaacatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggctacccattccattcctcaacccaagagctagcacagttagagtaggagggggtgcgtactagcacgtgcccagttgctcagtgctgctagtagaaattgatttgcatagtccaatggatgtgtgctttaacaccactatgttgcacaaaaatttaagtctttatctacaaagccaaaaaatattgactcttaacaccaaagcttttacaaagctgatataaaactgcttacatagtatacaaagctctattttaaaatttaatgtttattttaaataggaaagcatt

SEQ ID NO: 38528 - DNA, 9550 bp, Homo sapiens
gtagtattctgggagctgcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggaggtgggtagataactctgccttttctgaagtcagatcccgcacgctcactttacccccacccgcccgctgtcctggggacctgcccaacgccctgtggccaggccaggagctgctccctgactccggaggttaccgcccgcccctcgactcccttcccgctggggtcctaactggaagtcttccaggccccgcccccttctcaaatgcccttctcagactctcgctgtaccctacggaaggcacagtcaaagcaaccgaacgtttaattatttgaattttctcaaagtaattcatgtataataaaaagtcaaacattaaagcaggtcttattttgaagagcagtaactacccatccccagatctttgcagaggctgccacttttagtttgtccccatttagatgtttttagcaccctaaatcaaaataatatgcgttccactgtatttctggatttatcattttgatatttctttgccttactttcttactgccacaatcttgtcaattttccatcgctattttaggtcttccatttgtagctttaaataatgggtatcaacttccatttattgttttattgactttagatggtgtctcttaatgtctctactgacttagctaaggatattaacacatcctccactttcaatctactatcggttggaactcaacatttacatttagttttcacgtattcaacaagtatttgaggcactgttcttggcactggggaaatagaaatggacaaaacagacaatgaccctatccacatgaaaaagttctagtatgggaagtaagacaatagacgaatacatggcaaatgacgtcaaaggcaggatcatgtagaagtcattttcagctgggagaatagcaggcacccaagtcaggtagattgaatggacgaggggtttgcgggagtgtgtggaagtttattcctttgcctagctgggcacaggtgctgtttcaaggagagatcttgttaaccgggagccaggatagattatttagtaagttagtgatttaccaaaatgaggttttaggatactggatcccacagtttggtagtgatagtgggaggaagaaaagcaggaggcagggagtctagtgagaaggcatgccctgccaatggcatatcagagtcctgcaagatttactgctctgcttcctgcttcctgctactggactgcgctaaaccacagtgatttttctctcctcttgaatttgtattataccttaaagctaaagaggttaagaaatttgcccaagatagatggcagagccccaagccaaacatctgtaaaatgagaacaataatggcctctgcctagggttgtgaaataaaccaacttaattcatgtaaagtgctcagaacagtgcctggcacatcatagaactgctcaaagagtgcttgcttttattattaatgtatgctctcaatttacctcacaaatgctaaaaggattttgggtttaggaactatttcctatgtctagctggttaattcattcaacaaatatttactcagcaatatctgcattgcaggtgctgtttaggtgctgaggatacaacaggaactaggatcaacatgtcccttccttgtatagattctagctggtaacacaaactagcaaagtgaatgaataaatattgccaactgagccaagagcctgccattgaccaagttccatgcccatatgtggccctggcaaaaatctcagatttcttgctggtgtagtgatttcatcaatatgggtgtgatgatcatcaaatgatctttgttttaatctccaagggatgttatttcatctctgcttctagcatatcactaaaagctcagaagactaccttgacatcttggtgaataataagtacattagtgctggagcagtgggcaggggtttaaaaggcacaggaaaagaactgctgtttcctttacagtttttgcattttagtgtgcaacacaagaaaacaaattgagcttgtaggcaatgggcttctggcatactaccttttgacactttgaattatattaatgtaaatataaacataccagagagtgaggctggaggtatttatggccttacttcagatactgaaataccacattttatgtgaacttacccaagtttaagagaaataatgctgatttgtagagcatgattggagtggtaatggtcaagtagagcaaacccagaggaaaatcagagttgaccaagtgaatgaaaaccgaggactcccaatattcactcacttaggcatccccattatccccttcatggtatgagtaatgtggcccgttcagaccatgcacccttcagttggaaaggccaatgcttattaaagaaggtcagtaaagggtcaaaaggaaggtggttttcccccagaaattaattattcctgttactgatctctctgttcctctgttacctttttctcttatttgtctttcttttcttcttctcagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaaggtgagagatggaagctggccactccagtctaaccccggccccaagttggctgtttctagatcaagggcttgaccaccagcaccacagactgagagctaactcctttggttcctgacacccagagatccctggaatctgatacagagagctatacctttccttgtattcatgaccttccttgatttcctgctctcccacttcctctacacctacatcctaacagggctcaattcctaacccaaggctgatttcagtaatgagaatgtgaaggaaaacagtttgggttttaactgagattctggatgccttggatgagtttaggcatgaggctcttatatagatggtcaaggctacacctgacctgcaaactcctcctagcagtgctgcaagtagtcatttggcattgaatggatcacttccctccttcattttatagacaaaagtgaggcttagaaagttgaaaacatggcaatttattttagaggtggaaagaactatgggtgagtcacaagattgagagaggtcatctgatatagtcttctcaggtcctttctgacttcaggtccagttagtgaaaggaagatcagaggctgtgactcaagtcttcttgcactttctcctctcccaagtttgtttgtttgacaagtcatctctgacaaacctgggactccttttttgtagctaacctcatcaacttccagcttctgggcttctctttactctttcatcagatgcccataatgacatctttatcggaaccattatctcagtgattctgtgatccagtgatccagcattggtctcaactctcttttttggagttgaaataggaaggtgagagtgtaagacaaatcccctgaattagcttttttcctatatgggagggatttctaaaatatgaaaagtatttactaactcattctgtttttgagactattagaaaagggagctagtataacataggggtaaagggctggatgaaatcccagcccaaccatttattacctgaatgactttgggtaggtcaccctctaagcctcagttttcttgtctataaaataaggttaataccagcctcagaggattgtaagtatcacatgcatatttagagctgaaaatatacctgacacttgatatattttaacaaaatagttgctattttgttaaaatagcagaattaaatggtgtttctgcacagtttatgcttttcagtagaaatcccttgcattactattctaggaaagtgcttcttacccttaataagcatatgaaccacctgggagatccatctaaaattgagattctcatttggtaggtctaaagtaaggccaagattctgcatttctaacaagctcctaggtgatgtggatgctgctgatccacttgaaccacatttggagtaacaaggttctggcagacagtaagataaaaataaataagataaggataaaaattggcatggaaaggaaagtccaaggtacttttgtggagaggttgtaaatggaccttttcttccagtttacagacatttagagactgtgggagttgaaatgattctcagcccagagagctacctcggatgtcatctgggcagagtctgcttcctctgtggcattccctttccccacagccttcactgtggccggttgcctgaaggactctggttctcccatagcctcccagtgctaggaagcctaggctgccggaggtggcctcatgagggttttgtctcttgcagtgggaacttcatgaggccctcgaacatctgaagaaagagcaagaagaggcctggaagcttgaagttggtgaaaggaaacgaactgccacctggaaggcaggttgcctcgtggggaaaggagtttgtgtcagtcgtcctgtgtggtcctggagctggcctagggtagcattctcatcactgtgaggcagaatgtgaggcttgaaatcacagagcctagggttctaatccctgctttctctgtcccaggccttaggtaggccacgtcacctcttaattccagtttctccatggggatgtagggataacctctggtcttgtatcctcctatatgagaaaggaaaagcacatgctcacgtgtgtcagctcacagtggcatggcttatatcatgcttgtaaagcagagtttctctttcattttcccaagttagagaatatttgctaagagtctggttattaaaatattgtaaaatcacctctgaaataaatttgaggccagtaagtatcaaactactagaacttttgatcaacagaaagtaacactgaaccaatctaaaacagcatgttgaacagatataatatcaacatgaaaatgaaccacctaacagtgtagttaagttacactgccttagagacttaaatgtaacacatcttgtcattattctgaaaatggaaaatagtctagagcatgtagtattaagataatatcctggaccctactggagtcaataagagtgacaatagagacctagaagcatgtggtggagctgggagaacaggaagctaggaaaaatagtatcctttatctttgcccctgcatagcctgtcacgtggttggtaccattgcagagtatgtgtgtatgcatatgtcagtatgctcgatactgggtgactgaaagtatcagtgctgatttccatcttggctccacagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggtgagtagtaggttttcctggtaaccctgagtgacagctgaagatagactgagactccaggagagagcatcagttacccttcagtagggactgccagccctctgccagctggtcatggatcctgtgtttccccagctaatacctgctgtttccctatccctggctggtggatgacctggtctgttgtagcatcataggtggggcagtgctcaggcagctctggcgtcattccaggccctctcctctagcccgagagtcttgagatggagcctgaaattggccagttcagccaaagctcagcctgctcttccatccttccataggcttctccttacctctgcatggcatctctccattcttggtatctgtctcccttcccctagagaaactccctgccagttcgatgtctgttccctctgaggaatagcacttactcagatgctgcatttttttttctccttccaggatattcaggaagtgttaaacaggtatgttctcacccttggagcctctaagcagccctgtaggggatagtgaggcctaactagagccagaagtagggacggagcacagactcggtgcacacagaaaagcaggtgctggtccacagtctcgtcccacttacatggtaatggctaaggaatctttgttgatctttcctttttcttctttgtacttgatcaaatgtatatcaagtgaagctgtaaaatatgtggtttcaagtagattgctcaaagaggataaaagactgcccatgactccttcatgtccgacagaaaatgtgtgcacttcttcctctcccagaatcaaatatacatccaacccttcccatagcatgggcatgcaggtgttctcacctctgcacacaaacagcttgaggctcagccaaataaccgtaaccatcatgtctctgctttgctggggttcactatgtccctggccaagcccctcttccctgtactaagataaggcccatgtgacaaagccgggactcctggccctgaggttcaccctcctctaccaggagcaaatcttggagcttgcagcagccagaaccaatctccctggagttgaagacagattgccgtgtgctggggctaagagagatcctgaagacttatgcaggtaatggatcctgggggagactgtagtggacagtgggagggacccctcccagagatagaaaatggttcagtgccctctgggtgctccatccagcctcaccccttcatcattgagaaatctgtggctgaatttatcagagggctctcacccatgtcccctggccctatatcactgttaccaaccaggaccttttcttctagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatg

SEQ ID NO: 38529 - DNA, 42908 bp, Homo sapiens
gggaggaagggtgcgcggggcgaggggcggcggcagacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccgcgcgccggagcatgagtcccggccggagccccacggccgcgggcggcgcctaggacggcgatccgcgccctggaggatccgccggccgcccggctccactacagctccagccgcctgcagcggggccctcctgaggccccagaggaagagaccatgaaaggtaagggcggcctgtcgggggcagctccgaggggggccgcctgcacccccgctccacccagggcctggggggcgccttttctgcaggcgaggctgagaggagggcagggcgcctctggcttttcccctgcctttttgggcatcctgcgagacaggacggatccctgaagaccagaggaagcaaagaggagagggaggatggggacactcacacacccccccttgcagtcctgttctcatcggccgttgctctaacctcacaaataattttaaaatccagagaagtttctgatccctttaaccagtagacgcagaaaggcatcaccagcccaactttccagcagtgtaaatttcgaccctggggacccatcagagaggcccctgcatcccccaccgagcctttcaaccgggggccaggcctaggattctcccccaggacctccagcccttccccaaaagagacctgcagtgtcagagcccctcagcccaggccctgcccttcccaacccctgaaccctgcctgacccaccctctgacctccttgggaggaagccgccggggaagccccatgggccaggactgacctctccccagggtggtgagccagcagcagggtggcccttgcagccagttcttgggatggaaataagaaccagacatgatcccaagtggccatttccagggcctgggtgtctttaggcccctacttggtcttcaaggtcattttgaggctacaggagaagcaggctttggagttatctcatgaggcagggaacctccgaggttttgaacgccatttcgggtgtctttcagtaatcctcctgtaacacccccagcagatgcttgtgttcctagcagtgagaacctcaccacctcatctgcttatggaaagtagaaactgaaaagggcctttgagatcatctacagggctctcaaccacactctcaggtgccactgacaggtatggaggtggaagaggtggggccagagctctcagcctacttcaaccagagcagctctgtttgtctctcatacaaagaatggcctgagggttcattggaagaaagggctccaccgacaaacttctgactggatgcagcctccgcattgcatagttagggaaactgaggcccaagcaggtagggctggcttcatggcttctgcaaccagtgccatcctacaaggtcccacacttggtttaatgctctgcaggtgctatcttgaactttttaaaaatgtattttattttgttttattttagagatagggactcaatctgttgcccatgctggagtgcaatggcatgatcatagctcactgcagcctcaaacttctgggctcaagtgatcctcccacttcagcctctcatgtagctggtactactaggactacaggtgtgcaccaccatgcatggattttttttttttttgatagatatggggccttattatattgcccaggttggtctataactcctggcctcaaacgatcctcccacctcagcctcctaaagtgctgggattacagccttgatccaccatgaggcctgaaattcttataattttttaacaagtcatcccctcccaccaacacacaaacacacacactttccttttacactgggccccacaaattatgtagctggtcctgtggacagaagtgagttgttacaaatcacagttagtcagggtgactagaccccaggactcctgacttctagtctagaatccaccttgcctctttgtggcttccttccctctgcctctggcaccttctttctgtgcttcccgttggcctccccaagtcctaggctctgcgggatgagccaagcaagttataatcagccctagggagcacctggcaggcagtgaggggagcctcgccccaagtcctgctcctcactgagacacctttgcagctgaaccctctgcagtcagctggcccagggcagaccattactggaagcctccagaaaggtcttggaccacatcttacacggggccacactgccctggaccttgatgatggtggtgagatgtttcacattctcagagtggctccaccccaattccagacaagcaccagcagggtgtggtggcagatacctgtaattctagctactccggagcccgaggagggaggatcgcttgagcctgggagtttgaagtgtaatgagccatgattgcaccactgcattccagcctgggcaacagagtgagaccctgtctctaaaaaaatagaatttatttaaaaaaagaggcagggccaaaatcctgtgaaatagagaagaaaagagctggtgtgaatgaatatttaaaaagaggtgcctgaggaggacccgctgacaccacgttgcagggttccaggctctccttgtgctgtgggttcctatacaggaagccaagccctgcctctctcctcctttcccttggatcccacagcctcttcatgtgccgagcgggattcctgtctacggaggccctgagggcggcgctggtgtgtttttcctccagcctccggaaacccctcagtgatctcccataacatcacaggggctgcatgggctgcggggctgggggctgacttccagcacttccctccctggcagccgggaagagccgcccctctaccagagatggaaatggcagggcagacagcaaataattggcttccgggatctgtggggtgtaaagaaccaggatttttctcactcgagtggaaaaagtaaagtgcccggcagagtagggcaggcagccccttccagagaacccttcccgtgctcctccagaggccacaccaaacttcgaattacatctgttggcaaaggatcatgccctgctcaaaacaaacacgtgatgtgatgtgatgttgtatggagaaccggtgatggtggggaaggtgatcaagaaaacacgctagtcgggctgcccagcccaccggtggccgagtgccagggcccactctgccagccaagccatttccacccgaggcccctcctgccccacggccagctgacagggcctcccaggccgctgcctcttttgatccaagctggcacctggcccctctcacacgcagccctaaggggacactcaggtgccaccagccccttggtgataggcccaccttggagcttcccactggcttgtccaagccattagcagccacctgtggggttgtttccacacttccagtaagagtgacccacccccaagatgcccaagacacaggctggtgcaccgtgaagactgatttgagagtcgaagacatgggctttagtcccggccccatcatctgccctcttcggccccgttgtcctcctgggtggtccctgaggcccaagagctctgcgcctgagcaccacttggggagcggaagtgactcagtggtgaggtggctggaagcgggcccaccttgtggcctctttgccccgagagacttctgcttgactgcggtggccagggcagggggcagccctctgttcctcaggcgtgggagaaacaacccctccttccagaatcagagagcagtgcccacttcatttaggcaaagggtggaagtggggagaggaggggctgtgaaaacacagcgatgcaatcccaggaggaatccgccctgcaccgctcctctggccgagaggagaggatctccactcatgagcggccaggctgggggccccagaaagcctgacctcattccccaggggcacgggaaggagccagggctagaagaaaaggagctgatgtggtgaaggtgaaaagagccaccagacagcctaactgaggggtccagggagcccagcggctcagatgttggagttcggctccaaatcctcaaacatcggccccactcccacccccagccaaaacagtcactttgccctctagctgggggtaagcctaataactgaagactcaggtcccaaggctcatcgagagcgaggaaaaagccttctgtttctcagtaggctaggttgatggatagcttggcagtttccgtgaaggacaggcagctgttctgggtgttagaattgatgtacagggtggcatagctgggcatggctctcatacatgcactgcccatgtttgatcatgtataatttagtgattgtgtgtgtgtgtgtgtgtgtgtgtgtgtgtgtagagcactgagtcccaaggtcaggcccagccctgtcataggccagctttatcactgggatgaagtccctggtactccctggggtcagtcccctcatccaggtggaccagatgatcccatgggatggcatcagagtgtaagtttcatgacagtggggtctctgtctgtttctggcacttagggggtgtccactaagtctgttcagtgtgcacatctgtactgtaccatggtatcgtcagaacctcacgcaggcattccgtaaacatgcagaaagatgcctgtattcaacaaacagcgatggggcgactgccaggtgcccggctctgtatgtctatatatgtctaaggactgaggaagctacaaagagctcagatgctgccctttctctcagggagcttactctttactaggacacataggatttgtgcccaagtcactcaaaaaaagactaacagtgataagtgtcttaagggagttcccagcgagagagtttgggggtgggctgggctcttttcctggctttccttctttgctgctgttcttcgaaatgcgtcctcggtttcagccacagacaggctcctggttcttgctggcacccgttccctgaacaatctctcccagcctcgaagatgtgacatgtgggagctggcaaatctgacggcaccagatttgcctctctgggcttcacagctgtatttccatcggtgtcctcagtgtctccaggtggagacctgcaggcaccttcttcatggttcagatgagacaccttccccttcacctgaacccaagctaaaaaatgggttattctgagttgttgccccagcccacacttttcagtcagccaacatgtatggagttcctgtttttagggaggaagcacgctagttggaaggcaagcctgggtgctttctgccctcccagcagaaataagacgtgcacacctgagacgagaaccgaatcatccaggcagatgccacaaaagaacaaatgcacggcatatacgggagattggatgggaatcccgggagagaaagggagcatttcaagttgggcagttcagaaaggcttcagggaggagctgaagggtggggaggagttggatggggtcagtgaagagggcaggaaggagtgctgggaaaagttggacagcaggtcctgggggaagagtgtttggtggtgggggagagagatggcctgcagttgagggagccctaagccagaaaggacctgagtgctccataaaggacacgcggttgtgtctggttgacattggagagacctgggagggtttgtcaggagaaggcctatttgccacttgcccctggagatattctctcgtggccttagcccatgttgagaaacctctacttttagagagtgggaggaagaaaatgagcttgtaaaggagccaagaggagcagtccaggacacaggcagagaaccatgatggtaatgtcatggaaattgagaggagaaagttccaagggggaggaaatgacccaccgcgttgactgctgatcagcagagttagctcaggattcatggatcagagaaggccaggttgcaagggccagaggggctgagtggatcagaagcaaaggcgcaggaggagctgtgtccttagagtgggaggcagggcccagctcaaaggatttcaaggcagggatggcccgtgctcattgggagggggagggacagaagaggcatggggggacttggggacagagcggtggaattgagggagacttgctttgagaagaaagaatctctttatcgggaggcaagggaaggagaaaagatggttacagacatagactctgcattacgagcagctgcatttaacctttttataacacatttattatttttttaaaaatcaaaaaattccaaaaaggaaaaacattcactcacgtgaactcctgccctgtagagataataaatgacaaaatgtagatgaacattcttcagaaatcattctgtgtatgtttgcacagatttttttcatgtagataagattacactatccatgttatttttatttttattttattttactttgagacatagtctcactctgtgcccaggctggagtgcagtggtaccattgtaggttactgcagccttgacctcctgggctcaaggatcctcccagcctcccaagtagctgggactataagcaggtgccaccatgcccagctaatttttgtattatttgtagagatgaagtctcgctatgttgcccaggctggtctcaagctcccgacctcaagcaatcctccctcctcagcctcccgattacttagcgtttttgttcttagtgctggtttttagttgttgcttttgtttttgtttgtttgtttctttgcttgagacagagtcttgctctgttgcccaagctggagggtagtggcactatcatggctcactgcagcctcaacctcttaggctcaagcaattgtcctacctcagcctcccaagtaactgggactacagatgcatgccaccatgcccagctaatttttgtattttttgtagagatgaggtttcaccctgttccccaggctgatctcaaactcttgggctcaagtgatcctcctgccttagcctcccaaaatgctgggattacaggcgtgagccactgcacccagcttgcagtatttttaaaaaatggtttcataacatcccatagtaagactctacgagcatttatgtaaccaatcccctggagatgggcattttagctatttgcattttccctcagatttatcatagcatgcagtgatcacctttacacatacaccttggcctaattgtgtaattattctcttaacatgaagttcctagaaggaggattactgagtcaaagggcactcgcccttgcagtattgacagagggtgccaggctactcagaatgcacgagaaggcctctttccccatccctcccccagactgggtttgaagtgtaggcatctggacagagttagtggatgataaagaaagaagttggaacctcatggtcttgatcctttcagaaaaggagggggtgagctcatctttggggaatgaggtgggctgacctgaggaggaacccaggaatgggaagtgaggatccagatggcaggacttggctgaagccaaatgcatgcccccctctgacactctcctgcagctccaggcttctctagtgcaattcgaagaaagcaggctgaggatggaagggaccatggccaggagagagaactacaggctccatggggcagaactcaacccttggggactgggctgggcttggaggtcagggcgaatgagaacttggaggaaggagagcgaggaaaggctgagtgcattggggatgaagaaggcaaggggcttgagatcaagcagatggaacagcaataagccttaagctccagagggcaggcaggatgtgtagagatgagacagtaaatcccatgtccagagccctgagtttcaacagaaaagctgcttccattcaagttgatggcaggagacagaatgaagaattcatccaatccaggtgatgtcattgtccagaacagtgttccctaaagtcagagtccctctgcctctgaacataggtcccagaattaaaagatacatttatttttcaagatctgcaggaagttccatgaccaaataagtctgagaaacgtggagttaaacacagatttaaatgggcttattattttttttggcaggacttttcaaaatgcttactatgtgaatgtgaatctctaagatggcgatagagtatgccatgttttccacacttacttgatcaaataatcctttttcacaaagaataatttgggactagtgtcccataggatatgttttgaaacactgatttcttgtaagttggaaattggtcctgggagtgatgggggttgggagatggcaataaatggcagcattaattggaataggatagaaaaataatcctaataaaagtggctgctactactatttattaagcatttacgatgtaccaggtacttttcatatacgtctcattggattttcacagcagctcattgaagcggacgatctccccaccatttacgcataaggaacatgaaactcagaggagggaagtggggtgcccatgcgagacagggtaggatttgcaggatcaggggtgacaacggggatcaagagaactggtgattcctggccaggcatggtggctcatgccagtaatcccagcactttgggagacccagggaggaggatcacttcaggccaggaatttgagaccagcctgggcaacatagtgagatcttgtctctacaaaaaataagcaagattagctgggtgtgatggcacacacctgtagcctcagctacttaggaggctgaggtgggaggatcgtttgaacccgggaggtctaggcggcactgagccatgatcgcaccacagcactccagcctggccaatagagcaagaccttgtctataaaaagaaacaaaaaaagaaaagaaaagaaagccagtgattcccacccctcccatccctctgaattcatggggttcaggggagtcgggggggttggtgctgtggacagagaggagatcagtgtgtaagtaatggggggagtctgttgcattgagtgagtagcctaggttcttgtctcaactagaggcagcaccagcctgcgagcaggtatttagaaatgggtgggcattcggggttgtcacaatgaccagggattgctattggcctttagcgggcaaggccaggatgctgaatgtctgtgcagagtgggccgtgctcatctaatgaagaattgcaccacctggaatagggtccaagttagaaaagttgagggcaagaaagttgtttaggataaaggggatttaggataaagcagggatttacccacaacctctgtggttaccaagaacagggtgggaggcagccaaagggattcaggtggaggtagcaggaaccgggagggaagcctgtctcagagcagcagatgtggctttagggatgcaggagcttgaggatggggaccaaaaaaggggcgagtgctggaggagagaaactggcagagccacggaagcagaaaaggacaacttgttgagcaagaagatttgaagggaaaggacctgtgtcttgagacctgagcgggcaggcggattcccaaccgattacagacaaacccacaaaggaagcctgtggagagggggtagtggcggaagggctctaatgaaaacaattttgcaaccttacttatagcgttctccaaccttaaactaatagctattctgcactttaaatatagcattggctccagagaagactctgaaatctttatttttaccgatccaattggctgttttgaaaacccactctgtgaaccctgcagaagataattatcaaaatatgttccttgaagtgcccaaagaaagaccttttattcagttcctcgaatctctcccccttgttgactcagatggaagaatgcagtcccagaaaggcgaaagagggaaccaaggacacatttttggtcaaccaaaagaaagccggcattggtgaccacagttgagttagcagttggttaacaggtccgggctattttctacccccaaagggagagctgaaccaagctcaaccccagtggagtcagtggccgtgcttagcaatgtgccaaggcatgcaccctccatcaaacttgctacgtggctctgtgagagcagacttaaaaaaaaaaaaggaatttctcctcttgtggctgtcctttctggagtttgagatggatattgtgacctaagggatgacaggaagagaggccctttcaaatttctagtggtcaccactattttatgggtctgggtttgcagccttggccttggccttggccttcccaggctatttaacttttttttctaagcaccttgcctgcgatttgggtagtaatcactgcaagaagattggggcctggctgtgcctttcactaggaaatccatggggctggcttctttatgacagggaccatggccctccctcatagcagctgtggtcccttggggccttgggatcagagcaggcagaaactggctcatggagtcttagatgttcgttctttcatgattcccatgctgtcccaagtttgttcccagagaggagttttcccataggtttttaggtcccagcatcaccttatcttctccagtgtcctcttccaagcccatccgctcctgccaaaataaccttgctcctggaatccacaaaatgaagaaaagaaggggagagagagagagagagagagagagaagagagacagaaggcaaccagtgctatttctgccttcctataaacggagtctctctctagacacctagagcctatcataacatgatgatttcattaccccttccagacacccagcatgcttcacactcaggcactcctcgattttcagcatgtcaagagtcctacatttctttatacatgacacagacaagaaccagcgccttactttagagagctatagacatattacatacaggtggtattgaaaagcaattaactgggacaacaatggaaaaacacgacccccccaaacaagaacccttggagcttcaggagaagaatatgatgtcccttgttctgttctgcgaaggggaggggaagtagagccaacattttgctcctacccagtcctccaccagctcattcctttgcagttcaaacaccagcccttggtatataaatttcgccttcgctgcaaaattttataaatttcgaaaggtatataaattaagcctttgcactccaaatgcatccatcgtccccaacactccctagccatggagaatcctaagaataaaccagattccaaccctattttaagtcatcaatcttcattttttaaatacacatgagctcctgattaaaatagcagaggataacagttaactgaagacataggccttcgccgagggccagaaaacacatctttatggaacatccactatgtgatcaaccctgtgctgaaagcagttgaggggagctttcctgaccacagggatgtagcaaactgctaggagcgtgacctgtcaacagatatcaggcttatatggaaaggtcttgtcccagttctgaggcgtttctgagatgggcatgtgcaactctgcagacactcaaatgcgtgtttggattctgcctcagattcttggatatttaggagccactaaccagcttccaggccacttaacctctctgagcctttgtgacatgatggaggtgaatttgcaaattcccttcccaccctctcaggctgtggttctctatccctgaaacccctttggagagctggtgcacctaactctaagtcagtttgcccttaatggcaggagaataggcatagaagacggagaggggaaggaaattcttttcccatctctattaaccctgcttggcctagttcaaggaggcactacggatgcctgcctaatcagtcatcctctgatcaatcactactctggggcctcagccagggctttttcattcttggtgactgtttattcatccatacatattctgatcagaacaatcttggtataacatgaacataatgagcttgtgcttgcaaagggctcggcttataagagcctcacaaatgctttggattatgttctcattaagtgaacgaggctacagtggtgagttactacagcattccagacataggtgagtcaggggtccccacagtccggggcttagtgctggaagacaggaaatccaagggattagagagagaagacctctttggggattggggagggctgtgagttatggagctgagatgtcagtggagggaagatggccaaacacccgtggtccccctagtctagagagatccaagatcttcgctggcagccgccacttcccttcccatgggtcactcggtgcgttactggaaagcctcgttagcaatttccactggctaacagttgctaatctggggggctgtccattgggaaagctggttataacaaagctctgtgttttttgagagggtgtttgctgaaggctggtgtcagccttgcttgatttaagtcatcccagattccctgcaaaggctataaacagtgaagtgatgaaatgggccctagagccagaacagggaggaggcccagtcacgggggagggcagaggagctcatcaaggatggagagaaacgaggaacccggccaaggaggcagctctgctctaagggttggaaggaatacctccccacggtagccccggggcagtggtgaatacagcccacagcccacaacgtggttctgactggggtctctggaggtgagaggccatggctactagggtgaggttttggtcagacagaaacagaaggtaccaaggaattcccctgccttgccccagccattcatttatgggaaagagatcataatcctggtgactgcccaggccaggcttccttgtaaactgttggcagattgacgatgggacagctgcccaaggagagctgaaagtgcttcttaggatatgcatgaaaacaaacttctcatgcttccttgctgttcccgctttaccctccaaagcacttgcccgcacccctgaccgcccccgccccccccccgcacacacacactattgccccggaaagcaaacctacctggaatctcctattgtggagaggaaaaccaggattccggaagctttgccactgcccagctctatgacttgagccaggcattaacaacctcacaccacacatacacaggtacacacacatgcacactcatgggcaaaaatgcacgtgcacacatgtgcaagcacaggcacacacgcaggcatgcatgtatactcacacatgcatcggacacaccctcacacacatgtgcacacatacacaaagtttagtttcctcacctatcaaatcaggagaaaatgttctctctctgtctctcagactagttgtagggatcaaatgggataacagatgtgagagcgctttcaaagtcctaaaccccaggtctcctttgtcgccccagattaattcaatctctgggggtggacccttgaaagctccccagagagctccacaggcaggcatagaactgctgggaagcctaataccaaatccttcattggtttatttgaaattgtgtttgttgagcctttctctgtgccggctctctgtgccggccactgtgctagggatgttggataaagcagtgaacatgacagatagtccctgcccttggaactgaagcgctggggaagagagctgccgcatggacaggagaggagcattctcctagggagagcacagagcatgtgaggtgtgggcaacagggccttacgctagtctgagagctcaagaaagactgctggggaagtgacgtttaagccatgcgtgaaggccgagcagagggcactcgtggtcttgatggtggcatttttaatttggggtcaccctcagtcccctccctactgagtccattcagagctgcctttgcttaccaacagcgccttgccaactgcatctcagctcctatgttgatcacaatggccgtggcatggcatttgggcctcaggtactcacaggtctaggatgcggctcaagatgcccatcaatcatggtcaggagcccccgaggctccgcagctcattcatgtaccaccctcttcttgtctacccgctgaccttgtagttgcagaagcaaggtttcttagcactttgtggaacctttgctcattacctcaaggtggttgtaggtatggtagaaaagatttctgagttcacatcttggcttcaccacttctattctgtgggctgctaagcaacattcttcacttccctgaacctcagtctttttgtctataaatgtgactctctggactgtaaagtttataagatgttgtgaagattgccttgaggcaaaacccagcactttattgcattaaaaacaaaaaggaggcagggcgcagtggctcacgcctgtaatcccagcactttgggaggccaaggtgggtggatcacggtcaggagatggagaccatcctggctaacatggtgaaacctcgtttctactaaaaatacaaaaaattagccgggcgtggtggcgggcacctgtagtcccagctactcgggaggctgaggcaggagaatggcgtgaacccaggtggcagagcttgcagtgagccgagatagcaccactgcaatccagcctgggcgacacagtgagactttgtctcaaaagaaaaaaaaaaggaaaaaaggaaaacttgaagcttctacttctagcattaccagcttaaaatattctcgggctataaaatgtagacattaaataaactacagacatactgctaagtgcatagctaaaggtgaaagaaagcagggaatccttaaggacccaacaaaacggcaaagaaagagataaagagagagggagagggaggagagagaaagagagaaaggagggagggagggagagagaaggaaaggagggaggaaagtagggaaggaaggaaaggaaggaaggaatgaaggaaaggaaaggaaaggagaaagggaaggaaagaggtaaggaaaggagggaggaaagtagggaaggaaggatggaaggaaggagaaagggaagaaaaggccaggtcttacttacagggagtgggaggtgaagggtgtctggggaactagaggaatcttctgagtgagggatacatcatctaggttttagttagggaccatattgtcccagagaataagcaccgaatcaaactctgaaaggagacctgctccgcccaaggccctttgacaccctgatgggtcctaggtgagattgtgtgaagcagggatctgcgcccatcctgtcatctcctcctccctctggcctcctcctggctatgctggaggcagagtcttggtggggactatgctgtggccagattcagccttgtccctggagaagaggaattctgcttcggtgaccaagtattggggaatagaaggacgctaagccagagcaagcagccagctcttatttctccttactccaccttcatgggtttcagcaagctccagagagagcaggcactgaggtggcccatgtgtctttcccagcgtgtggaaaatggggagctctcctcacccagaggggtgggacatcccagctcctcagccacttgattcttatgtccgctccctttttgcagcttacatcaggccacctggagctcagtgagctggctcaggggtagaggtgggcatgggatatggggacaggtaaataaaaggggctgctggagaggcctgggatggctttgggtctgacggcactggcttcattatagtgaggtcggccggcggcgatggagatgccttgtgcgttacagaagaggacctggcgggtgacgacgaggacatgccgaccttcccatgcacccagaagggtaaggactctggggctgcccctgatctccgctctgggctgagagatccctgtctccatccccaggccagtgagagatttgtctctttaggtggtttcaaaagcctgggtgtcctttccccactgcttcctggatggtgaaagggcagagttcacggccctgggcgtgcagtaccagtgaagtcaaaggagtttaatgtttttttttcttaaagacatggttttgctgtgtcgtccaggctagtatgagtggtgcaaccacagatcactgcagcctcaaattcctgggctcgagtgatccttccacctcagcttcccaagtagctgtgactgttggcacgcaccaccatgcctggataattttttttattttttgtagatacaagagtcttgctatgttgcccaggctggtctcaaactcctggcctcaagtgatctgcccgcctcagcctcccaaattgctggggttacaggtgtgagccactgtgcttggcctgaaatcaaagcttgacacaagtgccacctgtctcctggggtcctcccgagacccatcagggacttctgccatctcccagagctacataccctgtccctggggcctgtcttctagctggcctggaactgtccccttcattgtgtcccatgccacctgaactgctgtttggaatggggtctcagtgactttggtgtagagtagagcagttgttctcaaccttggctcttcattgcaatcacccatggatgcatgagaccaacccttggaaattcctatttggcctggagtgtgatctgggcatcaggatttttaaacgtcctagtagtcagaatgtgtggctaaaggtgagttcaccttaggaattcgcagctgggccatcactgcattcccactgggtgttggccacctgtctgtgtattcaggaccatctggttccctctttcctccatgccaacaattcaactggtggaccatgactatttgtttggtttccaggagaacttctggttccctgaaaagtttggggactggtaaccaacattctggtttgccagggactgaggggattcccagggtgtggggcttttcattttcttttttcttttttaaaatagagatgggatcttgctatgttgccttggctggcctcaaactcctgggctcaagtgatccccctgcctcagcctcctcaagtgctgggattacaggcatgagctactgtacccggcaggctttcagttttaaaacccagacaatcttagcaaaccaggatgattggcaccatgctgaggagctcctgtgatgggagactttcagtgctaaaacccagaagatcctgggcaagcccagacaagttggtcactcagtggggcctcaggctggctgctcatcctgtgggtcctcagtaggaccaatggagagggaagaggtgtttcccctccccatgggccgaatgaagacaccatggagagaggatgatggtagtgctgggggctgttctttgaagtcctgactcggtctcctgcattccagaaagcaccagcacctagagaaaggaggtaggacaggtagagaatgagggtcgagaacagctccccttctgagcctggtttgaatgtgatgagacagaccagagcaggaacatggaactgacccttcagctccaacctgggcccctggcctaagccattgtcctccttgtgtcccccacaggccggccagggccccgctgcagccgctgccagaagaacctatctttgcacacatcggtgcggattctttacctcttcctggccctgctcctggtggccgtggctgtgttggcctctctgggtgagtccggggctttcccaccccgggctgcaggggggtgtctgatcagggatccagcaccaaaagttcccctgcaaagacaaacacttgacatctgtatcccagggcccagagccagcatcttcctggctaggggatctctatgcctaatgcaaactgcagacactggcaactgacaagatctgtggccttaaggaaggcacctgcctctggggaccccttctttcccattggtgtaatgagatgatacgaccaggtcagtgcttctcagtttcagctccatgttacagccatcttggagctttaaagaatgtcgatgtctaggccccaccccgatcgtggaattaattcggtatctttcaactctcctgatgattctgttgttcacccagggttgagatcactggattgagtgacttctaagcccccttttatggtctgtgtgtttctaaaagtgaggctggatgcctacctgcagcaatttcacctccagtatttgttaaaatgcaaattcctgggtctccctcagccagacctgctgagaccaaggaatctggggggtcctgcaggtgagacccagggatctgaggtttggttcttctcatacacattagggtttgtagtagttgacctaggtcacagcacacagccagaggcaagtcacttctgccttccagatgctgacagattgtggtaaacttgttacaacaaatttgatgtttgtaatcccattccactaagagtgctaagagtgcaatcccattccactcttagcttcaaactttgaaaatccgggctctggtaggcttgtttgttccaatctactggattttagaaacaaggccaggagtagggagaggcagtcgaggctccgaggggggccccctgctctcatgcagaccctgagcctgagcacatccctaaggagaggcccctcgtcctggccctggctggagatattcggtaaccagccttcttagcttgaaggcaagaggccagcatactaatgatttgaatagacacaagtcgtcttccagtaatccgaaggcattaattaatccaacaaaagccgggagcctgctctgtgccaggcactgggaacactgagttgtgtcaattacatttcaccatcaaggggcatggttcttccctcttgtcaggggatactggaatcccttggaaagcatttaaaaatactagtgccagagtaccccctccactcactccagatgaattaaatcatcatctctgggtaggacccaggccttagtcatttgtaaatcccttcaggggattccagtccgcagctagatttaagaaccaaggatttcagaacttcccaagcccatcaccacctgtgtctgctaaatcaattcacaaggtttggcatttcagaaagtggcaaaaatcccaggccagaggaggaaaggagccacggtctgcctatcagaggccacaaacttgctgtcagagaacttgtcaagatttctggtcaccccttttagggcctctgctcacagcactcaaggcacctggggccattatcaaagctccaagagccacaggatcaggcccagagaagagcgcaggcaccgaagagtttcagagaggatgacagaatgtgagacgctgtcatgtgcataacatccatgagtcagcctggcaggctggagcgggaggctggccccattcctcacgggagggtacagacctgggaaggggacaggatttgcaccaagatccagagtgaatggacagaggatcagaacaacctgggtgaggagtgtgtgtttgtgaaccacgggagacctttgggtttccttttttgtttttgcctccagcttgggtatcccaagtccctagaacagtgttggcaccatcttggcctaaatggcaggtgcccaataatatttgttgaaagaatgattatagatttgtaaagcgtgtgtgtgtgtgtgtgtgtgtgtgtgtgtatggtgtatgtgtgagtctgtggatagactggtcaatgctttacaaccagaactgtgaccaaagtccagagggttgggaaaatcagtcagcagacattacaaaccaactctattcattttaatcaagtttttttttctaaatcaagagcatactggggaccaagaactatattctatactgggcagtatactgcttagtaaaacacagaccctgccttcatggagcttataatctagagctgattatggccatttttttctgtaaaaggctacatagtaaatattttaggcttttcaggttacatacaatctttgtcacaaccaaactcgtcacagagcaaaagcagccacaagcagtctgtaaatgaatgggggtggcaactcctgtaaatcaggcattaggctggatttcacctgcaggccataatttgcaacacccctggtctagagcagtgatccctaaacttttttgaccgtgcatcccatcagtaaaaaattcatttaaaatgcattcaaaaatttacatggattgatgaatgggtgaaagagatggatgaatataaaataaatacagaaaaatgctacttgtagaatctaggcaataggcatataggtcttcactgtacaagtccttctattcttttgtttgaaaaatttttaaattaaatgttagaaaagaaaaaattgttagcgtcacagccccaaaatatacctatttatttataagtgatgtatatgtactatttgccatattgtctacataaaacataattttataaggatgaagaaaaatcatgtctaaaaagtgaggaaaaatggcttaaaaagcaaatatataattattaagcctgagatgcacaatgaagaaataagcaaggccaggtgcagtggctcatgtctgtaaccccaacaccttgggaggccaaggtggaaggatcacttgagctcaggagtttgaggccagcctgggaaacatagtgagaccccaactcatttcaattaaaaaaaaaattgaaaattaactgggcatggtggcacatgccagtagtcctggcggcacatgccagtagtcctggctacttacgaggctgaagtgggatgatcacttgagcccagaagattgaggctgcagtgaaccatgatcacactgctgcactccagcctgggtgacagagcaagactgtctcacaaaaaaaaaaaaagaaaaagaaaaaaagaaaaaagaaatgaacaggtgaatgaattatatggagtggagtgagcctcggctgttggcttggaagtagaattaatgaagcataggaataggaatcaaagtcactcagtctctttgtgtctttgttcatctatgcatgaaatcttaattgtagggaggctcaaatggaatcataactattgtaaactgtacagtgcttgtctcatgtaacagcatgtgcttattcccaaactctctcaacatgttgctgttactaattaagtaaatctactgacagctctgagatgtacaatattaactggagcctggagattccaaataatttgaaagcatagaattttggtgctgatgagagccttagagtcatcgagctccacattttcattttacatatgattgaactgagctcaagaaagggtaactgacttgcccaaagtcacccaacaaatgtgatgtaaactaggactagaagctgtgttactcagtgctcttggtggtgctaattctttccccttgtacttgaccttaagaggatctgtgggaagcatcttgctgaacctcagaacaacccatgccctccctcactaccaggcccattcaggcacccgctggaaaaagccaggcgtcctgctgctgccaagacgtgctctaaccactggccaacatggcccccttagtagagtgcaaggctgcccgtggggtataaagtggtgtaatcttttctgggcagcagtttggcagcttgtatcaaggacttcaaaaatgttaataccctaggtcccataattctattttaagcaatttatcccaagagaattatcatatacacataaccatcatatataaggattatttctagaattaagcattacttatatttatatatcaagttttatttatgagctcagaagaagaggtactttaagtgtcctcaacagtaggagattcttacataattgctgtattatttatatagagtgccatgcagataccaaaagtagtgattttaaagtgatttaaccctggatggaaaaatgtccgtgacatgatactgataaagcagcatcaaagaaaacagatgagatgttcagaacatcccagttttgcttttgttgcctaagaaagtacagtagtccccgtttatccgcagtttcagttaccctaggtcaatcggcaacatcatggcttgatgatcccccttctgacatatggtcaaggtcagtagtagcccaatactaagtcacaatgcctatgtcattcaccccactgcatctcgtcacgtaggcatggtgtcatctcatgtcagcacaagaagaaggatgagtatggtacaataagatattctcagatacaaagagaccatatttacataacttttattatagcatactgttctaatagttctattttattattagctgttgttagtctcttactaggcctaatttatacattaaactttatcttaagtacgtatgtataggaaaacacatagcatatttagggttccatacactgaggtttcaggcatccactgggggtcttggaatgtatcccctgcaggtaagaggggaacactgtatatatctatgtagctgaagaatggttatcaatgtagacaagactagaagaaatccatgaagacactgatggcagcaacctttgggtggtaggaataagaataatttttttttaattttttttctgaattttccctgttccattctgtgatcaggtcctatttctaacatgtggggtgtggggtgagttattctgtttctaaagggccttgtggcaaactctggccataagaagtatcttccctaaccgccatgaagaagcctgagagaagaagggtgaaaggttttggttgcagaggagctgataaagatgccttctcaaggaatgactgctgtttctctgagcttagaccctgccccagcttctcatctgttttccctacagttttcagaaaagtggactctctctccgaagacatctccttgacccagtctatttatgacaagaagcttgtgttaatgcagaaaaatctccagggcctgggtaagtagatgggctgatgactgtgatgcagtgatcttcagggtggggcaggggtgccctccccacgctacagtgccccagcaccaagcaaccttcaccagccttctaggcacagaggctatccccagctccctgctccctccccagccggatctccatccattagaggagggctgctaccctgggatactcccaggactggagcaggggattctgggtggaccacagatctagccagagtctacaggcagagaaggaagccaaagatagtccattcccaaaatagcctcatgcatctgaaatgatgagagtttcaagaccttgcaaaacctcctgccaggtcaaccctttcctcatcattgccttaagctgtgccacgattcttttcttttttctttttttttaatatgtgccatctatttatctatttccataattttaacttttgttgttatagattaagggacacatgtgcaggtttgttacttggttatattgcgtgacactgaggtttgggggggtagaaatgatcctgtcacccaggtagtgagcccaggtacccaataggtggtttttcagcccataaccccctccctcctctcccatctagtatgcactgaagtctattgttgccatctttatgtctacatgtattcaaccttttttttttttttttttgagacggagtctcactctgtcacccaggctggagtgcagtggtgtgatctcggctcactgcaagctccacctcctgggttcgtgccattctcctgcctcagcctcccaagtatctgggactacaggcggcagccagcatgcccggctaattttttgtatttttagtagagatggggtttcactgtgttagccaggatggtctcgatctcctgacctcgtgatccgcccgcctctgcctcccaaagtgctgggattacaggcgtgagccactgcacccagcatctacatgtattcagtcttgctcccacttataagtgagagcatgtggtctttggttttctgttcttctgttaatttgcttaggtcatgccacaattcttgatgttctttatcccctgctttaacctggaacaatctaagagagaatgagacagaaggagcaatgatagaagggtttagagtggtcttatctgacgcaaatagaaggttctggtctggcaccaatatacgtggctatttaccaagccacttctctgcacctcgttcctcttgattgtattgaatgtattattttgagaggattgaataagataacagatataaaaatactgggagaaatttttaaataaagtttaaatgggaagttcctggccacctaagaaaaattatgaagatacattcttgagaatttggtggtgagaaggaggaaacatcctaaatgctacatttcagatcagagtcaagaaagtcggtaaaaatgagattccatagaggtggcaaggctttttcaagaaggaattcataacaggacttctggaaggaagttggtttgggaagctactaaccaatttcttatgctctgaaatatttaatttaaagaggaagcgtcgtaccctggcccttcagcaactcaaactgttatccctttcccctaaagatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtaagagctgggtccaggtagggctgctacaaagcttccactgaggcttggtgatcttgctggacacagaagtacctggttttaggcaaagtactagtgggctaacacaatcctatagcaaatgcctacagcagtcggcagctttaagaaatgtccttgcattagccaggcatggtggtgtgtacctatactcctagctgcttgggaagctgaggcagaaggatcacttgagcccaggagttcgaggctacagtgagctatgattgcaccactgcactgcagcctgggagacagagtaagtccttatctaaaaaaaaaaaaaaaaaaaaaaaaaaaaagagagagagagagaaaagaaaaaaggaaaagaacatccttgcaaacctcttttgtaaaggtattatggcttctaactttgcctattatacaaatctggatttttgtatttagatttatttaaccaagtcctaatagagaaataagcagatcttgtcttttgaaaactgtctcctcttttttactcccttcccaccccctcattaatgctcccaaccacccaaccctctgcccctggaggctgtcactctgaaaaactcttctcctctcatccccctcatgtcttccttatttatcagggttctccagagaaacagaatcaatagtgtatgagagagagagagagacagagagatccacagaaacagaatcaatagtgtatgacagagagagatccacagaaatagaatcaatagtgtatatatatatagagagatagacccagagaaacagaatcaatagtgtatagagatgatagatagataggtagatagatccagagaaacagaataaatagtgtatagatagatggatatatagatgattgattgattgattgatccagagaaacagaatcaatagtgtatagagatagatgatagggatgatagaaatggatagatagatagataggatagagataaagagatagagatgagatagatagatagatagatagatagataatagatagatagatgatagatagatccagagaagcaatcaatagcatagagatagatgatagatagatagatagatagatagatagatagatagatctagagaaacagaatcaatagtgtagagtgatagatgatagatagatagatagatagatagatagatagatagatagatccagagaaacagaatcaataatggagagagagagaggtgatagaaacagagatgatagggatgagatagatagaaaatagatatagatagaagatagctagctagctagatagatagatagatagatagatagatagatagatagataatgatagagatagatggatagatggatattataaggaattggctcctgtaattagaaaggctggcaagtccaaaatccgcagagctgatatcccagtttgaagaccatcaggcaggaagaattccctcttacttgggggaggctcagctcttttttccattcaggccttcaactgattagatgagcctgctcacgccagggagggcaatctgcttgacccaggctacctatttaaatgttaatcttatcctaaagcaccctcacagaaggccccagaattatatttgaccaatatctgatctagtcaaggtgacacataaaattaaccatcacaagcccaccccttgtctacttggcacctgtacacatctccttaaaccatacttaatctccaaataaagacaacagtaaggtcataattccacctaatgtgatgcaactctcctgagtacaaccaaaaacacacacacactttcccctgaagaggagttaaagtccttgagtgaattttattcttttgcttataccctgtaacttaaatactatgatgtaaagttaacaatatttgtgctatagaggagatacatgttatgttacacaataagggaataagagaagacagaaaacaaaattgttggctatacacacacacagatatattcattaaaaaaataaggaggattgattacattcagaatgtctgaatggagaaatacagtaaaatataaggaggacataccataaccatgacagtccttgttgctgtcattggtcacgtggttgtagctggtattcatcaccaccttcttccactccccattctgtattccctttgtcttcagcaggcccctcatctggtcctggctctttacctgctggggtgatctaaaccttccctcctgaagggtctgggctatagtatttctacctgggtggggttgttgaatattccattcaccttactcacaggacatgtaatactatgggacaccctgtgggatctcctatattccagacatcctcttccttacttccattgtggagtagcagtccaatttccccttggcagtcaggatcagtcacccacacaagcataggaactctctattttgcttgttgattcagaggcataaggagctcaaagtggccaggtggcagtcttaacttcctgttcaatggaatcacagttgtgtctcctggtagcagcattcctccctttggaactagacctctatcccagcagaacataaggtcataggaacaggaagtaaaaattttctagtgggtcaccagtataagaataaaagtgccactgccattacctccccttcatttctggacctgtgagtctgactttgggagaaacaccactatgtattgaatgctgattcagagcatatacagcctcctggagaaccactcctaagccccgcaaggtactgccacctagctggtgctgtaactgagtcttcaaaaggccattccactgttttatcaagccagctgcctcaggatgatgggaacatggtaagaccagtgaattccatgccacattgccctacttcgtctgctgtgaagtgagttcctcagtcaggagcaatgctgtgtgaatagcatgactgtggataaggcattctgtgagtctacggagggtagttttgaaagaagcattgtgtacagggaaggcaaatctatatccagggcaagcgtctattctggtaaaaatattgccctttccatgatggaaatgatccagtgtaatcaacctgccaccaggtagctggcagattaccctgggggatggtgccatgtcagagactcagtgttggtttctgccacagcagattgggcattagcagtggctatagctgggtcagccttggtgaatgggaagtccatgttgttaagcccatgggtaacctccatacctgccaccatgcactctttgttcatgagcccattgggcaatgacagtggtggctggagaaagaggctgactagtatctacagaacaggtcatgctatccacctgattattaaatcctcccctgctggggtcaccctttggtgaggattcacataggatgcaaatatcttcagtatttttgcctatttggagaggcccgtccacagacctcttccctaaattttattgccaccagtttttcagtcatgttccttccacatccctgaccatccagccaaacaattggccacagcccatggatcagtacatagtcacacatctgaccatttctccttccaagcaaaatgaacgatcaggtgcacagcccaaagatctacccactgggagcctttatctttcccactgtccttcagggacgtctcaggaaggggctgcaggactgcagttgcccactttcaggtggtacctacatgtcctgcagaaccatctgtaaaccaggactgaatcttctcttcctccatcaactgatcatttagaactccccatgaggccacaggtgcaggctgggagagagaagatagggtagcaggagcgggacccctgggcatctgggccacttctttatgtaacttatgtgtgccttcagcgcctgctcaggccagatcacatgtacaccacttccatctgatgatggagtattgctctgcacacgcaactttatggattagtggatcagctaccacccagttcatgattggtggctcagaacactggtcacttggttgcccatggttaagtgtttagtctccaccaaggcccagtagaaggtcaaaagctgtttcccaaaaggagagtggttatctatggagaatgggagggctgcttcaaaatcctaagggattgtactgattcacctacaggggcctgccaagggctccacacaacatccctacccgccactgacacctcaagcaccactggatctgctgggtcctatggcccaggcagcaaagcagcttgcatggcagcctggacctgtggcagagccttcccctgttctgggccccactcaaacaagaagcttttcaggtcacttggcaaatgactagaaatacgcactctaatgatgaatatgttacctccaaagtccaaatcagcccacaaggcattgtgccttcttttgggttttaggaggggcctgatgaaacaactaatccttcaccttagaagggatatctgtctccacataaccattccacttgacctctggaaatttcactgaggtggaaggctctcgaattttcatcgaatttatttcctgtcccctgacatggtaacggaaatcttcccacagtatttcacctaaaatacgtatgtgcacgacctctagggcacaatgttccagggaagggcattagtaaatagttcttatggttcagcccctggcaagtgtgtggtttcattgagttcaagctaagaacaaaggcaatttaaagctttcctgattacaatgcccatttacacattttgttttatttcagcctcacgacaacccttgcatggtaaacaaggcagatgttggtgactctatttatagaaaagtaatctgaggatgggggagggagtttaaaggaataagcacagggtcactctgatttaaaatcctgacccctctccaatgctctgaaatgcacacaattcagtgcccacccaggaaaggagatgcccagagaatgagtttgtagatgccaacaagacatttctgctcaggtcctgctaagctatagggtgtggggcagggagtggggaagagggagatggcgccaaaagtgttgacaggggaaccgttctaatataaccaatagtactcttgaaatttacacttgctgctgtcctagtcatgcgtggagttttcatgtgtggagttccatgactaggagtcctagtcatgcgtggagttttcatgtgtggagttccatgactaggagtcctagtcatgcgtggagagcaaaacggggcatctgtttgagctacacctgagtcttggttcaacgtctgcacatttgtttaaattgtgtctactggccagcctctctcctggttgttaaagtcaccacatgtaaaatctctcacaattgaaagcaaatttcagggacacagtgcacatccctttctctggggacctggtcactcattcattcatccagagacaggcacagacaggctgtgacacaggagctggcaatgcggtctccacgtggccggaactgagcggctatctggaataaagggagggattgcagcggctggagccatgtggaaggtgccaagtcctgatggaagggttggaactgagactgcacaggcaagaagcctggcttctgatgtgctctggatctttaggcagaatcacttcatccctccagggctctgcttcattcagctgtaaatgaagtggtaagaccagctgatctctgagaactattccagctctaattaattctaagcccccatttactcaacagaaagactgtggtactttcatagtgtttgtgtctctcataaaatatttatctcttcctactctgcagggtaatttcagtgtctgtgctagactgtgtctgtgctagactgtgtccatgctaggactatcatttgggaattgtagactaaaaccatcataacgtattagctaaatgacctggggcggggcttttggctactttctttctttcttttttgtagagacagggtctcactttgttgcccagactggtctcaaactcgggctcaagcaatccacccaccttcggcctcccaaagtgctgggattacaggcaagagccatcacacccagccaagctttgaactcagtttcttcatctgcgaatagaaatattaatgcctttcctgcctgtatcccatagggtaattgtgaggatcagtgttcacaatgggtgtgaacaagttcttgtaaaatatgaaagggtgctctgcataagggattattattatgctaaattgcttggagacctaggctccttgtgttactcatcgaggacccggcagagtgcttggctcttggaaagtacaagaaatgtttgctcggtgaataaataaatgaaagtgtgaacaaaaggtagaagcccaagatgggcaagatacaaagggattcaatctgcaaatgtgttgttctataagcaccaccctccatcctacttccacactgaagtgttcaggagtttacctgtgaaggacgaaaaagcagagactgtcatgtcattctgctgttcaggcccaacgagttacctgcggaggtggcagtgaagagggtttggtggccctgacccagtttttgttctctcagccctgtgatgctgctgaaaactccactcagcttctcagcctaatagctgcagccctttgttggtttctaagcctctttgcacaaaccaataacaaatccacaaatgcctggaggggaaaagatgtcaggctgacttcaatgagtcttctcttctctgggatcttggcccttggtatccctccaaagcctccagaaagatgttttggtctttctctaacagctctgtttgttctccgtgggaggttgaatctgtcataaactagtccatcgtaagcagaagtcgaagcccatgggcatgtttttaacagccctcagttggcaacaagcaagtttgagagtccctgagccaggccaatattctcatggagcagaggggagcctgagccccagccacgcgctttgctaatatgacagctgggtctcaaacactgggtgcctgatgtccacgccaatgtgcctcccacggcaccaggccagtccctccagaggcacccctttgttttattttcttctgtccttgtaagctggccagttgcctttgaccataagatgtaccatgggctcctcctgggccatgcactgcccctcccatgggtgggcagtgctgatgcccgagacactgggcactctgctcaccccaccccctcctccctatccaagctcagaccacagagccagccactccatggtcccagacgtgaggtcagctgtggctggaccctaatgagcctggaaagcctgattacagcctgtggcttcctgagtaatcatggccgcccccctccaccggactccagggtgtgccggtccctctccttcccacgcacctcggccactgttgcccatcttccttggtggcctgaagtgccttccctcagctcagagcagccactagcccttctctagcccttctctcctctgcccctcacccctgccttgttattggcagggtcagtggcaccccggcctggaggggccttggtcagcctttgtccacattccttgcccccacactaactactaaactacagttgttgacttcctccctagccagaccaggtcacgcctgctgtcagtcctctgcccgcatgactcatgcctggcctggagggcaggtggtgccctgctcacctaaggaaggcagccttctgagtccccttctcactcagtggggaccccaaagcactctttagaaaaaggctctggggtcttcctcctccaggcagcacctaggattgcagcctctccttcctccaggcagtgcctaggattgcagcctctccctcctccaggcagtgctgggagtggcacaggagccaaggtagcggcatgggggaaggagattgggtcttagagcctctcgggtctggattggaatcctgacgccagcactgttatcttgagcacgtggccacccgctgcacctgcattgtcatctgtaaaatggagcaacagcctcctgcctgggacatagcagacactcgacgaagttggcaaatgtcactgctctcatgtccctcccttctccaccctgtgggagattcaagaaggcatggagcaggcagagagtgagcagggctgactatggcacgccagcaccgagcagctccatccgccagccgtgacacgggcagcgagggaggcttctgtcggcaccacaggcacctgtcagtagcccacgcggagacccacaagatgtagacaggcccccgataacatcgtccactctatcttctcccggccgctgcctgggacacctcccactcccatctgggttctcagagatggggtgagaagcggcagctgtggcttaggggtggatatagagagggagggaacccttctccctgcatcctccctccactcacgctaggctgcagctcctgggcaatgaagggaatgatatgactgaggcttctgcataaacatccaccaggagcatgtgggcgcttgggcctccacacctagggaaagactccccagagctttccgggaaagaggagctggaaggggctggtcgggaggagggagagttttttctcctttgctgctggcacagaatcccttagaaatcacagatagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagaaatcacagatataggccaggtgggatggctcatgcctgcaatcccaaaactttgggaggccaaggcagaagaatcacttgagcccaggagtttgagaccagcctgggcaacatagtgaaaccccatctctgccaaaaaataaaaataaaaaaatcagctggcatggtggcatgcgcctgttggaggatcatttgggcccaggagttcaaggctgcagtgagctatgattgtgccactgcattccagccacaacagaggaagaccctgtctcggaaaaagaaagaaatcctcacagctggctgctgtgttcttagagaccagggaggagaggttgtccaccaaagatggtggcatagaaaggaatggagttccagaagaaggtgagagggccccagctgtgtgtaggagcagggcagggcatccttgtcccagcgagtcttctcaggcttttcctgagtcaaggctggagatggggattgtgaacttgtccacccagaaggcgagagtggagagagtggagtaccagggagctggggacaagccctgggggagaagtgagcccaggaggagtcgggacagaaggaggaggcgaatgcccacccagacagggaggagggagtggcaggagaaggggtcatggagctgcagggcccttggaagctgagtgagcacgcaattttgtggatgaaatatgagttttggaacagggttgccagcattgccgcaccgccaacagcttcgtggggcgtctccgcctctgtatggctctctgcttttccaaaccgcagctggcccaggcgccaggagcagaggtagggtgaagacagacgctatggctgtgctggttccctgcaggtcctgccagggtggggaggtggctcctgcacaggcatcagcctgggcccctggcactctggctgctgagctgccaggggctcctgcaggccaagggcatctcctgcctcccggcttctctgaggccaggctgctgccactgctgctggccacctttcatccctggctaactcaacaatggaatctcagccttgctgctggcaggccacgtgagccatgcagggccacatccccgtggcgggaggtgggcaagggcaggtggtggcagggaaccgactggaaggtttttattggctctggtggggctggctctgtctgggctctggtttccagtttaggtcataataaaggatgtattcactgactctgctccacttagaaacactctgggaagaaaacaaagaggggcacagcagagggctcagatagcatcagccaggatgaaggggcctgtgccgcagaactgggtacggcagtggagggctcccagctcccagcatgcagaatcccttcccccgagaggcccactttctgccttgtgtcctcagggttggcacagctatgaggggtggagactctcagacccacatagccagaaggacatgaggtcatcagtcccctgtcctcggcactagacagggctccttaaggaagggccgtatcttcatcttggcaactcccgcaggccctcatgcagagccagactcacaggagggtccatggctgcttggtgaatcacccccttcaagcacatactgagttttcctaactgcattccaggctctgtgtccagggctgggatgtgagccgtggctcctgccatcttcctagggctgcacagtctagcagggcccaccagagagtacccagtgtttgctttcactgtgaggtgacttctctttgtatgtgtcaatgaaaagactcacaacgtagtagccttaagagctcagtgaagaggctgggtgatcagggtgggcttcctggaggtactgacctttctctgggctgtcactgtgcccacttactcatactgggacacacctatttctcatgccccactttcttagttttctcctccatgtcacctgacttgaaccctgttcccaaatgactgagaagtcatgggggtggggtgggggtgaatacagtggtcaaagaccatgcatgagaaggtacaggaggtcagactggcctcagagcaggacaggcaatcctggacaaccttggccccttctcgaagctggccagccccttgttccctaatctcagtgtgtgtgcggagcttctcgaagctggccagccccttgttccctaacctcagtgtgtgtgtggagctatcggcaagccttgcagtgagaaatgagtgtccgctggacttgttcaaccctcgggctgtcgccgtgcccgctctgctcatgggcgagcctcgggtggggagcccctgacagactgacctctcccatcttctctccaacctcaggtgcccccggccctccaggaccaagaggattcaaaggagatatgggcgtgaaagggcctgttggcggcagaggcccgaaaggagaccccggcagcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccaggagtgaggtgtctttgagtcctttctgcctgacttgggggcatgatgccttcagggctgcactccaggtgggcctctgaaggagaaccagtgacgagggtcccccaaaaattcaatctcactggagttgggtctaacctcattttagaaacactgagttcggccagggaccaagagcgtctgagggaattactcagagagagcaggaacagagggggaaatgctaagcccaatgcatcttgcagcctggccctggagctctttggctaaaacaagattggaaaacagggcaggcctggacatgtgagtgatacctcctgcttctggcttttgtctccaagacaaggagatagaacaggaaaggaggcagagaccaggccagacctgccccaaggggcctggcttggcagggtctgcggattacggaagaggacagccggatcctctgtgagtcggcacagcagcctcactcactggcaaaatgtgacctagtgcaagcctggagccctgttttttgggtttttttggagtttttttggtgggttggtgcttagttgaggaagtgagcaaaagggcagggggtgaggatggggccaaacatggctgcctcacatggacctcaccgcttcctctatagtgagtagcatgaggtccctcctccccactgacatctgagatgtccacagcacctgacaatgttcaacacaccataaacatcagccattgtcacggtgggacttattatatgggtgaagagcctcctgggccacagtgggtgtgctctgtgctcctctgcaggtgagtagccagcacaccagcccctgcatgtctcatttcacgctccctgaactgtgagagctgggagggacctgggggagtctgaggctcaagtctcttacttctcatgggacaaaccaaggactgagagcagttgaggggtttgctgcacatctggggctggaactccagtctggtgtctctggctagtggtagatccagttctcaggctactttcctattggtgagggtcctcaggaagcctcctaccacatatttcttgggaagtgttcccgccccaatcctgttccctgtcgtaagtcatcaaactgctcttagtattaatgtggccctttggagtatctggacagctctaggtactactgaaatccaaacagcggaacctggggtttaaggggacagacagttagaactgcaaagcttgaagcaaatgctgagaatccctatattcataaattttgtgaatggatgaaacccacctcagagtgggtgattgagtgagttccatgatggaggtgcctcggtggccatggaaacggggcaggttgtgcttctgccctgctggcccttcatcactgtgggaccttaggcctagcactggccctctctgaccttcagtttcgtcatcagaaaacagagggagtggactggtcttgcctccattgagtctgacatgctgtgttcctctgtcctgcaattctaaccaagtgctccttctcctgccctgctcggttattttctggaactttccagggccaaggcgatgaagtctgaacccacattgagtggtaacagccattggaatttcagtctccagattagaagcccagccttcaccactggggtgattttaatccccaccagacttgcaaagccctgaagtcactcctgggcctctttcttttctctctcttttttttttttttttttttttgagatggagtcttgctctgtcaccaggctggagtgcagtggcgtgatcttggctcactgcaacctccgcctcctgggttcaagtgattctcctgcctcagcctcccgagtagctgggactacaggcgtgcaccaccatgcccagctaatttttgtatttttagtagagatggggtttcaccatgttggccaggatggtctcgatctcttgacctcatgatccatccacctcagccttccaaagtgctgggattacaggcgtgagccaccgtgccaggctgcctgggcctccttctaagaagagcaggggcttgctggaagccacagacctggctcatgtcctctgagtgcctctaaaaaccccaggccagcccactcctttcaccctggcgacctcaccacctctccaacccaggcaggacagggggctgggcaagccttctgccgtccctccaactcgtctctagccagggctgagctgacaacttctgttgcgccagccctggatacacctgtcaaaacagagccgcgggagaggagagcagagagctgaaaaacatggtctgaccacagtgaactttccagtggggctgggctaggctgggctggcaagccttgacctgtgggtggtgtgctgagcagcctggctggggattgtttgacctgcaggagcacaggccctttgttttgcttgccttcttctgtcttgcccttttgttttcttttgaacacttccaagtgcaagactctgtgcttggtgtggcaggcggtatacacaggctggtgtagtgccaggactttgggaggccaaggcaggtggatcacttgaggtcaggagttcaagaccagcctggccaatatggtgaaaccccgtctctactgaaaatacaaaaattaactgggcagggtggtgtgcacctgtaatcccagctacttgggaagctgaggcaggagtgttgcttgaacctgggaagtggaggttgcagtgagctgagattgtaccactgcactcctccctgggtgacacagtgagactccatctctaaataaatgaataaataaataaatgcagattgtgggcctcccccccagaaactctgattcagaatcagggacgcggtgggatgggaggaatggggcgggacggggtgtggggaggtgggggaggaacgtgtacttcccccagtttcccagggattctgacgccccagataaaacttgagagccacaggtgtaggagatatagaaaaatattgttttttgatttatgtatataatttcaattaatcttcacaagcaaagtgtgtttgcattttatagatcagaaaacaaggctcagaaaagctaactcgctcaaggccacatagatgttaagtggtttcaaacccaggatttttagaagctgctatactgagctgcttcttacagaaaggtggcattggaaattagataagacctgtgtttgcatctgagattgctgagttccacagaatcaacttgctcaagttcccagagccagctagtgacaaagctgtgacaaggcttcacactgagggctgctgggtttcccggttccagctgcctcgttactaacaccaccagtgagagcagtgcaggagatggcagcaggagtgtgcttctggctgggagagttggcaacttctcaaaggaagccaggtgctgacctcagccaggcccccgacttccctgaggccttttccctaagcccaaagtctccaacataggtgtccaacgaaatcccctgaagtgaggaacaaactattaaatattagaacatctcaatgtgtttcatctattctaggtcacactttgttttcacataatcggatatgatatgaagccagccataaagcccaggatgaccaagaatataatttgaaaatgaatttgtttactatccttaatggtaagcatcaccttaagcacatattatgccttgagacactagccaattgtggtacatgaaaataatttataaataaataaatttacctatattaggaagatg

SEQ ID NO: 38530 - DNA, 12030 bp, Homo sapiens
acacgccgcctgccaggcgtgagtcttcctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaagtaatgcggcgggggcggtgtccctgggcgcggtattccctagggggcggtgtccccgggttgcggtgtccgctcatccgcgttcttgcgcccatgcggcctagctcgccagttcctgcctcctggggtctgcagcagttctagctctcactgtcagcatttgcagcttttgtgttcgtggacgtgtgtcgggttaagaaaacaaagtgacaatgtgtgtttattttgattcttgtcaccagacgtatttttcagaagattagtttcagaaaatgaggaaaaatgaaaaaatataagaatttccttgctaatgttgactttctgtgtgaatttgaagactaaagcttgtcatgataattagtgtttttaaattatgaaagataagtacaataaaatacattgacttttcacactgcttttagttcttctaagtatggtaggtggttgtatgttttctactttaatacactacttttaaagacagttttagaccctgcagaaaaattgcaaaaatagtaccgcgttcctgtgtcctggcacccagctccccctgtgttagcgtcggactttagcttccaacgtgttccagttaatgagccgatattgataagagtgttgctaactgaagctcatactttattcacttttccttggttctgcctgctgtcccttcctgtcccaggtgcccacccaaggtccacgttacattgaattgtcttgtttccttaggctggggtagtgtcccagactgtccctggttttgatggctgtgccagttttgaggggtactggtcaggtgctttgcaggatgcctctctgttggaatgtgcctgtttttttaatgcttagacgtggattatggcttttggggaggaagactacagaggtaaaggccattctcatcgcaccgtatccagggtccacgctggccgtgatcccctgcatgaggtgcttgccaggtttctctaccgtaaagttactctttttgccccctttccttactgtactctgggagaaagtcgctgtgtgcagcccatgcctaatgagtggggaattttgctcataagtggtttgcattctgcacaagggatatgtctcttcaccccatgtattaattcattcatatcaccaagaactcatgggttataatcccgtgttacttagttttgttcgaatgtttccagctcaggcccttaggagctcactaagctcctatgtcctgtttgcataccctgtcattgtggggttttgctgggttctgtgtgtgttaaacactttcctactttctggcactacaagatactccaggctcatcttgtgtgtttcgtaccacagccctaaaatcagccatttctccaagaagccctcgttccttttattggagagagagattagaaaccatgggtgctgggtgtgttcattgcttctggggtgtctgtcttttgggccatctcatctgacgaaaggatatatgtgtttctactaacccttgtgtaaatatgcacctataaacatttccgtgtatagccatctgtctccaactccagacgtactgtgtggatcattctagcctcctctccttgctgatctgtaagtcgcactccaatggtgagcgtggctcccaccatccatttgcttaattgttcagtctcagtctatgcctataacagtatctgaatcctttacttgaacttccatgggaaacatctttatcaattagcgtatagtgtttatgtgcagtttggtaggtgtctttttaagatcctctctctaaccttgggactagaagtagaatttaggtaaaaattatgaggttgaattaaaaccatcttcagcctcttccccacaacccatgttgttatcaattaaattctgaaattttttaagatgtccagtaatgtaacatctaagtttagccccctataaacagttatggtatcataacctcttaaattagcttatgtaactttttgactttgccatcactaacataatgcttattttctccccaaagaaaaaaggtttggtatgaaagtccttccttgggttctcactcggtgagtataagccatgagccactttataatcttgatgggagtgagggtttaaaagttggcaaaactcttacctggaggtctttccatttctgtattggaggggatagtgtctatgtggatgcgactggatgccattggcaacatggagttttgatcttttcaaaaaaaaatgtactgacattaatgttttctggaaagtcatatcttttatcaaattataatatggtaatatccattcagtttttagtgtgtgtgtactgtaaaagtttatacaatatatggctcccattctgaaaaataaatacatcacgtttccaaaaaattactgaattattccctttagcacggtgaactttatggtatgtgaattatatctcaacaaaaactttttttgagaaaatatttactggcagtacttttaatcttggagggttaccaggtaaaatttaaaaggatcccggtttataaaactttatcttaatgaaagctgaggcagctgagagtgatagctgctgttgatctggttgcccatccagccctcccccagcccctgctgtgtgacttggtgagtttggagttgtaacgctgcccttggggtgtgctcttcttcctgatggagacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtaggctgtgtggccaaagagaagaaatgggttgagacagcaggcctggcacttactttacctggcccagtcttgcctgacaattaaaaaaagacgctttagactgggcgcggtggctcacgcctgtaatcctagcactttgggaggctgaggcgggcggatcacgaggccaggagattgagacgatcctggctaacacagtgaaatcccatctccactaaaaatacaaaaacttagccgggcatggtggcgggcgcctgtagtcccagctactcgggcggctgaggcaggagaatcgcttgaacccaggaggcggaggttgcagtgagctgaggccgcgcctctgcactccaccctgggtgacagagcgagactccatctcaaaaaaaaaaaaagccactttagcacttatgaagtcttagttctgggttgcagaaatagaaatgatgctcagtctggtcattggagccctggagacagatggtgagtgtctgtgctgtgcagaggcagatgtctcactgcaaggcgggagtcctgtgaccaaacagcacctggcacattgtcagatagtagaaggtctaagcctgccgtgggaagaggatgcatctgcatgtacctcagtacagaggtacaggagatgacttcctctgacccactcagtgagttgtaaggagaaaaggcagcatcgagcatttttgattagtgtctcagggcaagtggctgtgaggcaagcgtggggtcagggttccggtttggttctgcaaaccaggtggtttggtttgcgggtcctggtgaagagaggagggaggttttggtttctggggccctacttcacctggggacatggtgcggcagcaggaggtggcctccagcagcatgccagagccctggcttgggtgggaggggcgtctgcagctgtcgttttcatctcctggatgttgtttgtcttgaaaacccatgtaagctaaaaagtgacctgtggaggggcggggtctcaggtttccctgactccagacttctcagcctgccgagcgtactggaagacaacgctctctgctgagcagaacgcacacatggaggctgtcctgcagagaagtgccgcgcacatgaggtgatgacctttgctttctgaatgtacttgctttttgctcataccctaaatttctcagctgtttcacttgtaggtggacttgaacttttcattgagtatttttgcttttaaagaaaattttggaggcattttcttgaagttcatagtataatttgcatttttgtataagctataatgtaggttagcatttattaaagtgtgccaggatcactagggatctggagatcctgtcagggagttcattagggtaagacgttatttcacctctcctgctgtgttgacatttgcactgagggtacagaaaccatgagggaagactgctggtgccatgctgccagccagtgctgtaggggcgccatgccacatgcctagagtaaaagacaatgttacttttacttaagaatatcccagatgaggctggacatggtgcctctcacctgtaatccccgcaactcgggatgccgaggcgggaggatcacttgaggccaggagttcaggaccagtctgggcaagatggcgagaccctgtctctacaaaaaattaaaaaattaaccaggcacagtggcagcacacgcatatagtcccacctactcaggaggctgaggtgggaggtatcccctggattcctatcagcccaggaatttgaggtggcagtgagccgtgttaatgtacctgcattccagcctgggcaacggagcaagaccctgtttctcaaagaaaaattaaaaaatccgagacagtttatcaaaaattattaattgtattaaatcttgacccttgagcatgcctttttcatattttttgtaatgggaagtacatgtaaatcacctgctgtctggagaatgctgaacagaaaagcatcagtgagcagactgtttaggtttgggtgtttggcagacattctttcaaaaataagcgagtgaacctaccactccggagcaaacaacagaccatatctgttgccagtgataaaatttaagctttcaagtgaaaatcagaattttaggaaacttgtattcaccactgtgagcttgacaacttctaggtacttgagactcttctgatgagattggcagcgaccttaacaaacgtgctgttgtatgataaactgtgtcaatgcttttaaaatctgcataactaggtgagctgttgttttccaaatgaccagtgcatgaggttacaaaaccatacgctgagagatcaattcaaagtgtgagccagatggtgagttttaatgtagcagagtgtgacaggttggttgggtgtggtttcagattcctcattgcaactatttatatgtttatttatttgagatggagtcttgctctgtcgcccaggctggagggcagtggagtgatactggctcactgcaacctctgcctcccgggttcaagtgattctcatgcctcagcctcctgagtagctggggttacagacgcccgccaccatgcccagctaatttttgtatttttagtagagatgaggtttcactatattggccaggccgggacaactgacctttaataaagtacatttgttgaatttttgtgacaaagaagatccatacttttctcatggctgttaaattctgtcttttccaacacataactgggaggcctgaatttttttttttttttttttgctttttttgagacaggatctcattctgtctcccaggctggagtgcagagacacaatcttggctcctgcagcctcaacctcccaggctcaagtgatcttcctgcctcagcttcccatacagctggaagcacaggtgcatgccaccacacttggctaattttgtattttttgtagagataggatctctctatgttgtctaggctggtctccaactcctgggcttaagcgatcctctggcctgagcctcccaaagtgttgagattacaggcatgagctactgcgctggctcttcttgtatttcagtgagaggaaggacagagtgcagaagcagcagtgagatcccagctgtcttccatgaagctggccttggagaatttgcaaatacataaacaattccatgcttttcattgattttgtgggggggagtgtatatatatattttttgttaaaaatgtctatgtaagcatttagtgggtttttaagcgactttaaaaagacgtagcttttagagttctcagttttagtttgtagtatagtaaatattgatagatagaacccacataaacaaatgctctttgggatcttcagtaatttttaagaatgtaaaggatcctgggaccaacaattttgggaattgctgagctggatgataataaagaaattattcagtttcctcctcagttttaaaaaatgcagaaatccaaatccagctcactgtccagctctctcagaactggaattcctcctttctgcctcccttctcatcatgccccatgtttagggtggggacagacgtagaaaaggtggccgtgtgtgggcttcgttccaggcaccctgcctggcttccctgcatcattaccacacacgatgatgcccaggggtctgtgaaactgcatatcagagaatgcttatttcttactgtttaacaaaagcaagaaaatgagagattattgacaagtgttgaaacagcattgttttctgatttttaggtatcagaaaattcagttgagctgaatgtccctcttcccaactcctgcggtcacccaagatttagggtcaccgttttccatagctgtgtaccaaagatctgtggtcacggctttcgctggttatatgtgccgtgcctacattggccctaggtctgtattatgtgatgtgcatgatacaaatatcacttctgtgtctaatatctgggaacctgagggttgtgtcgtgccagggcgtgtccactgggcacaggaggacaggctgttagtgcacagaccctggagcccaaggctacggcgatgagttcagatcaggttatttgtacagatcgcacaagttgcgttgagaaaagtcaaggcaattgcagttatgatgcattttgcatcccttttttgatgtggtagttgactaaagatgactcttctgggctgaggttttcatttttgagtaatacgataaatctcactcctgcctcttttttttttttttctttttttttgagaccgagtcttgttctttcacccaggccggagtgtagtggcactatcttggctcactgcaagttccgcctcccgggttcaggccattcttctgcctcagcctcccgagtagctgggactacaggtgcctgccgccacgcctggctaattttttgtatttttagtagagacggggtttcaccatgttagccaggatggtctcgatctcctgacctcgtgatccgcccgcctcggcctcccaaagtgctgggattacaggcgtgagccaccgcgcccggcctctcactcctgcctcttggttacatcttgaatcatatgttcagcactgtcacgcctctccactgagtgtcacggcacagctgtgagggtctgtgcgttctgtctcctaggcaccttttgatgtcccagcagaccctgaggaatgtgccaccgatagtgtttgttcaagacaagggaaatgcagctctagctgaggtaaggttttcaaaaaaactttttaaaatttaaaaatttttatttttttaattagagacagagtcttgctatattgtccaggctagtcttgaactcctggcctcaagggatccttctgtctcagcctcccaaagtgctgggatttataggtgtgagccaccgggcccaggtaataattaactttttataacataaacgcttatatgaataaagttttaaatttaagttttaaatcctgaaaagataatgtacagttaaaaaagagaagaggccaggtgcagtggctcaagcctgtaatcccagcactttgggaggccgaggcaggtggatcacaaggtcaggagttagagactagcctggccaatacggtgaaaccctgtctctactaaaaatacaaaaaaattagctaggtgtggtggcgtgcgcccgtagtctcagctgctcgggaggctgaggcagaagaatcagttgaaccgggaaggcggaggttgcagtgagccgagattgtgccactgcactccaggcagcagagtgagagactccgtgtcaaaaaaaaaaaagagaagaaaccactgagaagggaacaaatgaaaagtaatgaaagaaaggtgcaaatgaaaaggctgtccctttctcctgtgcccctgttcccagccaggtccccagaagtagttgctgtttctggttttaatttttttatgcttatcactgtagctctaactagggtatgaactcaacacggccagagttgccctcccacgcctgtctccccctcccacctctcgaaatggatcagtccactttcgtttcacattattggggcttatgagacttaggtctgtcctgtaaccttaagtgcttttattatcattttccttgctttagagatgggttagctataaagattaaaaacatgtaaatatatacttctctgggtggtggttacctggcagttattaagatatgttataccttcaaaaagtcagtcaaaaatcagcgaatagcgtttgcagtattataggtaactgttgttcagtataggaccagacagcatttggatccacagaagaaaaagatccagtttgacatttttggttttcgttaatcagtgtgtaggtaacactaaaaacattgtacaagtaataagcttgacagattcgtgatttcccttgctagaaaaagaaacgaaggagtgaagttatagtccctgccgtaaggaatcagggacagttcaggtcatggcagtgtgctgtgagggcatgagcaaggtgttccctggggaggacgtgccagtctctctgtctgagctcagcactccaggctcctgtctctggggagggaggtcccatcaggtggtgtgggttccagaacagtcactggacaggggagagtgcatgctatgcttggagcaggatgaggacacccccggaggcaggggataggcaggcagggttcgggtggaatgcattgtccagcagggcttgtgggccattgccatggtgtgggtggcatcccatgagcctggctgaggagcagttttcttttgtagtttaggctcccagcattgtgactgtccgcatcatcttttaccttgtcttgttgggaggcttttgtcccccaaggcacacaaattctgtggcaaaactgaagcattttgcaaaactaccttagaaaccagttaatggttagttagttaattcaactaacgcttaactggtttcttcataaatttgactaacaagtctaaaatgtagtttttaaaaagcctcacttcgttatcagagaaaatgtgttatgttaaagtaacagtaaggtatttgaaagcacaggctactgaacaggtcctagtatttgggaagagtcggtggaaggaattgtgcaaagtctgatcaaaagctctgcagtcaacaatgctggtgttacgtggagcccggctgtaagtatggtggtggggatgtggctaacgggtttaccctctgtgttcctctgtagcttgatcagttactggcagtcgcagactttggaccccgggatgaaagagacaactttgtacaaaatgatttcaggtgacgcatgtggacatatgttttgattccctggggtacattcctgggtgtggaatcaccattttccagagcagctgcccagcgccacatcccgagtagcctgcatgatccccatggcacttgcctccagggccggcaatccacattcacaggcctgtgctgtggcctggccacgtttacacagtgagggcctcaggggccaccagaggtgcctgccataactcctgcagtgaggagagggcctcttgtcctcttcgttcattcaacacattgtttattgagtgcccactgtgtgccaagccctggtcaagcacttaggatgcagctgtctttggaacctgcgtttcattaggggaggccgacaggaagcagtaaacatcacagatgggtgttaggaggggagtagagggaggtggggcttgggagagcaggtcgggggcgtggaagtttggcctgtgcatgtacacacacatacacatcttttccaaacatgtagtgcctgacagagcctgcaggtcttggggtgtttgtggggggccccattccaagcccacagctgctagagcaggccttgcctgggggccttagacagcagcgtcaacatcgcctggcacctgccagagtcgggtttaaccagcctgccaggtgcatccctgagctggaagcaaagctccacgctgtagcaggcctggcctgaccgtgtcagcaaggggcagtgtgggggcggcagggcagggagctgagcccagggtgtggaaactttccaaagtggagccttggaggatacaggggctgtgacgtggccttgactaggtgctgttcaccaagaatagactcttcatgaaggcgaatgagtggcaggtctgataggcctcacctgcgattctgccagttgaactggcccgaggcactggccatgcttagagaaaaaagttgcaaacgcttttttttttttttttgaggcagagtctcactctgtcgcccaggttagagtgcagcggcgtgatcttggctcactgcaatgtctgcctcttgggttcaggcgatcctcctgcctcagcctcctgcgtagctgggattacaggcgagcgccaccacgcccagctaatttttgtatttttagtagagacagggtttcaccatgttggccaggctggtcttgcactcctgacctcgtgatccgcccgcctcagcctcgcacagtgctgggattacagatgtgagccaccgtgcccggcgcaaatgcatttattgcatacaggacggtgcacctggactgtgctggccgaatgcttctgacactggagaaggcggaaaccaaagcccaccttccttcactcctgtctccagttaccctcagatagacgtttgggagggttctcaggcgagtagatgtaggaagtgtgatgtgctgttgtgttgtggcgacgacactgtggactaggggcatggtttgtgcttggtgtgaagcctcttcttccttcccagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcac

SEQ ID NO: 38531 - DNA, 97853 bp, Homo sapiens
atggtaacaacggtagtggcagtgggtgataccttagctcaaccattagctgcagctgaagtgtttattgtaagtcaagcacagatctaccaactacatttcttctaattgtagcagatgaaaccacacacatttttaaaggaccagatatctaagcacaaaggtcaacatttggtaggcatgcagaaaacatggaagtgccttatcttaacgggatcatgaatcttcatctttaaagggcagtttttacagattttcagaattgataccttaagttgttctgaacttcaattacaaaagctattgccagattgtgttttgtttttattcaaaatgtagccactcatgaagagaaacttctgagtttgaaatgtgatttgtgtttttgcaaaatgtttatttgaatgcaattttacctccagtctaaacaaatgtaaagataaatgtaaaacactaagaggggcaatgctggcactgaaagcttaactatgtagtagtattgggtttgtcctttaatttttacaacatatgcttttttagtttagaaataatattgtagacttttaagatctcagaattttaagctaaaccactaataacaactgtcttcattatttaaagtgatctaaattgtatagaaataaaagggttttaagaattataaaaatgtagttattgtttcctgcttttttctctaaacttctaatgttcaattcttgtgttttatataacgttttaaaataaatcacaccaaaccttagtctaaagaaggtatagtaatggttggtgtcagatctgagagtgaaccaagcacatgttaggatttagaatcatcaagataaatagtaacaccaatggcaacaaggaagcaatttaaagacaaatttctggaatcaagatgtcaacagtgtattttcccagggatgactgcttctgtttgtaaatattgctattaaagtacatcacctattttctacaagggatgctgacttgtcttattttcttttatatattttggtgactaatacatacttgttatgtgacagattctaaaatattcaatgaataaatgttagatttagtgaccacatcacatgtaaatgggttcagaatcttgcaattcttggtagataaaaccatggcactaaggatctggataagtgaagaaatggcaggataacacttatctatgctaatgagttcagatcttctctcctagataattaaaaccgcaggctactgagataactttgccaaaccatgctgaaagcttttcagttatatctaaggaactgtggagtagagaaaagggaatgggcaattaaggaaaaatatctagattttcaagaaatggaatatgaagttattcacttttcttttttattcttttttgagacagagtctcactctgtcgctgaggctggagtgcagtgatgccatcttggctcactgcaacctctgcatcctgggttcaagcgattctcctgtctcagcctcctgagtagctgggattacaggtgcacgccaccacgcccaactaatttttgtattttcagtagtgatggggttttgccatgttggccaggctggtattgaactcaggcttgtcctgacctcaggtgattcccctgcctaggcctcccaaagcgttgggattacaggtgtgaaccaccgcgcccggccattattcacttttagaatgacaagatgacactaattttgggaaagaggatagcctgatttattaaataaatgacctatggaattcttactaaaaatataactttgcatatatcagaatataatgatgatgaaatggtctagatctgtatatacaactggtctatatagattcattcaaaaaggtgtcgttttgaactcaataatatttaactaaatttactatctctactaaagcaaaaagaaagacttttccgtatttgaaatgaccaaaatctcacagagcatacgggatcacagacttctagagcactatgtagtgatcccctagtttagttttttaaaaaattttgacagagagagattgattaatagttagttagttcttatgtaagtgatccagattccagatgtgaatgaaatgcacatttatgaaaatatatttgtatagctgtagcatatattttaaaaacatgattcattatgtttttttaacacacacgcatgagactgtgtaagttttctttactgactgattagctctgtggcactaggtcgttccttaccactggactttcattaactcacctatccaatgggagataaagttcttaggtcatagggctctgctgaggtttttatatgtatatatgtgtgtgtaggtgtgtatgtatctacatacacatataacctaaaaaaatcaggtatgtttattagttattttattaaaactattaaaatatagaattggcttgctgaattcatggacccaccagttacactgagacatcttttaggtatactcaacttgttcctagtgtgtgactctgtttcctgatgtgcctttgatggtcatatttaattggtgtcaatctagaccttccttacgctcaatttgatgttcttccctgcacatacacacttacatgcacacatttacacacacccacacatacttacataaacacacgtacattttttcacaaagacatttacaaaatcatacatgcacacgcatgcatgcgagcacacatgcacacacacacacccctagcatgcacaagggtggcttgttgctttcccaataaagtcataagattacagatgaaagacaatttagaattttttaaaattctatgaatctaaaagttcagagttgaattatgatgcattcagttaccttttatttgttattttttcttgttttaaggactatgcatatatatgcaaaaaatttacgtgtataaagtgaagatatttagtaatttctgaagaacattcattacatatatgtatgtgtatgtgtgtgtgtatatatatatatatatatatatatatatatatatatataaaatatgtatgtgtgtgtgtatttcaaagctcttcccacatgaaaactcagtgtacattcagtatgtgccagttgaacctgtatgtgggactggaattctgatttttaaaaataccttttctcaaagcctttctctggctctaagaagcttccagatctgtcctaacagcttgaaaaccaagatcttgactttttatagaatacttcactctgtgccagaaactgtgttaagcattttctttacctatatcatcaggatttagtcttcacaaaatactctaggacacatattattatactgattttaaaaggatggactgaggctaagagaaattaagtgcccgagttcatctagctaataagtgtcagacaggaatttgaagtctggtctctctaattctaaaacccatgatatttacaaccctgcaaggaagttggaaatgcatcttccaggctgcagttgtagttattgtgggcatttccttaaaggaaatggtgtcgagaatggttgttgctagccaaaatcagaagtgtcagatttctaactgctgagacttgcctgtcttcaccattctctggactcatttgagccatttgttttatgatccactcttctactaaaaggtggaactagaggtataacaattatttagtacttaattttatatattgttttctatttttataaattgctcatttatttgtctagctcttgtatatttcccattcattccttttcagataatgatgacagtcctacttactgcctctccccttcccacagcttccattcttcctgggaaaggagaaatcagaattattttgctctccccacttccttcagattcatccttatcactcatcactgatggagtttttacagcataattataaaagatgacattttatcctatgacaaacatgccctggttatatcctaactaaatggatgggtgggttttttaattaaatggatgacttaattttgtgatccagctgggaagatttcagttttattagcagctgtctttccccttttcttaccagaacttgagctattagcacctaactcaaaagagaaaatacagagtttgaagttattattttatacttcacaaatcctttcttctaaacattttttcttaggtgaggaagcaaacaaataactctggctaggatcttttaaacaaagctgttaatatttgcaacctatatccacatgacatctgaaagaaatgatggcttagctttagtcacaaatagagagtgctgatacgagtggaaatagaaagaaaagatgtatttttcttcccattaaaggttgagcgtggactttaaagggggaaattctgagtgattcttaaaacaacatgtgaacttttttatttcccccagacattagttgccaatatgtaaacatttcagcaagaaattttataccacctcctctgtttgtcaggcagcatttaatggttgaatgacagacagtgctgagccttggcagttccatagtgatgtgcaaatctggggattaaaatgacagttaatcagtggaccttttctagtataaactccatggccactatttaaaatcagttacttatcaacaaggcagacgatttttatttcgactttatgttttcgtgtaaagatttcacaacttttccctaggggtagtttctgttgtttggatgttagatgcaaaggttccaattcattttggcagtcttgattgcgtggattcctggtagtcattttaattggtatcttgcagacacgtgggagtcattcacacattgtttcctttttctttgtaggtagaaataacacttcaggatatcaatgacaatccaccagtatttccaacggacatgctggatctcacggtagaggagaacattggagatggctctaagattatgcagctgacagccatggatgctgatgaggtagctcaagcatgtctctgaatttgtgaaacttcgtagtgcagtgatttatcaaatttctaggatatgttgactacttttattacccaataattaaggttaagcatgtgtgctcctttccaaagaacattaattcttgaaatgtaacataaaaatgttaaaaaagagattactatcaagaggtaattttcctctgatcagcaatccacaactcacttgctgcttgcactttaggttacttagccaaattattttttttctttaataataaaaatatctaaagaggtatctctattttatgccattattattcccctttgctatcttatagcagctaaggattggtttttattttatttgtaattgttaaaagcaaataatttaaaactacagaattttaaggtttagattactattttctatatttatatattaagttcagctatgtaattattatgtttcaaatggcatggaaacaaatactttgtgatttgtatttttcttatgaaaaaaactccatagcttattttctctttactgggtaaggagtttaactaatgttctggagtttaaggaagagaagtaactttccagacaccagtatctccttacctctttccccttaagccaagccgaacacagaacagagaatttaattttcttcctctcatctaaactcagaaatatcagaaacttgattcctggcatatgaatcagtgctttataaatgtatttctgtaaccttaaaaatttaaataaataaataataaaataattttaactgccaatacagaaaggtaatgacttagtcatttatacattttgccaaaatctaactattacaaatgaacaaaataaagcatacacatttaggtaattgcaatttgctattagaaaagatacgatgttttatgtttagtacattctactcaattttacaatgtgaagttcacacttatttcaaatttagctagctttaaaagagttatctgacttaatatttctattgttgatagatatgtgatatcattagccataattcagtaaatatttcattttcttaaagtttatcattgataatatacattttgatttatcaattcataaaatttcattaactcttatttgaaagtagcagcaataacaaaaaactcatgtaattggcataggacaattgacatcaaataattgaaattgtaatgactatttcattggttatactctaagaatagagcaaataaaactcatttatttgaagtgatttattctaatcactttaaaagaatgaagtaataatcatgttaattataatagatattctaatgggatggctatttactccatggaatattataattagagtgggattatttaataggaattacaggaatcacaggtagaattgcatttggaaatttagttgttttaatcatcatactgctctcttaagaaatggttatttcagagattccaacactcaccccttttaatactgttctcttgatactgttataattttatttccttcccaatattttctctttaagaatatttcatgtaagtattagtataaatgcaatgctgccagcattcttatttttctccatctgacttccgtgtgtgtgtttgtgtatgtgtgcacacacttgcattgcctccaagttcatcttttaagctatgtttacctttatgatgagactagaggaagcctaggaaggtccttatacatctaggtatttagaccaacactggtttttgtgaatttttattttatttctactgagctttgttttttaagtttaaaaaaaaatgtaagtaaccttgcagatgttatcacttagacatgctagttaagaaaaatacagaatgtaaagtgatgatagctaggatatataagaagtacttttgagatgagacagagtcgggtattagggccagaaaagtataaggctataatgttggaatgaacaagagaattggagggaaggctgttagcaattcaagggtagagagggatgctgacaatatgtatgaggtgtgactgtgcctgaaggcataaaaatcaccacattcttataactcgatttgtttgtgtgcgagtgtagaaaggcagagaggatggaagggagtaactaggtgcacctacaacattaaaggaaaggggggcatttcaggaaaactacaaccattgttttttaaagaaaaagctcacaaagttgtttgtcttcttaaatgcatttttctcttaaacaatttaataacgttttaataactgctgactgactataactcttgacacgaggaactcacatgtctttggtttcatattaagtagaatggctgcctatggcatttagaattttgggctgttttctttttgttgttgtttttagttgcttataataaatattaatgcttttagataaacctttgttttattttctactttattctcagctccttacctcttagccaaattttggggaaaatattttaaaaattttctctcttttcaaatcctggctctgttttctttcttcatctagtttgagtaagactcgagattatgtaggtcatcagccaattgtgtagatttttaaaaattatttatatacttttcattaattactttacctaacatataagtgttagtatgctataggaactcttgtagggcactgtagaacaaagcctgggtaaaggaattacaattttataaaacaacatgtacatgttgaacttaatttagatatcatttgaaatgtgttggatcaagatttacatgtttcagaagcacatgattccgtttgtctcttgttcccttttataaattatgctagtaatgggctaggatactcaaactttgcttcgtggtaccatacatgtttttgaaaatactatttaaggttctaatatgcatttgaaatttatagctatttacttttagaattccttctatgtgcttttgtctctgtggttcatccggagagcagaatatttttaaccagcattatttccactgcagtgaagctgaaacatgatatttgtttcttgttttgttgctgatatggcatattttgaatatttagtaaatagacttttcaaaagacctaattaaatcattactcttggccagatattttcagacattcactaatattatgaattcaccacatcagctgattttgaatatgaaaaagattgttttttatcaacacagcctgatatgtttacctcttttcagaaaaattattacaactttaggaatattattatttattacagcccatttgtagacagggcatttctaaatatcaaaccatttttgtaatagcattaaataggtttttgtttcttttctttaccttaatttccaagtacttactattttcatgggtctgaattgaatgtagctacttccatacctcacccactttactaaaataatggaattcctagtgaaacagaacaaatgtacagagtgtggtcagatgagaattctcacatgcttattgaaagtttttgttaaaccataaaattacaataaatacgttagatattcaatgtacacctgaatatacaaggtaaatgtgggtaatgtcttagactcagctgttccattattaaatttaaatgtgctttgaggcattcattttactaaatgttaagactggcctgaagaatgcagtacaaactaacactaaatatagcgggaatatttttgctttagactgttagaaatcatctccttatatgtttgaccatgaaggaaaaaatgtatgtaagctatgatggaaaagatgtatggaaactgtggatgctgtaatcccccactgtgtcagctttacatgcctatacactccaaacttaccttcttcctaatattctcattgagagctctgtgtctttatattttaataaatacattctttgaggttaattacaataaatggtatatttgttttaggtaagtatattaaattaaagagtaatttttgaagtcaacatttctagcactacttatacctagtgtcaaggtcaataataacatataataggaaatctgatactgtattttcccatggatatatggcaactctagttatattttgatttaaattattcatttgcagaagtctaagtcatcaaataaatttaagccatcatgtttctcttataagaaaatagtaagaataagaataaaataacaactatcattttcctgtgcttactatctgtcaagggttgttctaggtttttaaaatatatgttcactaaattaacctccaaaacaatcctttttggcaggtaatattatcatcccagtgtacagatgaggaaacatgggcttggagaggttaagtatgtggtccaatgccacatgactaataaatggagcacaaattcaaccacaaaatatggccccagagcatcatatctcaatcagcacagggtatattaaacgcagtattttgattgtaatatacagaattaagaaatatctctcttccttcttcttctgccgatccttgcttctcttcttttttcccattccttcaccatcattcagtccttatatgagtgttcctatctctatctattctaatttaatttctgaacgactcttgtggcttcaactgacacccacataaaatgaccctcagatatttattttaaacctcattcccaaatctctaattgccagataaccatttctatgatgctattctttaatccctaaatacaccgcaaataaaatttcacttcctatttatcctgcatcaaagcaggtcctattcttgaaatgtcctcagtaagagtactctcttaattgccagccaaagtaacttgaaatttaaaaagacttttttttcttttttgcttttactttgcacatggggttgttaaaaaagtgagaatatatatggaaatgttgagcaaatgagagagctattagtattatttctattttcaataatctgtcaaattttactaatttgtcccatgaattgattcagagcaagacggccaggattccaatcccttaatttcttttaaaatgggcattctaatagtacttaccttgctagtttgcctttaacaaattaattagtgccctggaattgatgtgctcaaggtggcgtttagcagctagcaaacactatgaatattctatttttctctccgccatctctctagttcagaattttgagggtcacagctcaaagacctgagagtacgtaggaaatcacccccattttcattttccagaacagggactttcattttacagaactgtttcagcaacttgggggaaatgaagcctcagtctcttgggccccaactgtattcacaatctgccttctctggcctctccctacactagtccatactgcaatatcaatatccttaaaagattgcttccaattaaaacaatattggggttccttggctgtagaattgaggcaaagttgtgttatatttgaagttctcaaaaaatataccgatactctaacattttagcttgactttcttcttttgttctatattaaaattgtccactctaacacactgttcaacagtaagccaagtccatgaatagtgaatgactgtaaaatattgtattcatttgatacgcttttatttttattttattgtgataagaacattaatgtgagatctgcccttttaaaagatttctaaatgtacaatacagtattgttaactataggcacgatgttgtacagtagatctagaaattattcctcttgcataagtgaagatgtatacccatggcttataagctcctgatttctccctactgtctgtcctggaaaaccaccattctactccctgcttctatgtgtttgaccattttagatacttcatatatataaatacctaccaagcagcatttgtccttctgtgactatctaatataacatccttaaggctcatccatgtagtcacatatggcaggatttcgttttgtttttgagctgaataatattcctttgtatgtatatacaggttgagtatttcttatccgaaatacttgggaccagaagtgtctcaaattccttttttttttttttaaattttggaagttgcattatacatgctgatttagcatccctaatctgaaatgtcaaaatctgaaatgttccaataagcatttcctttgaacatcatattggcacttggaaatgtttggattttggggcatttggattttggattagttttgattagggatgctaaacctatatcacctttttttatctattcgtttgttaatggctatttagtttgtttccaaatcatgaccattgtgaaaaaaggattgctggatcatacggtgattctatttgttatttttttgaggacctccatactgtttttccacaacagctgtatcattttgcattcccaccaacagtgtacaagggttccaatttccccacttcttcaccaacacttgttttggtttatttgttatgatagccatgccaacaggtgtgaggtgatttctcattgtggttttgatttgcatttccctgatgattagtgacactgagtattttttatatacttgttggcctttttttttttgagacaagagtctcgctctgttacctaggctacagtacagtggtgcgatcttggctcactgcaagctctgcctcccgagttcatgccattctcctgcatcagcctcccgagtagctgggactccaggctactggctaatgttttgaatttttttttagtagagacggggtttcactatgttggccaggatggtctcgatctcctgacctcatgatccgcccaccttagcctcccaaagtgctgggattacaggtgtgagccaccacgcctggccacttgttggccatttttatgtattcttttaaagaaacatctatataagaccttaaccatttttttattggattaccaaacttaatagctattatgttgtaggacttatttatatattttgaaaattaactttctatcagatatacagtttgcaaatattttctcacatcccatagattgccttttcattttctcgactgtttactgtagagaaactttagtttgatatactttcacttgtctgcttttgcttatgttgcttgttttgggagtcatatacatgaaataattgcccaggctgtcttttagcaattttcaactaggagttctatagtttcaggtcttaattttaagtctttaatccattttaaattgatatttgtgtataatgtatatttacattcttttgcatatggatatccagttttcccaacaccccttgttgaagtgactatcctttccccattatatatccttggcacccttatggaatatcaattgactatcatgcatggatttatttataggcgttctagtctgtttggtttgtctgtatgtgtgtctttatgccagcacaatactttattcattactgtaactttgtagtatattttaaaatcaggaagcacaatacctctaactttgtttatctttctcaagattgttttggctatttaggctcctttgtggtttcgtatgaattttggaattgctttacctatttgtataaaaaatgctgttaggattttgatataaattgtattgaatttgtaaattgcatagataacatggacattttaacaatattaagtcttccaatgcatgaacttgggatgtctttccatttgtttgtatctttgttgatttctttcagcaatgttttgtaatttggggcatacaaagcttttaccgccttcgttagttagtaagtttatctctcattacctgtttaagtcttataatatcatatgaacttaaagccaaaaagccttcctttgtcaaatacatgttcaaaagaaaatataaggagcaatgcttttctacttccaatagctcagatgcttggtctctttttttagggtgcaaatgctctcgtcacatacactatcattagtggagctgatgatagttttcgcatcgacccagaatccggagatctgatagcaaccaggcggttggacagggaacgccgctccaaatattcactgctagttcgtgctgatgatggtcttcagtcctcggatatgagaattaatatcactgtcagtgatgtgaatgaccatacacccaaattttccagacccgtgtactcttttgacattcctgaggacacaatccctggtaggtgatgggtctcttatgtgtattttgcaagaatcgcttttgaaccaaaattacatactatgtttcggctgctcttaatcaatgattagtttttaatcatatactactagttataaaaatatatatgctggattgttggatcttttcattaacgatctttggtaaaattctcaagcaaatggctaaattttttaggatgaatgaggttagccatttatgtgtctgaaagtatttgtgacatgggttattaattttctgtcaatcacagttttggtactctttctgctttaaaaacgtctaatgtgatttgggggctatgtataaaaagaacagcaaaaaaaaaatacatgaaaaactgtgaatattgattctaacgctcactagctgtgtgaccaacggcaagttaattcatttctcttagtttcaattctctatcctgtaaatggaaacagtaattcctgttagagttaaggtaaaggataatttagaaagtacattgagtttgctaacacagggcttgggtattagcaaatgcccattaagtgttataagaaactgaatctttaattataatcttgcttctttgaacatattatattgtgattttttttagtctgagtactcaatatccatgtttctggtgtgtgtgtgtatgcttcattcccattattggaaatttttatgtaaaattaaaattttattctgaattacatttggaatgattattcatgataagccatacattttagaaactccatttggcaaaggaattaaacatctacaggagactccttctacctgaagttttttcttcactcctcaagatatcttgtgcaagtcctttatggaaatcccatcacacttatttcttgacttagttattgcaatgaccacataagttctagagtagtatcaccagggcataagtctatatattttttggaatcctcagttcctgacactagcaatatgctaccttaaatgttgattgaattcatcagtatatttatggataggtactgctagatggaaacataacatcagatatattattaattcctcaggaaatttatgctgaaacctgaggtccactggatatctgatatgtcacatactgtattcaaatagggaaatggtaatatcaaaatctgcagaatgttatgttcactgtattttcatagcggttttcagttaagatattttactgtacaaatacattttttggtctctttctatatgttctcttagtaatacttcttacttccttgattttatactattaatttattcttttgataggttctttggtagcagccattttagccacggatgatgactctggtgtgaatggagaaattacatatattgtgaatgaagatgatgaagatggcatctttttcctgaatcctattactggggtctttaatttgactcgattattagattatgaagtacagcaatattatatcctcactgttcgagcagaagatggtgggggacaatttactaccatcagagtttatttcaatattctagatgtaaatgataatccacctattttcagcttgaattcatacagcacatctttaatggagaatctacctgtgggatctactgttcttgtgtttaatgttactgatgcagatgatggtatgtattttatttaatataatttttaaaacatctataaactgtcatcagatttatattacatttatttattgtgttgagctgtcacaaaaatgcattttgtgaatataggttggaagttgaggaatagaattataactgaactgtagaggattttaaaaattaagtactttatcggttaaattcttatttataacagaaaacataccttgtattgttttataaactttatcttatttttccccctaaatgtagggtcgtgtttcaatttagcaatgtagaagtcataagaccacttttttttgtataattttgttagataaataaaaatattaggtttacatatgttattttaacttgaaaaggatagaatttcaaagcaaaatgaaaccaaagacttaagtaaaaatacttacgaatgcaaaaactaagtttcacatttttggctgacaaatagctaataatttttttttttttttgagacagagtttcactcttgttgcccaggctggagtgcaatgatgcaatctcagctcactgcaacctccacctcccaggttcaagcaattctcctgcctcagcctcccgagtagctaggattataggcatgcaccaccacgcctggctaattttgtatttttagtagagacggggtttctccatgttggtcaggctaatctccaactcctgacctcagatgacccgcctgccttggcctcccaaagtactgggattgcaggcgtgagccactgcacccagcccagctaataatattttaactaggtttcatttcagctcgaacagtctcagatctgtttaatttatgctaatgatcaagttaaaattttgcattaaatttatactttacatgtgtttgatttgtatttattgcaaaagcaattggcaaactttattttaatagctgactcctttggcctttcttctaacacctgttttgtaagtatacatatcatataatatagcattagagaaaacattgtatggattatcaacctttaactgaattgtctggaaaattagtacgtgtttttcccttatgttggatgcaactaaattgtctcatcaatatataaaacaagggacagtactttgaagaagaaataggtctctattgacaggcatatctatctcaatttagaattgccttattcttatgacttggatgatttgtgaaatctcagaatactattctattttaacattctattctatacttactttccttctcatagtgtctataaatggcacttggaacgatatgagaagcaaaaaggacagtattttatatatgtttcaataagtaaaatgggaaatactttctttagaattcattgagtaagagcattttgatgtttcctcctctaatttaagtgcagttaaaattgggcacaaagatatatctaaaatagatacagctgtaatgctagtactactactattactactactgttgctagtaacaatactttaatgttaacgatgttaataagaatctcaagaactgacatctgccaagtgttttgcatgtacccagtcctggcctaagaacattgcacactctatttcatgtacctcatcccaggtctgtggattggctccagttagatatctgtatataattgaggttagtccctattttggagattggtttatctgctataacttttagttagtctacctattccatagataagaatattttcaaagctaatcatgtattcttatttgtcctgtgactgtgctcaacttttctacagagaagaattttccaccatgtttctttttgatttattagttatgtattagagagagcccattgtttcatagaattgtatgttttcctggaataagttttatttaccatcataacttaaaatatagggaaactgcgaagataccaaaaaattaaaaagaaaaagaaaagaattttgtttgtcaaaaacctgctggaatattccatgcacatgtaagcacagaaatacattgaccattgtctctaagtaagtttttgtgatattttttctttaattgcattgagtaaaagtttcaagctatatttattcattgttttagttttgaatacgtttatcagtgtaatttcctgcaccttgacataaaatatatgacacaattcctattctttctgaatttcaaggacagtgataaggctatacaaaggtaagcttgtttgtaaaactttccagctcagttacacaaaagggtctcaagtgtttcacagacaatattagtcagacattttttaaaaataacaaattaacaaataaatctcaatcactgatcagaaggttccaatgaggtaatattgtcatctttttagatgaaggaattttatatgaaaataaatgtcacaatctgttatctgtctatggattctgtcagagtttaaaatttagcttacatgatgatttcataaacataaatcagatcttttactgttttcacaagaagggtaatacctctgttagcatcaagactactaagcatgcggtattacattgaggaaatatcggagcatcacggaaatattctggctttgatggttatttcgttatcctataaattatttacactttaaatattgggaagtcatattaaaatgttttgctaataatacaattggaatttttgctgaataaatgtagctatataatattggtgtacaatacagaccattgagtttcatatattccagtgacctgatgaccttgttgaaactgctttataaagatgggtgttattcaaaacacttctatgtgttgcagctatgtgaaaagttgacaaatattagttctttatagaaattagaagataacatttatagattgtgagtaaatatacatattttatagcatgaaactatacacctatacttttaaaatatattttactatttatatatatttttatatatttataatatatattttatgtgctgtgcttcttagaacaaaattattcatgagactgaaatactatatatagatatctacatatctatatatagtgtgtgtgtatgtgtgtatatatatatatatatgacgaaaccataaaaccatatgtatgcaataaaactgccaggaagagtcatgtaactaaatgacttggagaacattgaacacaaatggttcacagtgggctgtttgaagtttaaagatctggtgggccattaaagcccactaaatttaaattgcaacacttatggctaaagcttagaattcaaaacaatgtaaaaataataattttacaataatgtgtttactgtctcatggttcagatatttgttgaaaaaatagaaaaaaatggtctgagcttagtatttttcagtatacttcaaatattccgggagaaatttgagttttgctatgtctgcatgtattttttagatgtagtgtatgtggccaaagtcactttttagacttgtcagaaatgaaaagttattttctttacagtaaagtaaatgcagatggattccatgacctgtaattgcagcaattaattttcagttcctgagatgagagctacttcttctataatatggcaatattttatgtaaaaatagttatattttttatttgtttcatcaacaataatcttcagtttatttttaatgttgttacttaatatatttgtcattatgtatttgaatataaaagcaaatttttcttttgttatacttttagttagcttaaaatttattacttcccttacccattcatctaccaaactttttgcctttataaaagaggctgttctgctgtttacaacaacgctataaaattttgggatcgtgttctctttttgcctctgcaatttagctgtttactcaaggaagtagcatacatgatggactaaggatgatcagatacttgatttaattgctcccattcctgttgatttatgtagaaatgttaggccatgtaaaatgtcagtatttttaatgtattttgatcttagatatgaaagattttatatgcttctctagaattaaattttatatctttgcttgttggtatttattttcattcatgtgttttcataactgcatttctcaataatagtcatgtccccaaaagaatggggattcaatatttactgatgaacttttttgtaggaaatgcagaaaattttcttaaaaagtaattaaacgtaactatatatgtagatgttaatagaaacacacgtatacacataattaaaaataaattctgtgtgtatatatagatactcaaatatgtatatgttataatgtttgagtaaatatatatacacacacaatataatgtatatacgtatatttacgttgtaatgaaagtcctaaaagctttatatatatatatgtgaagatagtggaaatttttatcctctaaagcctgtggaattttaagacaaggggttgaaataagctgttaaccttgttctagtcagattctacaattctgtttctttcctgcgggtgaattgacctctgacacctattagctttatttattcatatttttcctgatcttcagactcctaagtattctgaactttgtaatctcttccttgttcacttgtgagtagtcttaaataaactataaagattaaaagtcacaactcataatgagggggaaaaaataaactacgctttcaacgatttactcaatcattgtttatcctagaaatttttgttaataagtcattgtctgaaagttatattcataaatatttttcccatgtttcaaattaggcaaaggatattagagacagtaaagtcacagaataagagtaagtgtggcgtttttaaaaacattgagttctacatggtagaaaaaaatctcatactcaagttaaatttgacttcttaaagaacttgatgaagttcaaaaaaaggcaaaagttaactgaagtattgatagaataatgagaaagaatttttttaaagaaaagagtaaaagggtgattaaattgttctagacgacttttgccaaaagtgaacatcacttctcataggtagaattcagaaacctggatagttgaaattaatgttagaaatatagaagctaattgtaggtaattcaggttagtcagtagatatttgctagtcccagaatatacatctttattaaagatagattacctggatgtacagtacgtttttatcataatatcctgtaatttttccaatgtcattaggataagatataaaaatgcacatcgttacaggccagagaagaaaacatcactctgaggcagaaactgacttctttctgttttcactgcttatttgttatttacctttagttactaaaacagtaagatgatgtatatgctccacatcatttttgttataagactctctgcaatcattttctgaagtgaggatttagaaacaatttttaaactaaaaaatgacacatgatcctaagaaaaatcaacagtatctaaatacagttcaataatagcatgagcatttatatttggaaagttttatgtataattttactgctaacaatttctttaaaaatactttttagaaactttaaatatgtttaataaaatttgaaagagaactattgtctcaaaggtccattacttagctagacacttaataggaattaataagtatttattgattttgacacgaaatatagaagtacacttacagcattcatgactaatgccatacatcagaacattttattaccctttcttgaaaattggtgtcagcctccctaaattactaaagttacaaatgtttgactaatagtatagcgtgtggcactgttagtgttggaccatcaggaattatgtgatagaaacaaggaaatatatagaaaaatatctgctctctggaatatttttctcctctttacttttgtaatttaacatttcaacaccctagtaaatagcaagcagtatatagatcatttgttcacaggatttcctaaagtgtgtttggatgcacggcatatcaaacatgccaaattacttgctaaaagttttggtatagcttgttctgcaatcagcatatgtttaagaaaattttttcttccctttaatttcaggcatcaactctcaattgacttatagcattgcttcaggtgatagccttgggcagtttactgttgacaagaatggtgtactcaaagtcctaaaagctttggatcgggaaagtcagtccttctacaacttggttgttcaagtgcatgacctgccacagattccagcctccagattcacaagcactgctcaagtctccattattttgttggatgtaaatgataacccaccgacatttctttcccctaaattgacatacattccagaaaatacacctattgatactgttgttttcaaagctcaagcaactgacccagatagtggcccaaacagctatattgagtacactctgctgaaccctttgggaaacaagttcagtattgggaccattgatggtgaagtgaggctcactggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtcagtatatttaaataaagcaagtattgtcttaattataagacatctatttgaaaacctcccctcttctacagcgtttacgcttcccctgttctctcctcattctcatccataaatgctcaattgcagatacagcaaattttgaaaaggaaaggtttataaacatcatacctaagaacctcttaatttcctcattgatgaaacttttgtattttactagctttcttttgtgtatactcatgttgcacacatttatgtatttgtgtttttgaattttgttccacaaggataatatctgcacatagtaaaaaactaaaatgatggaaatgtttgaaacttcgttataaatattgttctactcttttccttcatatatttaactacctaggtgaaactgctcttaaaaatttttatgaagccttccaaaaatgctgtgcattagctttacacatatttttacacaaatagactcgggtgatatatactatagtgtgccatttttattttttacttgaaaatctaaaaatatatctttggaatctcttaacatagttttacctcatttttttttaatggaggcattttatttcatgagatgcattgtttgttttactcacatcttggtatgtactgttctacaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcaggtaagtccattacacccttgttcatttgtagataatttctaggccaggcacggtggctcatgcctgtaaccccagcactttgggaggccaaggtggatggattacttgaggtcgggagttcaagaccagcctgaccaacatggtgaaaccccatcactactaaaaatacaaacattagctggacatggtggtgcgtgcctgtaatcccagctactcagaaggctgaggcaggagaatcgcttgaaaccaggaggcggaggttgcagtgagccgagatcacaccactgttctccagcctgggcaacaagaacgaaactcgtctcaaaataaacaaataaattaaataataataatttcttcataatatgagtatgaagtattttctgtttgccattaaatgaaatatttgttcacttttactaatgcttgaaattctgattgcctctatgttattgatggcacatcattcactttatgacatttatatataagtggcaagggcttaaggacatcgccacctaagccctattcccataaaacagaatgaattgttgccctataagcttattgagtacctctggatgtgaccttacactctacttcctgagctaggggcatttaaagtactttagctttggaaacatgtagatggttccaaccacttctcttctgatagacatgggtgagtgagtctgttaggaggagctttcactagaaggtggctcagtattcagtgaagcattggtctaaatgtgcaggctgctcaagaacaaagtcctggttccagggagccaaactataagttcctgatgccatcagccttgaaaatcagggtcagggggaaaccaggacttggaattattagtataagtataaataacagaagtctaaccctaatttctattaaataagaaatatgcagatcagatgtgtgaagattctgcccaatagagttatggaggattctaagttatggagggtgagcaatcagattatcagtaacattatgatatgtggaagcctgtcactcaaagctttaaaaatgatgctgaagaccatgatgggaggcacaaatgagtttcagtgacattagtgtcctaagtcatggtgttttggcagctctaaaaatgaaagcattaattaaaccttgtttcaaagcacagctctctatgggcactgtttttcgagtcgctctgaaatagactggcatttctgaggccactggtggataaatactcaattagatgtctgaagttcacttttatgagtgatacagaaaacagaagttgtgaggaaagttgaactgggtgatcttgaaattaattcccttggatactcttgatatgaataaccacttttttcaggagaatgtgagttttagacatccggttttagaatctacagtttaatcttattttccaagaatgagatctttgacagaggacttaaattacatattcactgttttcattcaaaagtcaaacttgtagatgacatgagaaatttcggaaaaatatggcagctattagatcccagatgcaatgtttttctcaaatctgtagtgttctaagggcctggaaaatatcaaagtgtttcaaaaaaattttgagagtttaattctttatctcacaaatcacctttcctttgcattttttttgaactattaccttagcccagagataggtcaacttcatcagtatggcacagattgcagtggcagtttttaatcatgcaaaccactaaatgtttcaatgtgggagggagaaaacattaccatttaaactctcatcatatttttatttactgactgcatggttacagagtagcacatttggaaactctaactactcctgtctactgctccagtaagctacaaccacagtatcatatgtatgcagtgctaaaagttacattactaaattacaaaaccggaagagggtataataattatatctcatttttcctgtagataattaaattgctaaacagactacaattccattactgatgatatgttgcttagctataacagaaagtatggatattcggccttcattatgcattacttatagttatttcttctggaaatatttactgtaccaagtagaaactcataggaggctaacacatccacctggtatagtaatgcaggtactactacatggtttaaaggagaatttgctcaaaagcagttatgtccttcatatgggttaggcattctactcctaagtagcctttcttacaagagtttgccttaccattttctcatatgtgcaataaataaaataatgttttaaatggagcaagtagcaggaaattatcagggaaactagaagagtatactttaaaaaatgaattcagataattaatttagaaatggaagtatatcatgtagttaaatacatagactttatagttaaaccccagttcacatcctacctctgacattcccagctatatgaccttcaacaactttactattccttcatgtttgtatctatgattggaaatactaatatctatatgaaagtttattgatcaaatagataaaaaggaatacttattctagctattaatgtcagtcagcatgtttactagacatttcaagcttagtaaggccaaagtaacacttttgacttctattcacctccctaccttaaatgaattgcttcatagatcatttcacaattgctgaaggcaaaccttgttattattcttcattcctcttcctctgtacaccatatccaacaaattcattaacaaggagactcagcttcaaaaatgtccaaaagtgtcctgaatttatccacttttctttacctccaaaacgacctccttagtctaagctggggtagtatgatagcttgctaactgcctatcttttctcctgcatggtgcattattcaacaggcaacccaagaacatttaaaactataaattagataatcataccctatctcttgcatagacagcatgcagtgatttctaagaataaaatttaaatgtcttaccattgactacatgggattcaataacttggtctctgtccatttatctgaacccctccaccaccaccagctgccacctttattttgagccagagtcgtgcactggccccagctcaccctttgtctcctgtcagttctgcatttagtatcatcacattattagattgtaattggccaacatggaagtatttacaccctggaaatcagtaagtgctttgaatgtagttggcctgtttcttgaaagcagttgctaaacatttactgaatactgccaatgccaaccaatcaatcaggcttccttaaaaatgccaacctttctgccatgttggccttttgcacttgtagttctctctgcctggaattttctattctacagcgagctgtttggtttggtttggtgagggagaagggcatccatgtcatggtcattttgtcattattttagataaaatgtcaacttctcagagaggacttgtctgaccagtaatgttatgtttgccctttcccttttcccagtgtcactctatcaacttcctctttatgatttcttaacacaaattcctatctaaaattgtgttcttctacataaaatatatgagtatatagagtttgtttaccttatccttctctatcagatttccagagaaagtaaacttcctaagtcttattcaaaatgggattctcagaaacacttagaaaaggacctgcaacataataggtgcttaataaatatttgttgaatgagtaagttatatatgttgaataatgatagttgtcatttgaaagacaacctattattttaatatgcaactgttatttatatttatttaacatacttatatttagtttattgttatatattcattgtttgcagatttttttaaagaaacttccaaaagaaaaaagtgcaaatcatttttaattcatggctgaaattccagaagtttttgctacattggctgtggtcattcaaagtgacctctcttttgaaaagcagcacaagtgtttaaagctttgtggtgtttagtgtgatgtgacaaattgcagtcacatgtaaggacccagtgaagcattttatggctttaattcagtttcaagtgcttaaaatactgcttgagctatattctcatgactttcccctgaaccttctggctctgattcaattctgttatctattagacgtttctagacaggtcgtattgctactctgtgctttactatccaccttttcttactctggttcataagatttaattcaaaacctgcatgagcagaaactacatgcttctgaatagtttttgtttgtttgtttgttttggagagggagtctcactctgttgtgcaggctggtgtgtagtggcatgatcttggctcactgcaaccttcgcctcccgggttcaaacaattctcctgcctcagcctcccaagtaactgggactacaggcacatgcctggctaatttttttttattttagtagagacagggtttcaccatgttgccaggctggtctcgaacccctgagcacagacaatccatctgccttggcctcccaaagtgctaggcgtgagccactgcgcctggcctgaatagtttcaccattcgacaattcttttatacctggttttcccaaagcaaacaattgtgaatcttccatatctcccacatatctaagcactttctaagcacacgtggcaattggtttcacatagcttaaatataagggcccatcatttcacaccaacttaatatgaaaaatttgcttgttttaaattttattatggaaattttggtgttcacataaattattccaacagatatatacttacgcaagtaatttgtccagaccttttagaatttttttaactcaagatgagattataccctcaaaaataaatttaaatgctgtgaggcattaatatctgccactactctttcagggaactgaattaatgtgcgagaaagcagtaaaacaaactggtatgacactttggggatgctacagttatactcagaggagtttttaaagaaagctacatatgaaaaaattctaagttagagaaatctgacattaagtgatggtttttttttggccaggaggtttcttggagatgagccagtccacttcctttattttccagataagaaaattgaaggctgggatagataagcagtgtgctagaacttgcagacccaggtagtagcaaagtcaggtataatatttagaatttctgcctttcaactaaattcttgctcatccatatcatatttattaaatttttttaaggaaatcaggatattccttaaaatatattgctgactctctccatgaaataaatttataaatatgcaatttaaaaaatattttcttttttactttattcatttcactttaataaatgaaacattcaactgctatttttctttccccaaataaataaatgtttgaaaacatttttaaatgaagccaaattaagtggaatcagtaatttcaatattggtattttgaaaataagcttaaatttagacattgtttaaatttaattgttaaataaagaagatataaagaatttgttaggctttatgcctagaagatgataatattggtaattatcactgccaattatcattttgcattaattaaaatcaaactatggtgctaatttaatgcactttataaataagttctgattacagttagtgatatggtttgcctgtgtgtccaccaaatcgcatcttgaattgtggttcccataatccccatgtgtcatgggagggacctggtggaaagttattgaatcatgggggcagttacctccatgctgttctcctgatagtgagtgagttcttatgagatctaatggttttataaggggattttccccctttgctcagcacttctctctcctgccaccatgtgaagaaagacgtgattgcttccccctccgctgtgattgtaagtttcttgaggccttcccagccatgccaaactgtgggtcaattaaacctctttcctttataaattacccagtcttgggtatgtctttattagctgcatgacagcagactaatacaggttactgatatcagagagagtagggcactgctgtaaaaataccaaagtgactttggaactgggtaactggcagagactggaacagtttggagggttcagaataagagagaaaaatgttggaaagtttggaacttcctacagactttttgaatggctttgaccaaaatgctgaggtgttatggaaaatgaagtccaggctgaggtggtcacagatggagatgaggaacttcttggaaactggagcaaaggtcactcttgctatgcaaagagactggcaacattttgcccctgccctagagatctgtggaactttgaactggagagagatgatttaaggtatctggcagaggaaatttctaaatgacaaaggatttaagatgaagcagagcataaaagtttggaaaatttgcagcctgagattgcaatataaaagaaaaacccattttctggggagaaattcaagcccactgcagaaatttgcatgagtaaccaagagctgaatgataatcaccaagacagtgggaaaaatgtctccaaggcatgtcagagaccttctcgacagcctctcccatcacaggcctggaagtccaggaggaaaaaatggtttccttgggtgggcccagggcacccctgctgtgtaaaacctagggatgtggtgccccacatcatagtcactctagccatggctaaaaggggccaaggttcagctcaggctgttgcttcagagggtacaaaccctaagccttggaagtttccacatggtgttgagcctgcaggtgcacagaggtcaagaagtaaggtttgggaacctccgcctgaatttcagaggatgaaaataagcttaaatttatacattgtttaaatttaattgttaaataaagaagatatatgcctgctggggcattgcctcatggagctgtgagaagaaggccagcatcctccagaccctagaatggtagctccactgacaacttgcagctatgcacctggcaaagctgcaggcactcaccaccagcctgtgaaggcagctgggagtgggactgtaccctgcaaagccacaggggcagagctgcccaagaccatgggagcccatgtcttgcatcagcatgccctggatgtgagacatggagtcaaaggagatcaatttggagctttaagctttaactgcccctctgcattttggactttcaggggcctgtagccccttcattttggccaatttctcccatttggaatgggtgtatttacctaatgcctgtaccgtattatatctatgaagtaactgctttgcttttgattttacaggctcataggtggaaggaatgtaccttttctcagataagactttggacttggacttttgagttaatgctgaaataagttaagactttgggagactgttgggaaggcatgattgtgttttgaaatgtgaggacatgagatttgagaggggccagggacagaatgatatgatttggctgtgtgcccagccaaatctcatcgtgaattgtagttcccttaatccccatgtgtcctgagagggacctagtgggtggtaattaaatcatgggggcagttacctccatgctgttctcctaatagtgagtgagttctcaggagatgtgatggttctataagggcttcaccccacttcactctgcacatctcatttttctctctcctgctgccttgtgaataaggacatgtttgcttctgattctgccacgattataagtttcctgaggcctccccagctctgggttaattgtgagtcaattaaacctctttcctttataaattgcccagtcccaggtatggccttatagcagtgtgagaagggattaacacagtcagtgagactattatacttctatgggcttattgatatttaacaagtctcttaatattgctttttcacaaaatgtttatagagcactctactccagatattcttctaggtgctgaagataggctggtgaagaggtctctgtctttatacagcttaaattacaatcacaaaaatagacagtaaaaaataaacaatatagtatatagattgggagtgttatgaaacatgatgcggttaaattaactggcgagagagtgttaagtacttacgtattttacccattttgaaagttgaatctttggacttgatggtagaatcggaaggataggaagctgcaaaaaggcacgaatcaggcatgagtcctagaatatttggatgaacaatttggagatggggagaaaaaagattttagggcaaattaccaagacttagtttttggacatattacgtttgaaatattataactaattgagatgtcacgtagaaagttaaatataaaagtttagttctcagggaagacattcaagtagagatacatcttagaaagtcataaacattagatgatattcattatatgcacacttagtgcttgtaagttccagaatatgtattatattatctcatttaatctcacaatagccctgaaagttagggactagtatctcaattttattgatttataaaacaaccaacaaaaatttgtgttataaaaactaaacaacttgtactgcccattcagctgtttgtcagtgactacaggatttgaggccaacccacttaacaggtgatgatttcttaacaattatttaccaattcccaaatgtcagcctgtctaccatattctgttttatatagactatgtttatacgaatttcttccctttggattaaattttatttttatattaaagagaacattggtttaggaagcaaaaaatcttgtggttctctctaagtaaaatagctggtaaagtcataatattcatgaattagaaatcacagcattattcccctcaataaataaaaaatatgtatccaagggttttattaagtataaagtacaaagcgaatcttagatattatactatgaacgtacaatacatatgatatgctcatacctgcatagacaatgcagttagttgggctgtatgtttgcattgaatttgggggtaggagattaatctgcgcacaaattaaatatgttatcctttatcctttatagataattctcagtctgttgtactaaagggatatagagattctgtctctagatttggcacaaaagtttagttataaagtatttgtgtgtcagcataaatagtaggtcttcagggaacagttcagttattagcatttctaattaagggcatttatcatccaactgaaagggaatatatttcattcttatgcagggattgaaaattgctttttaatggagggaaacatgctgtttttgcaaagttaatgctaaaagctaaaaggagtgatcatcatgctttattttattggtgagcacctggtaacattttgaattgttgtctgtcacattatttagttgaagctggtcattgcattataaatggctctgtaatcaaaagagaggtcagaattgtgtaatatgacattttacatccgaagataattgtttttaaatattccagaaagatcacattttgtcaatattatttgtgggaatgtatgatagaaaagtttgccttgtctgttatgatcaacatttttaataatgaaaattgcttgaaaacttttaaggccccaataattctataaatcaaatcatgctagagttgccttcaattaccagacatgaaatgcatttgacttaattttatttttgagtctcgggcagcttttgttatttccattggcatatttgtcatagatgggaatcttgtttccaaagttgataactggttattgttttaattcctcttatttgtagcagactttctatgaagtttgttagtgatctaaatattattctaaatcatttatttaaatagcattcttttaaatcagctactctttagtcagaaaaaaatatttctacatagaattttatttgtgttttcttaagataaaactccagaaacatttaatttccaaaattccattgaataagagctaaagttgccatcaggttccatagaattgaaatttgataaaacagtttcaatctattatccatttactccatgtgagctacaaatctgagtatacaaagtaaattaaactttgaaatggcaataaactatgattaatatttatgataaaatttatagaaactgaatgataaagattatataaaatcaaaaccaacatgatttcattatgaggatttcattattttcaaaaaagttttctaattctatctttttgaaacaaaccttttttaaagcttattttgataagtattcttaaatatataatttgatattttcactcaggaggcaggcagaggtaggttgagtttaaaattaggtggtagcctctagtgtttcagagtttcaataactgtgttgaaatttttgggtttctttaatgtcctccaaatagtaattcctcatatgtgctttttgcaggcataaaatatttggttattattattttttattttataatttttaaaaattatgataagatgtacttatcattacatttctcattttaacgattttttaagtgtatggtttagtgattaagtatattcactttgttgtgcaatttttcagtggcattgtcataactttactaaagtaattattttagttttacttcatgcctttatttagtatgtaatttatcttaaggaaatatagtgtttttgatagattcctatgcaaaaataatgaaaaaaatattaagtgtgtatatatctaatttatataagcatatatgtagaactaattagcagcaatacattattttataaaacagaatttttaaaatacagaagtgttgttaatatttaaattgttacataccttttgttttatgtattttttgtattcaaattttaatctaaccacataatcttcaatgctaatataggatgactgaatttcaatacattttttagtggatggcttacttactgtgagaaaaatgagtttacttcatggggaaaaaaagaagctaatactttattacaacaaacacaccgctagtcaggggacccatttaccaaatatttgatgtcaagaaagaaaatggctttgttgcaaagcaacagaattaagttaagcagaattctatttctgctgaatagccttttatgtttcagagaagtatttttgatttatagttgctattataaaaaatataatcttcctgacatttgaacttcaatcgtttaaactcattcattacacttattatctgtgtatattctgatagagcagtgacctgaaacttttttcttttttcaaatcttattttaagttttaggccaggtgcggtggctcacacctgtaatctcagcacttttggaggctgaggcaggagatcacttgaggtcaggagttcgagactagcctgaccgacaaggtgaaaccccgtctctactaaaaacacaaaaattagccaagtatggtgacacatgcctgtaatcccagctacttggaaggttgagccaggagaatcgcttgaacccgggaggcggaggttgcagtgagccgagatcacaccgctgctcttcagcctgggcaacaagagcgaaactccgtctcaaaaaaaaaagtcttattttaaattttcttgaacttcatttgatatatttgagctgactaagctaccagtcttaaaggcaatgctagttattagtttaatggtttttcatacttaagagtataaaatgtgactcacacaaggcccagggttaactgtggtatcataaataattggaagattaacctgtgcacagtctctctctctctctgtctctcttcccatgagtgtgtgcatgtgcacaatttggtttgtgtaaattttaagatatgccattcagaatttgggttttcttttttggctattttatgtgaaaactgaagaagaattttatcactttttccatgtttatgttatatttatgtttatatgaatacatatgtgcatacatatgtacacacactacatacaactttacaaatttaaatttgaaattttttcatctgactactaattgtaattaggtttttgacttttcactggagttctgacttctaattcaaatatccactgcatcttcttaacctctacaattacaagtttctgagaccttcacttttaattttatttgtatattttacccctttcattggctcactgtcctctatcaggagcccgtgtcattatatcctgcctctttgtgattgcatctggttttcataaatcaatcccaggtggaattgaacaattttgccctattacaccactacctatataattcatcattatcagatctatttgagctaaacattggccctagtattctgactcttctcatgggattcacgtttaattgggaccttctgtttctaagtagtacactatctgcaaaactttgacctttgtctgtagtcttgttctctgaccccagccttaggctaagtcccagactataaaagtatagtcctagattgtatatttctagaagtgttcaattatgtgaactttcatccatgtagaccaggttttcatatagaaaattagagaaagagttaatacagacagagcacaagacctaatggtatgcattatgggctaatataaaaattaattaaacataattattcctgttttcaattaacttataacttaataggacgtgactggagtacgttgataattataataatatagagcaaaacatctgcaataagagtggcagagttttatctgagcttaattaacttagaaaagattttttttaagaattcaaaactggctctctgtctattctggctaaatggaaattggttcagttctttgggtcttaagttgtttaacaaaatcaaacaagaatacctactttatggaatctgtgcattaaatgagcaatacatgtataaaatatgtatagatctggtatcaaatgtgttcaatgaaatatgtataacacatgcatgtatgtatatgcacctatatttcaatttagatataaatatatgagcaaggtttacagataatgactctgatttcagtttttgacacactaatgttgagactcttcagtaacttgcaagagcagaccaacaaatgggcagttggatctgacagcccagaggcagcagaaagctttggacggaagataaagtaatagtaaacattatgcagcacttcaaataggatgtatccactacacggtgggaaacagtaatactccggagaacctctccacacagttaaaaggaagggttacatcacacaccgggttctgtcctggggtgggatgaggggggagggaaagcattaggagatatacctaatgtaaatgatgagttaatgggtgcagcacaccaacatggcacatgtatacatatgtaacaaacctgcacgttgtgcacatgtaccctagaacttaaagtataaaaaaaaaaaaaaaagcaaacacacagacacagaaaagcaacaacaaaaacacagcgtcttcattcaattagcacataaaagaagtgccaagatctgtggtcgccaaggactagggagtttgtgtcactcatctggcacaaatgcagtgaaaataagattcacttgaaattaagagacattccatttttctcccttgatttcatttttctgtgtaaagctgatttggaggttatgctatcagtcaacaagcaagatgttgtagtgggatggagggttggtaagccccattcacaggaataatagtcaaacacattggaggcacgattcaaatttcaggttaattaaatctcagtaaaaggcttagaaatgtagaacaaaatttctgtaaggtttcctatgaaaaaaaatttttaaaactaacaagacttgtgtgcacatttcctggggtaataagaaagttgagacagttgaagaaattgtacttcacttttcttgaggtgggaaaaaaaaataagaagagaactccaagtgcttatgaagtgggttgtggctgataataaggggagaaaagggatactctggagaaagttcttggcttgaaaacagactcatatagatgtagaatcacctatggggctgatcgtggcttaaggatcatctgccagtcttgagaatcatttactaatctcaaggatcaacaaatgatcctcaagccagaattgtctgttgtcacctgagtgctttgaaaatcatctggaaaaataagttgatattctttggtatgaacacagtgagactgaacttgctgtaagctttccttgataaacagggctcattttttactccccccagcatttgctttctacagtatctacagtaatgtatcaacagtagtaatgtatctacagtaatatatggtttacagacaaagaaagaaatcacatattcttgtccaaatgagtcagtcataatttaatgtggttttccatatgtgtatcaccagacactttagaataccaaatattaatgtaaagactttgactggcggttacttattttctaattgtgaattacagcacaatgtgtatatcagaaatattcagatctttcttgaaatctcactgtaagtcttaaaataccacatttaaaaatgtccaatttactatgtcttccataaagctgtgaatttttagagagctaaatgtctcatgtatttttaccacaagtgaatcattgagatgaattattattcaaaatattttcctgaataatatgagactgaattgaaaggtttggggagggggcagaatcctgagagctgtaatacagaaaactatataataaaaaatgactttttatagtcaatttctgtgagttttttggtctctaaaacaagtacaagaagaacaatgggtaacatagaatataatttatgtgctaggtagtgtcctaagcacattacatttttctcaatacccctttggggtagagtctattataattctcattttatggatgaagattgatttttagtgagtagagtgaaatatcagtaaaagagattaaagaaccctgcatctcctcccatcctttgcctctctggaaccttgattaatgtatcccctctttcagtttctctctctcttccatgacacctccttttgctcacacaaatgcacacatattccctaggtaattttttttttatgcaactggtgggaattctactaacattattcagagcattaacttccatttcataaaattgtatatagtgaaacacacattcaagaaatttaagccaaacattggtactcaacaatacactccaaactgtttattttagccttaatatattgcttgtgagaaatttaaaatctatgccaagattattgtgctcaaatgtcccacaaacttaagctggccagtagtgaaggtccctccctgttgggcctcttcacctcctgcctggtgctcttctaggctcagcgacagagctgcttgtccagacccccaaagcagcgcaggaagcagcactgttccccctactggcagtaccttccagcttcttgtcagtggtaaagactccagggctgctttacatgggtcacatctcagtgacattcctcactaggtctgtggccttgaaaaagctacttaaactttctaaacttgagcttactcatataccaaatggagatgacagcagtgctgatttatggggattagataagacagtttatgtaaacttcttaaaccagtgcatgcatatctaaggactaaacaaatatttactgttattgatatttctttcaatatgttgcatggaattttgacagtcttatttgatgtgtttcttatcgtatcctacattcatatctattttgtgtgtgtgaaatatttgttgcataattttaccattgcttacagtaagcaagtactaaaaaggcatttacatttttttttagtttatagttcattatgcatattaccaatagattgagggctatttttccctttagtgtaaaatcaaacactaataggtaagatttctgaagtcataaactttatgttaaatttttagatatttcttagacgtcaaaattttttgactttgtatgttaatttaaatgaaacacttaatataaaatatcttatgatatatatatatatatggcaacaatgatcagtgtgcagtctaaatttaattgcatcattttctgggaggtatcatgcttctttattgtgctctgctcaactgggtatacacattctttcatctaacctagaattcacaaaaataacagatctccaaaaccatttcattccataatttccccatctgttgattttggttcctatacacacatctgagcataaaagctcattggtactaggccacgagtaattacaatctaagaacatagaagaatgattgaatagtggtaaaggaaataccagcaaatcacttgactattagaaaataatatggtaaggttgtgaatctcaataccattctgtgataatgagggcactccataaacattttacaaataaatgaatgagtggctttatttacagaatattgaatggtaaagttaagtagaatttaaatgtcatattaagggaaataactttattgaaggtaaagtagtatcttaagcagaaaaggagagtatctggggttttattttattttacataaatgcagttaaatggatcttcattgtttctatttagaagagtttgagtttgaaaaacggttttgaaaacacaaccaacagcagataatttgtctttcagttatggggacagcccacagaattccaacacatatggcatctagccttcaccacaaaattagtctagtacagatagtgtggcccaagtgtttggcaaatgttgggttttcaccatatattgatagcagctggaacaggaaataaaaatgaatcatttcacgttacattgaattttaagtagaagcagcacacatgattctgagttagctcatcattatgaagttattctagcacgtagaagataacacttttgagatataacttgaagctattttttgtttcccacagacagtatgggaaagggatttaaatacctcagagactctggaatttgtgatagtaacaatgatagtcacagctgagagtccagtttttaacattgccttgttagttggccagctcttccatgcctgtgggtattcttcaaatctggttttgtgctattttaatgtaatttcagagaaattaccggcagtgcctcttttgtggcattcaaatgatattgttgtgttctacattgttgaatcagcacctttaaaatagaataagagcatgacatatacttttcgtgcagagttactaggaaagagttgaaattctagttcacaaatgaaaacatttgtcttgtaacaaaattaaaaatcactcaatcacttatgtgttcagaaattttactttgatgtttcctaaattctctttagtaattctgtctacagctaatttttgttaaatttgttattttttgtttataaacattgagacttgattttcttttctttttaggatcccctgccttgactggaactggaacaatcaacgtcatagtagatgatgtcaatgacaatgtccccacatttgccagtaaagcgtatttcacaacaattcctgaggatgcaccaactggaacagatgttttattggtaaatgcctcagatgctgatgcttcaaagaatgcagttataaggtcagtacattttcctttgtaaagtttgtctgttttctcattaaacattagtttttgaactacatgaatataatgtttaatttaaatgaacgtcatattaacacatatcctcttcttgttatccattgctgatagccaacaattcattaaatgaagattcaaacagtaaacattttacttattactctaagattttatttaatttttattttatttatatttttatcatatctcatggttttgtggtttgggactacactgggtgcttctgtctcatgaggttgactggtggcacttcacagtatttacatggtgactgaatgatctggaggggccaagatgactttgcatgcctgctgccttggcagggttggttggaaggttcaggatcatcttggccccctctgtcctcaagtagtctcagaacttcctgatgtggttctttagcaaagtagttggactttttagttggtggttctcaactccaagagccacaagtgaaagctcccagaactctcaaaggtcagactcagatgtgccatagcagcacttctataatactctgttggtcaaagcagtggtgaccagctcagattcactgtgaggagaaacatgcatcactcgttgattggagaaatgtcaaagaattttgaccatttttattccactactagctctaataagaatatttgtgtattcttcatttagtaaatgtattttactttgcttaaatcctcttaaaattgagaacacaaatatgataacttgttcagagaggatgtgaaagaaatttgagttgcaacattttatcaacctagattgtccccttcttccatatctattctaaactacaagaaatgaagatttccaaaggttctagagaaaaactcacacacataaatattttatacccctcctccactttctataggctggtattaggtaaattagagttggttagatggctatgaaagtaatggagcagaagataaaatttgagacattaagaattatcagctatgggtaccagatatacggatatggtaatgagctgattcatgtcttattttgttgtttgttaccaattttcttttaacaaaatcattttggaaaactggttttcaccacacaaattttaagaaacacattcagaccacaatacttggtctctctaagaaatgacctttaagctgaaaggactgagctatggaatggaattaatctcgttgttttatctaagaaggtcagcatgtctggaccagagtgagaaaggagtcagagaggtaggcaggggctaaatcatgcaggccatatacaggccatatatgtcacgatacagaattggggttttccaatttacctttaggtgagaaactactggggagttttaaacagaagagacacataaactggtctacatttggatagaatctgatgagagaggatttacggagagaaaccagtgcaccatttaggcactaattaatatagttatccaagtagagtaactttgtacttacgtggagaaatgaaaattgagtaaatagatttggggcatacctttgaaattggatgtgagacaggaaggggaacatcacacaccggggcctgtcatggggtcgggggagggggggagggatagcattaggagatatacctaatgtaaatgatgagttaatgggtgcagcacaccaacatggcacatgtatacatatgtaacaaacctgcacattgtgcacatgtaccctagaacttaaagtataataataaaaaaaaaacaaagaaattggacgtgagatcaaatgaaagagagaaatcagaatcatctaagttttccactcaaacacctaggcagatcatgatatgatatcatttactgaaatgggtagcattgaaggaggaacagttttgtgagaagtcagaagtattctatttgaatacagtttcaaatgactgttactcattcatttagagataccagttaggaagctggagatatgagtgtggagcttagggttggggttagggctggatatacacatttgagagtcatcagtgtttagaggacatttaaaaccaataaactgaatgagaacacgtttgcggagtgtattagtctgttctcatgctgctaataaagacatacctgagactgggtaatttataaagaaaaagaagtttaatgggcatatagttccacattggctggggaggcctcaaaatcatggccgaaggtgaggaagagcaaaatcacgtcttacatggtagcaggcaagagagcttgtacaggggaactcccatttataaaaccatcagttcttgtgagacttattcactaccacaagaacagtatgctcgaagctgcccccatgattcaattatctccacctgaccctgcccttgacacatggggattatttttatttatttatctatgtattttttttgagatggagtcttgctttgtcacccaggctggagtgcagtggcacaatctcagctcactgcagcctctgcttcccaggttccagtgattctcctgcctcagcctcctgggtagctgggattacaggtgcacgccaccacactcggctaatttttgtatttttagttgagatggggtttcaccatgttggccacactggtctccaactcctgatctcaggtgatctgcccacttccgccttccaaagtgctgggattacaggcatgagccaccatgcctggccgacacatggggattattacaattcagggtgagatttgagtgaggacacagccaaaccatatcagagagagtatagcaggataaggaaagaggcactagaaccagtcactgggaattctccaacactttaaaggtaggtttaggaggaaaggtctccaaggagactaggagttaaggtaggagttaagaaggtctgaagttaaggaggcctggctagagacaacagaggaaatgcaggacagaatgaattatttgcatgcattgcaaaaggatggaaagctatatacaaatttctttcagtgagctacatacagatttctttcagtggaccaagacttattccaagagaagagttgagttctcagagtcctgtaaagtcaaatcatagaggactgagaaatttctgtccagggtcataacccgtttgagtcattgtacttagcaccaaccagagagaggcaggtacaactgaacttcttccaggttatgagcttcaaaaggccactaaataccctttcttttacttgtcttataccaaagcatagaaataataaaaatcatatcataagattcaatccaaagtctttagcttaacattaagagtagaaccttgggaattaagttgtgtggaattgaatcctgactctactattactattgcattagtatgggcaaattaacatttctggacccggttttcagtggattaagcagagtaataatgaaactaactttaaagagagtaagtaaaataatttaagtgagctggttagaatagcaccaggaacaaaaaacaatgctcaataaatgtcaacccatattgttctaatcatgcaaagcacctagccctctacctgtctatcatttgttagtgctaaataagtttctgataatgattttggaagagatgccctatctattgtaatgttataatctaataattctttatctgccatgcagatgctgtttcttagacagtatatagaatattaccaatcagatatagggaaattctcttgtatgagatgtataaattcctgaatatgaagttgaatgtttacaaacttgatcctgtcttccattgagtcattcatttatttctataataaagtaaatgctgtgatgacctgctgtttttttctagtgcatgttaaagattcattgcaaaatgctatcctatgcttgtgaattatgcttgtaaatttggtctagaaaaattgtattcatactctcaaactgttttacaaagctgtactggtaggtctgatgggattgttttgctttggtagtatgtattttggttatttgattggttgattaaattttcttcttttaacatgagaattaacattatacttttacatacattgaaatccaaaaaccccatcagtgaaaatcttaaaatgactctacagactatcatatattcagttaaaatgaaaattgaagctatttttgtcttgtgaataaaaaacattcaattcacttgcaaattaacagggcaaacaattattgcagcttaaatagaaaatattttcacagacaaagtaaatagttattataacctcaactttatttactctggtttgataaaatcttaatggaatataatgtattttatggttggtgttaataactccttgctattcatggtatcctgaagaaaatctattctttcttcagattaaaagagctattggtttaattatttatctcccatttaaattttacatggttcggttatttactgaactactgttgggatctccaggagcataaacttttatgtgtcttataagttaatttttttccaatgatctagcatgattttgcatatagcatccagccaacaatgtttcttttttacttctacctatttgatcaaactttgtatttctacaaatggtgtacttactttatgttatacattttacttcacctttagtattttcccttatagaaaatcagactgtattaattcttagtctttctctatccagattatgtctttgccttccacatatctattccagagcttagcttttacagatatgtatccccttttctcccaactggaccaaatctctattcaagccccacttctaattcttctgtatcacaaccctggagacagccacaaactccactgacaaagtcaacattctaaggaagatttcttttctttttttttttttttgagatggagtctcgctctgtcacccaggctggcgtgctgcgtcgtgatctcagctcactgcaacctccgccttccaggttcacgccattctcctgtctcagcctcctgagtagctgggactacaggcacccaccaccatgcccggctaatttttttttttttgtatttttagtagagatggggtttcaccgtgttagccaggatggtctcgatcttctgatctcgtgatctgcctgccttggcctcccaaagtgctgggattacaggcgtgagccaccgcgccccggccaggaaaatttcttaatatgtgctattaatctcttcccattcaatttcctccaactctttaattcaaaagttactcatttttcttgtgtttcttcaagttctctctcttccttgaaccatgtagatatctatataaatgctcatttacataagttagcgtatctacagaaatgctcagaatttctgttgaattctggttcttttatttgcctcccatggcctaggaaagtcattttagtgcctcaaaggcttagtttctgcatcaataaaaatgaacataaaaatttatactttacagtttgtgagacaaacatttactaaccacctactatgtatcaaacagtatgtatggaatcagttaatatccataaatgtctctggcataattattaggacatagaagtcactaaattaattcaaggtttcttttttctttttattcttctcatatcatcttttttactcctaatatattctttcttttacaatatctggtacataacagtggttgtcacttaaataaatgcattgaatgaacgattttaatattctctggaatggctgcttttactcattctatttttactacaacattcttgaaagcttcacaacctgttttctctgaccatttattcctgaaaatctttagtctgattttttttttccttcattgctttactaaaaaaaggccctgtcagaagactactgaaatttttcaagtccagtgacttttctaagtccttattctcctttactttttgcaatgttcacactacaggccaggccatcttttctttttggcattttttcctgctcaatgtctatataaatattatttcttatcatcctgcatctctgatcacacacagtttgttttctgtttctcttttctctctctggaaagtaatttgaatacttctcactgcattattttctcagtacttgtgtgtgtgtgtgtgtgtgtgtgtgtgtgagagagagagagagagagagagagagagagagaatttattccattgctgcaagcatcaattctgtgaacaaaacctccaaatctgtactatcaactctgattccactccaaaattttgcacccatatttataactcgctgatagacatattacactggaggttctgttggcatcataaacacagtgtacctaaaattctttgcttttcctgtttctcattttggttttctgctttgttttaataatattgtcttggtttgttttttaccacaccttgcagctaagggtcatcccctctcttatactcaatcagtggacaaattctcatgtttcttcttttctaatgcatctggcacccattcttttcagtgcatcccttctgccaagatcctagttcagttcataattacatcatgcctgtactattataataagaattaactcacttccacgcctctagtttctaatccttccaatctatgtagtacactgtcctgtaaaattatgaagccctgactatgcaccaaaaatttattaaactctcaggagtttggaactctagggcccataagaagtgcaatttaatagaagagataattttgtaatttcttaagtgtagtaccgtataacaagtatagtttaagcacagaataggtggaaagaatagtatggccaatgatccttcaatgatactaagtagaagtagtttatggagaaataaaggaatgaaagatattctaggcaaagacagtatcaggtactaaggcaaagagctatgcaaaaaacatggcattagagaaagaaagtatttccatatggttggtgtgggttaggaatggactttgtataccatataaaaaattcaaaatttctttctgcatctaaggagagaaacaatggaaatgttttaagcagcaagcacaaaaacatgcctagttatatttcataattatttctttcccagcattataggaaataatttgtacaaagcaaagctggagtcagtgaattaaagggcaatggcagaagtatgcatcaacatgagcatctcttggctctgctttaacaattatacttccttcctcaaaatctttcaattccagtttgcctatggtataacccccagtcttcaaattctagtcaccccataaatggccccagctaattctgcaaaactctgcaacatatggccaaaagttcagtattactggatcattttctgctcatgggacaaggatctgtgctttcccaagccttataggtttgctcaatttattctatatctttgaccagggcttggcaaactactacctgcaggccaaattgggcctagtgcctgtttttgtaaataaagtgttattggaacacagccatgcccattcatgtacctattgtctttggctgctcttgccatatgatggtaagctgagtattgcaacagagaatatatgacctgtaaaactgaatatctttacaatctggcccattatataaaaggtttgctgaccactagcctagaccttcttttgtttctgcctttttgaacactattgaaagatgggtagcccctttacaacttatgttaaatttacctttctctgaggaagctttattttaatcattccagtcaagagtgttctgtcttctgaatacctacagtgacacctctttactgtttcatagcactttactgttttgtaattaccttttttttatatctttctgtcataaaggacataaacttgaaaccaggattttttttaacctacttaaccgtgtctctgttttgaatttttagtccctttatccatttaactatctaaatataggttgagcatccctaatctgaaagtccaaaatctaaaatgcaccaaaatcctaaactttttgagcatgaacatgatgccacaggtggaaaattccacacctgatacctttgctttctgatgtttcaatgttcacaaaccttgtttcaagcaattatcaaaaatattagataaaattatcttctggctatgtatatgaggtatatgaaacataaatgaattttgtgttcagacttgagacccatcccctagatctctcattatgtatatgcaaatattctatccagagaaatccaaacacccctggttccaagaattttggataatggatactcaacctatgtatagatagatatggatagattgtatgtaatagactattacgttatacatatatattatataggtcctattatgttggtaaacttagacttttaaaggctcaccatttatcaattacaatgccaagtgctctttatacaaaatatttttaatagtcaaaactaccaaataaaaagtaaaatatgacctccactttacagataaagaaagaaggcttaaaaatgttaagaaatttttgtgaatttaagtgctattcatggggtttaaatttatgtccaagtgaactatgttctaaagtccagtctcttaactaaatgatcatattctcccagcagacagtataatgcctataaccctagtagatctcaggaagaggcaaagaagttttacaaaatcaaatggggatattttaactttacaaaagcaatagttgatttagggttcagatcacagtggtctctgtttatgcaaataatttgaaatagtaatgtattctcaaattagaaaataatttaacgtgtttattgattttcattgaactaaatgtgaacaaattctatattgacacaacttgagcaagagtccatgttggccttcgcaattggtacattttccgtcttcactacattccctcagttgagttttaccttccttctactgtggaataatgggaaaagtgcatggtgaagtcataaagacagaaattcaaactctagatctgctatttatagattgtatgtttctttgtgcaactactttagtctctgttagattcagattcattatccctaaacagtcaaaactaaaactaaactataaggatagttttgggatttaaataagagcatatataaattgcccagtagtgtgcttgacatgcactaagaaatcaataagctcctggaaatatttaagtaacagcataaatgtttaactgttaagaagataccacaagacacaatctaataaagtttttaactttacaaaaattaatgcaggccagagaagcaagagaggtcatcaggagggatgagaatagaaccaagcctcaagtaagagatgtggcaaaaatctagacatattatcttaactgtcgatctacgtacagagcttattgtgtttcttctatttttaaaattagaagtataaattttcatccaactggtgttatagaacatctcatatttaaaatatacttttatatgctttagaatctagtgaagtctagaaaaaattaattagatattaatgactatttgctcattcattttaaaaaatactaaatatattacctactttaaaatagacagtcatacgggcaatagcatgtgcaatagcataaaattaaaaaatcagaatttataccataggtttctttgtctgttttgtgctgctatagctacagactgggtaatttataaagaatagaagtgtatttggctcacagttctggaggctgggaagtctaagggcatggggcctgcttttggtgagtgcttcctgtgtgttatttcatggcagaagggcagaaggcatcacatggtgagcaatcatgtgagacagagagagggaatcaggctgaactcattcttttatcagaagctcactccctcaataactaactcccacttccgtgataatggcattaatccactcataatgatggaaccctgatggtctaattcacctcttaaaggccctacttctcaacattgttacaacactgttacaatgactaatttcaaggaacatttaaatgatagcaagtctttttgaatggatcatttagtgaaactggactaaaggccacaccatttgcctatcaacacattacgcttaataatacaccatggtcttggcatatacaaaacatccagatgaaaatttatgttttttatcaatctcattttatttttatttgtgaatatttataggaataaatatttgattgaaccttgatccttgccattataaaactaaaaaagtttatggcagcatggcttactttattttcctattaaattatttgattatttctacatccactgacagcaacaaggttccaaaaataaaattacacaattctcaaatccagttttctacactttgtaaaacgttaaggtattttgattattttgtgagtcctgaattttcaagttttaagaattcatgtataaaacttgatatttatattttgataaagagaatatatattatctactgtaaagggcaataattatacctaatagtcacttctggcccaataactatagttaatgctattttcacacatgcctgattctgtcgtgtgatttgccaagcatattaaaaatctgagtgacacaaagtattttatcaatactgaagccatttctcaaccaaaccacttctctattctttccctgttttgctatcattttataagacttctaatagttttaaatataaggtcctcaacagttgattatttcactaaagtaggataaaaaatgctgaaatatttgttttaagctgtgagcataataggagaatgaacatactactggctgcaatatagttttttcccctgcagtttatattagatatatgctgttgctatgtttatatagacacaaagcaaactgtagaaacatgcagccaactccaacaagggtatctatttgttggtataaaagaagaaaacttttaaagatatctatttccatgctatctttcaactttaaaaattacggaccatagccaatttctgaaccttcaagcttagctacttctttcctggctgatctttgggacctcaccttatacacaaaatcaggaatatatgcagacaactgtactcttcagaaagaagagagaagcttttctcagtggaaactcttgcccgttaacctatctggttagcatcaaaacatccatgaagatgtcatacctctcctgacaagaaagcaacaaaaccatatgaggaatgacaaagacagaattaatcactagaaaggtctttgtataaataatcagtccttgagttgttctgagaagcagatacatgtcaaatacaggttttgtcttaaaagaatacaattttcaactgatcttctctggtttattatggtatacagcagaaaaataatttttagtttcatttaaaagatattcatttgtaatcctggctactaaccacaatattagagcaagtcccctgatttatgcttttaggctcatttatttaaagccttaggggtttgtttggtggccttgcacaacttaagagtcctaaaaaccttgtgaagacttccttgacatcactggacatctcacgataaagactgtcaatgtgatgttcacagaaaatttgaaatatttattagctagactagttgtattctttccaacattgttgtatgatctttcttgtaacgttttcttgcatttctacctcagttttttaattatagtaaatagaagttacgatattaaaactatatgacatatccctatttctgctttctgctttagttataggatcatcggtggaaactctcagttcacgatcaacccatcgacaggacaaatcatcaccagcgcattgttagatagggaaacaaaagataattatactttggtagtggtctgcagtgatgcgggatccccagagcctctttccagttccaccagtgtgcttgtcactgtgactgatgtcaatgacaatccaccaagatttcagcatcacccatatgtcactcacatcccatctcctactcttccaggtaatcaaccaaattctgaggccacatggatataaacaaactatgtatcagacatttctataaaaatatttatgatattttacatacatatttctgatatagcctaattttgcaaatcctctaaaattcaggttgttttgtctgatggaaatgaaaaaatgcttgaaacttgaaaattaaccctttcttgctagactaattgtgtataatgttttataattgttatgtattattatttcttaatattacttgaatattataaataattaacatatatattacatcatcgttaatgatgtttatggcctgaggtataactttgtgtaagtttgctaagaggaggggcattgtctctattttgcatgccatatgccactacctgaaacatgatatgggagataataggcattcaactatgtttgtcagtggaaaatgaatatttgacttcaatttttcatagatatgttttcaaaaagtttaataaatggataattcttgttaatatttattttattccaggttttacaaatgaaaactgttctgttagcaagtttatggatccatttatgaatcattttcatattgacaatatgcatttatccttctgtatctctttaaatttagtttgacatttgctaagaaaggcatactctaagaactgcacaaatctgccattttaatttttaaaatgagttttcaaagaggaaaatatagaaatatagctcattattgatttaatcttccttgctcggaaatatttttaattattagaagaaaaacttaacagatagagttaacagatcctcctttcagtgatctttgatcttctattaatctgagaatgataccaatctaaaatataggattcataaatttatgtgccaactttctatcaaaggaaatgtcagtatcaaaatgataaatacctgctaaaggtcttcagatgaaatgatgttggcaggcatggttctaattacatccaatgtgtggtggtgcaagataaaatttcctatgtaaaatgaggtatgcttaagcatcttttcctcattggacttataaccactggcctttttaaaattaaagatattttacttttgttaccgtttcttctgtaggggtgagagtgcaggtttgggaatggtttctgaatgagtagattgaaaatatgtccttatggcagcttttctgcatatttttacgacaatctgtttcattggcactcagtctaagcactaacttttggagtccaagttgagtccattatccctcaattcttatttcttactactttacaattattttaattggcttatgtatatatctgtgtatgtatatacacacacatataaacatacacatatgcacttttttttccatctgataatagttcacgtataaaggaattttgtcataaaacagtggggacaaggaataaatggtaatgaacatgatttttgttgacaagattacatataaagtgattggaagatattttaagacacactagagcaacggtatcattgcattgggtagaggcatagcactttgcagagctcgcatattatgtttcttggaatgttgttttatgtgcagatttttctcctagaaactatgatttttgaacgattagcaagttcttttccctaggcttctctcaaaggcatactgaaaagtattaaatccaacagactgtataaattttagttagaaaatggcaggttagtctctgaagacaatcatagagcagatttgacttgtgaacctcggagaaaatataggagatactgttctccctagtaatcatgagaaaataaggtcacatcaagcagcaatagagtgtcttatatgcacttatctgctaccaaatattttatttaaattccacgtgagtataactgcacactttctcttttataggttcctttgtctttgcggttacagtcacagatgctgatattggaccaaattctgaactgcattattctctttcgggtagaaattctgaaaaatttcacattgacccactgaggggagccattatggccgccggaccactaaacggagcttcagaagtgacattttctgtgcatgtaaaagatggtggctcatttccaaagacagattctacaacagtgactgttagattcgtgaataaggccgatttccctaaagtgagagccaaagaacaaacgttcatgtttcctgaaaaccaaccagtcagctctcttgtcaccaccatcacaggatcctctttaagaggagaacctatgtcatattatatcgcaagtgggaatcttggcaatactttccagattgatcagttaacagggcaggtgtctattagtcaacctctggattttgaaaagatacaaaaatatgttgtatggatagaggccagagacggtggtttccctcctttctcctcttacgagaaacttgatataacagtattagatgtcaatgataatgccccaatttttaaggaagacccatttatatctgaaatattggaaaacctttcccctcgaaaaatacttactgtttcggcaatggacaaggacagtggacccaatggacagttagattatgaaattgttaatggcaacatggaaaatagtttcagtatcaatcatgctactggtgaaattagaagcgttagacctttggacagggaaaaagtatctcattatgtcctaaccataaaatcatcagacaaagggtccccgtctcagagtacttcagtaaaagtcatgattaacattttagatgaaaatgataatgcccctaggttttctcagatatttagtgcccatgttcctgaaaattcccccttaggatacacagttacccgtgtcacaacttctgatgaagacattgggatcaatgcaattagtagatattctataatggatgcaagtcttccatttacaattaatcccagcacaggggatattgtcataagcagacctttaaatagggaagatacagaccgttacagaattcgagtttccgcacatgattctgggtggactgtaagtacagatgtcacaatatttgtgacagacatcaatgacaatgctccaagatttagcagaacttcctattatttagattgccctgaacttactgagattggctccaaagtaactcaggtatttgcaacagatcctgatgagggatcaaatggacaagtgttttatttcataaaatcccaatcagaatatttcaggattaatgccaccactggagagattttcaataaacagatcttaaaataccaaaatgtcactggcttcagtaatgtgaatatcaacaggcatagttttatagtgacatcttcagatcgaggtaaaccttccttaattagtgagacaacagttaccatcaatatagtggacagtaatgacaatgcacctcaatttcttaaaagtaaatatttcactccagtcaccaaaaatgttaaggttggtacgaagttaatcagagttacagcaatagatgacaaagattttggactgaattcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagggtgtctttgaaggtattggccaagaactttggcagcattagaggtgcagatatagatgaggtcactgtaaatgtcaccgtgcttgatgcaaatgacccacccatttttactctaaacatctacagtgtgcagatcagtgaaggggtcccaataggaactcatgtgacctttgtcagtgcctttgactcagactccatccccagctggagcaggttttcttacttcatcggatcagggaatgaaaatggtgccttttctattaatccgcagacaggacagatcaccgttactgcagaattagatcgagaaacccttcccatctataatctctcagttttggctgttgattcagggaccccctcagctacaggtagtgcctctttattagtcaccctggaagatataaatgataacgggcccatgctgactgtcagtgaaggagaagtcatggaaaacaaacggccaggcactttggtgatgacccttcagtccactgaccctgatctccctccaaatcaaggtccctttacttattacttgctgagcacaggtcctgccaccagttatttcagtctgagcactgctggagttctgagcacaaccagagagattgacagagagcagattgcagacttctatctgtctgtggttaccaaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatggcccatgtcagaatggagggagctgtctacgaagattggctgtgagctccgtattaaaaagccgtgagagtcttccagtcatcatcgtggcaaatgaacctctgcagcctttcttatgcaagtgtctgccaggatatgcgggtagctggtgtgaaatagatatagatgaatgtcttccatcaccttgccacagtggtggaacctgtcacaatttagtgggaggattttcatgcagctgcccagatggcttcactggtagggcgtgtgagagagatatcaatgagtgcctgcagagtccttgcaagaatggtgccatctgccagaattttccaggaagcttcaactgtgtttgcaaaactggatacacaggtatgacaacgtttgtacttttctcactaagactttagccatgtcaagtatattgaaacgaaataattttatcattttccaatgattttcatataaatgagcataatagtaacaaatgtttttaaacatttactgttggtcaaatactgttctaagcactttttatgtatttgttttgtttacttcttacaagaaaacttatgaggtaggaatattttccagtttctataggcaaggaagttgaagtagagagtaagtaattaggttttctcaggtgattcagttactttgctgtaatgtcactattcaagtctacacagttaaatccagaacttaagtgcttaatctcgtagcgtctcttacaagagcaaaaaagagaataatatctacttaaaagagtattctagatattaaaggataaaatatatacaaaacataagatttggaccattttgtgtgttaaataattgttaacaatgattgttgttgattctttatcatcatcgtttttgtgaccttttaaaatcatagtcgtcattattatcgaaatgtgatccacatcgtgagaagagcgagaatcatgttttcagatttagattaaaatgatgtgttattgggccaggcaaggtggctcatgcctgtaatcccagcactttggaaggccaaggcgggcagatcacgaggctgagagatcgagaccatcctggccaacatgtgaaaacccatctctactaaaaatgcaaaaattaactgggcgcggtgttgtgcgcctgtagtcccagctactcgggaggctgaggcagaagaatcacttaaattcgggaggcagaggttgcagtgagccgagatcgcgtcactgcactccagcctggcaacagagcaagactctgtcttaaaaaaaaaaaaaaaatggtgtgttattcctaatggttgggtagaaagcacaataggcttatttctcaagaaagctagaacacaactgagccacagcttatcttgacagactagaaagcagcattaaacatagcagtaaaaattttgaactagtctttggcaccctagtgggatatgatgtccatatatacatagatctctacctatttctactccatgtctatatcattattatctatcaacctatctattagttaatcagtggttgatgttccttcaaatgtgaataaatgttatgctattgataagttcgaggagagcaaaattctatcttataacttgcacattatacatttgtaaagcatgcatattacattgagttactctgcagtatttataaacataatttacagtactagtagtataggtagaatcaagatagattgctttaacttttgtagatgtattacagaataatattttaagcaaatgcatttctatgttatattttcaaaagtgtccattatgtgtatactgatggttttatatttggagaattgaatcacttgaggaaaatatagagcaagtttgaaaatgttgaaacagaacatgcagtctttgccttctaatgaaataactttgaaatgtaaatgaagaaaaagtggcagaaaacatgtgtaatagaaaaagtgatagatttcacagaatctgatttagctatagcttttgggaagtcacctaaccttagctgattcttcatttctctgtccacaaaatgggaataatcataagtactttcagggtttttgtaatgagtaaatataatgtttgtaaaacacctagtacaggccaggtgcagtggctcacgcctgtaatcccaggactttgggaggctgaggcaggtggatcacctgaggtcaggagttcaagaccagcctgtccaacatggtgaaacccatctctactaaaaatacaaaaattagctgggcgtggtggcaggtgcctgtaatctcagctactcaggagactgaggcagaggaattgctggaacccgggagatggaggttgcagtgagctgaggtcgcgccattgcactccagcccaggccgacaacagtaagactccatttcaaaacaaacaaacaaaacccacgtggtacactgtgcagtattcagtaattgcagtctaattagtagtagtaataatggtattagtatagtggtagtaatagaggagtaccacagaatttttaaaaagacatgaaacctgtgtagcggaagttaactgtgagtcttatgagagttatttatatgctaagatcatgaataatagagctatatacatgctgaggtcaggatttctagaacacttccctcactctttcttacccatccccaaaattactttatcggctgggaattcaacaataagagtttttatattctacattagtctaatgcatttattcacacttaggtttagattgagtttacatttagtcctagaatgaagaaagtgcaaatgtattaggtatggataagaaacatggaaagtactactggtgtgaacaaaggcaccatttgctgattttagcataaatgatgagtaagttacttctgtctggcttgtttatttctttgtttcatttcatttaaatatacattgcatacttttctaaacgtgatagttgaaactcttaaaaatgcctttccttacatcataaaatattaataacatttatcaagcagttatgtaaagcactttttaaatctccttgcattatagacattattacatttagttcttacaactctgtaagatggatattatgattattgttccaattttgaagaccaaaaaattaagtcttcgagtcattaaaagagattagacaacttgcctccagccatggcacagaaagtgttctaactagttttttactagaaacttggctctggtgcctctgctatttatatacatgtcgcactcatcacactttgatttgcacttgctatggagtgttatggtgagttctatggtgatattatttaagaatgttttgtccatcattctattaatacttaatcctcacagaaagcctataagacagtgtattgtctgagactgatcagaaatcggaactactctcagactttgaggcaggaaagtatttgctacaaggaaacagcttacaaaatcttcaaactggctaagaatacaggtcaggaacattcaccaatgggcgcagcaataaagacatggcaggcattgcaagacaccgctgctgatcctcttgcccacctgcagtgctgcaccaagtgatctgaggagaatggttcctgctttgcttttaccattcagatatcatcacagtcttttttgctggcagaatataaacttgaaccccgctggaagggagtctggaaaaggtagttttcagacttccagcccttgcaatatggaaaggtaggaacgatgctgaatgtcagcagatgatatgtggctcaggaagatgttattattcttcctgttttacactgtaggaaattgagcctacagtctggtgactccagggccagagctgccaaagtctatatcataaactctttctagggaaggttgtttgaagttatacattaacgttacatacttctcctcagagttcacttcagtcttcatttgcatagtaggagataatccaactgatcaggaatgatataaacaaacataaaattgaatgattaagatgaatcttacattttttaaatcaagtttcaaattctgtatgaaaaaaaccatccagtaaaactggcagataattaatgtctgacagttttatttcctttttgtattttgtaggaaacaatatgaaaaaagcatagtgagtggcaaatgttaatccatactttaaattagaaatgtattgcttaaatttctatagtttgttaattttttttgtagaggtaatctctgaaggatcattctgagttattctttttacctagtctctgccagatagcctggctcaggaagacagagctaatataccaaaacatcttaacatctaacctagtcagagctaataaaccataagacaaaatttacacataactgtatgtgtgcctcatagaatgattttttaaaaaattactcataatagctagattttacttcagttaacatgaattaaattgtagtgccttagtaaagcttcacttcttcaaggtctgtatataatttttggccatcagaattattttaaattactgtatttttcatactctacttttgtgggcttccacctgcattttatcaataggtttcaaagtctgtgaaattacaaattggagctgcacaattttctgaactttctgcttaaaataatcctcagccactacccatacccagtttctctcatacacacacacacacacacacacacacacacacaccactgagtattttatgtggatttagaaattgtgttaaggattagaagagtaagtggcttatgagttgatgcaaactaagagactttatccccagaatcccctagggtgtgattaaatgttagctgaatggagattttatgtagagaacaacttataaggacgcaagtatgaaaatgataatcatggaacaaaaaataggaagggatatagttattatcatactgtcacaagtttatttctgaaatattcttaaagtttattttcaagtctgtaaccatgcacataagtataaaacaactatattttttaatgaatgagtgatttagagggaatgaatttgtataacatgtatttcttatctcttttccttagttactggaaaaagaaccaaaagaaaattgaaaaaaagtaacatattcagttataatcacttcatatgtttcattattaagaaaattttcttataatttttatattaatatcaccatatgaagctttgattaactgtaacataaattattagaaaagatggataaagtttattatagtataggccatgtgaaaaattaatttctaaattttcacaaaatgtaatgacaccaaaaattaacatcagttgtcagtatgcctcagtgaataaaaactattattcctgccacataagtctaggggttcctagaggaaaactttagcctaataacgacacatgtagtatttattttcatatacaaatgaaaatgtcttgcacttaatagaacactaattagaaagtacagtaatagtaaccacatcaacatttgtctactgctgccaggttttcgctgtttgcatcacattcctggcattaaatccttcatgggaatggatggtgttataaaatgcagcattttgatagagcttatttataaatctggctatcttataacataattagttcatagtctctttaaccttttccattcactttcacacatctggatgcatttcaggtgtagtatttggaataatgccgggggtttattaccttatggagaagttttcctatgttctcaattaagtcccgatatttcaggaaagatgaggtttgttcattcatcacttttatgtcatttgacagtataaacagtaaaattttttcagacataccaacttatatacagaatatgcatagtaattttactgagaaacttgccagatatttgctttcataaagatggaaagagttactaagagtgattcttttaaaattactacggtcatgtattggtgttgttgatgatcatgtgaccggaaaaccatataatataaaagaaatttagtaaatatatatgaaattaaattttgtttgagataaagaagagtggctcatgtaagagacaataaagagtgcaattatttttatttaatttgattcctgaaagcagaattaggcagtttacattaggtaatacattaacttataaaagcattaataacgtatgtttctaagaagtagcttaaatgcttatttctgtagaaaataagcatatatttataagcttatgaacattatgtgtgtaatcatatgtaatcatttgtagtctcattgaggttgtgtttgtgcttgttttacaagacaaaggtaaaaactttttttggttgttgcttttgttactggcagcccttattaaaacatggtatttttgcttttgtttcaatgcaaaaaagccataaggctattgaacaggatacttagactatcttcatagctccttaacaataatgggaaacatttgcatactgtgcaaaagacagctactttttgctaaaataatttggaaaatatataagataaatgcctagaatgaatagcatatatttattatagaatttctttattaataacataatcaatttagacctaaaatggatttttagagttgcacatattctcccatctcctctgtgtagaaatacaggagatttaaaaataatatttatggtagtctaatatgtatatataatctaagatcttaaattgaaggctacatgtatcatagggtatcaaaaattatcgtatcttcatggagtggtccaatttagcagttgagaataaatttagctctatttcacataatccaacattaaaatgtgcttggacaagtgaaacttgaatatacattcttgttgaaaagaccataggtgattacaatagattcagtttatgttcaacacgtcatcacatcttctgcccccaaacatgaaaatagacacaaaatttctcctgtaagtttaggaaagtctgcggataccatggattcctattatgcatttattttcaccttaagctattcccactttccatgtgctaagaatttacacttcttcaagcacatctccttctagttatgataaatagtgtatggcaacacaattaattgatggatgtcaaagcaatgagatcaatttattcttctaaacagctgctatggcagtaaacatatcttaatggaaggaggcctcttgagttcaagaggaataaatgcctgtctttgtgcaagtcctatcagcatacttccaagcctgaaggcgtttggcaagtattgttaattgacttgtagcattaattaagttaatgatccaagattttgtttcacagtgcttcaacacatcagattattgtaccaagagcatgttagagtaattcaaactactgcattctctgatactcattatgctattaacactacaatttaagtagatagacttgcacaaaacaattcagaattttgttaatttctaattgggtaaaaaagcataaactttccaaacctgagaaatatgcatttagaagctttcttttgattctaagtaaaattatggaatccttttctcacacaaaagacacaggtgttttaaataataatttaaatttaaatctgttttcctactatgtctttgaattcaagtatctgctatggcaacctctgagttcatgaattgtaaaaaatttttactctttaaatggagaactcaatttttaaatagtaaataatttacatactctaccaccaacagataagactattttttccaaactcaacaacaaattcctttatttaaccccaaacaaagccattttatctatttttttaacttatattttaggttctgggtacatgtgaaggtttggtacataggtaaactcatgtcacagggttcgttatacagattatttcatcaactaggaattaagcccaataccaaatagtgatctttcctgctcccctccctcctcccaccctccaccctccagtagaccccagtgtctgttgtttccttctctgtgtccatgtgttctcatcatttagctcccacttataagtgagaacaggtggtatttggttttctgttcctatgttagtttgctgaggataatagcctccagctccatccatgttcccacaaaagacataatcttgttcttttttatgactgcatagtattccatgatgtgtatgtaccacattttctttatccaatctgtcatttatcagcatttaggttaattccatgtctttgctattgtgaatagtgctgcattgcacattcatttgtatgtgtctgtatggtaaaatgatttatattcctctgggtatatacccagtaatgggattgttgggtcaaacagtagttctgcttttagctcttgaggaatagccattattaattatttgtaattatccactaagacaaagtaaaaaggaacaaccttatttttaaactgaaatactgaatgcaaggttgaatttgttttttcttaacaatttctatttctatttgtgtatacttgaagaatcagattctattgagaatttaagttttataggaaattcgttctcaaaattagtattttattggtttgtaacatcttctgccactttgtaatcactgtatgttttaataaatgaataagtcttatttgtgttaggatatatttccactcctcactctggagtaactgcaatagcctgtattttatatttaaattaaactcagatgtctatgttaaaatattttatacagggttaaataagaattgattcatataattatacacaaaaagaacaacacgtaaatttcatttgttgctatttaactcaagatttataaaggtagtatttgtaaatgaaattcaaaaaacatatagtagctttataggaacaatgacttgggatttatactcatatatttttgtcagagagcacatatgtccaattatttgagtaagtatacatagcagtaccctctacatttgttacttcttatttgttcctcatttccagtcgttaagaagtgaaggtggcaattttgtaacccactaacatgttttcatgataacaaggctatattgaacacacttataaatacatatataagtctatgtattttatacatgttacttttaacacaactctaaaataattttttggataaagaaaggaatgaaagaaagtaaaactgtacctagtcaaaaagcacaagtgaaaattatgtgtgcttttacagtgaaaaccaaatggaaagagtagaatattactttattgatgacaactaatcaaaaatatggccagtagaccttatgtatttgcaactgggaaatactgtgctgtaagaaaaaaaaatctacatcactaaaatggccttcacataatcagttgaaaaacaaaacaggaaagagttctgtgaaaccgcaactctctggtgagaaatcaagcactatttgaagttttcctgcctatttctccaatgtagtacactgctacaatacttaaaacctgatttctgtgcccataaatttgtaacttgtttattttcatgcccttgccttaacaatacaaaggtattctgaaattgttagctcaatgttttgccttataaggaggttcccaatttatttataagggaaaaaatgttgtgtttatgattctgtgatgtacagaaatgggcttagttagcatcatgagatctgactcacacttataatttcagaccagaataagtgtggctccgtaatcaagccacaaaaacagaaccaatttaaacaaaattttgactgtgttttaagcaaagttagtatgatgaaatgaagtatctatgctcagcagtaggtctcgttgtgcatatagaatgcatatcatttcctgagctatctaataaatgcattagtgaaattgggctgggaagtagaaagtaacttccagaaacaaatgatgtagtatttacaatcctactctcaatgaaaagaaattaactaagaattctgtaacatctcactgcattatgaaatttgaaaattagatcctaacgaatgtatcaaatgattgcaatactttaaagttatagaacagtggtattagaacatgtttaagtttaggtaaaaataagtaacaacaacaaaaacaagtgggacttatactccaagttttatacaccacgtgatcaactaccatagttttgtgaaacctggatatgggagcagaagccctaaattggtctgtgtcatagttttacagtttcacagacaatatattagcctccaagaggcttttattcttcacttttgaaatgtaaatatttcctttgtatggattaatactccctactgaaatggaaacacagtctgaagacacttgtttgctttcttcactgccatatccccctccattatcatgtctggcccataataagcactcactcaatattagttgattcaatttaacaagatcatgtatgagaaaagtctttataaactgaaaaatatgctgtttaggtattatcgcttcagacaaaagacaaagtatacataatctgtagtcaagaataaattttcataagcatttgaaaatatgatgtgttttcttatttcttattctgctttacaacagatatgtgtaattcaagtgatatttcttagtagtagaaagagtgtagtttgataaataagataagttattatctttgaaatacctaagtcaagaaaatctctgcagtgaaaagaatactgtaagtttcaactttctatctataaaatataaaagatgaagggacattgacacagaaaataaattcagtgaaagcatttaaatatgtttatcatgtcatttctctgcaaacagtattttcttccaagatgattatgtaaattatttcctaagtattataatgcacattttacaataggacaactaaacaagattttaaattctaagatattattctaatttccttatgtcaagtaaaacgtttttatatttcttttctccgtgatatgccttaggaaagatttttacgtatggtaatggtgtaacggtgttaatatatttatgtatgagatttaaaaaaaactgaatttgatatattttagggaaaatgtgtgaatcttcagtcaattactgtgaatgcaacccctgctttaatggtggttcctgccaaagtggtgtggattcttattattgtcattgtccatttggtgagtaaaacttatttgttgatataaaatataagtttatttttgcacacagtttagcaattttgttttattatgagtatgaaagaccaaaaaattattgttttacatggaaggttttattaaaataaaatcttaaatgtttaacatttgtaaaagttatggaaatcccattgaatacattgcattggtcattactagaaaaagagtcaactcaagataattgaattaatattgtttccataggatatttccccccaaagatttatggatatcttcttttcagctgagaagttatgaaataaaaaaattctgtaagcactctttcacgtcactctctatttcaaatctttaagagtagtcaaagtaaggttttttgtttgtttcacttttgtgaattttgctttattttttatttttgttttttacattagtttttaattttgttttttatgttaattcagccacttttattagaaggacttagtaactatacctgacgttttcataataggctttttgtagctgatactacctgactaataaaatttcagactaatctgtcttttggataagaaaaattgttaaaaagaacttttttgtatacatacatatttattcaccctagtggaatgaactaaaagattccttccaggtcttatccagctgttacccattactgtgccagccaaaaaccatgagattcagaggaagcatttgtattagcttggcttgtttcataagtttgtgattattccattctttttaaaggctgctttacaccacagcatagaatccatctccaaatgactctgtctcttttctttttttttttgtcccctttgtatatctatttatttatttttttattatactttaagttctagggtaatgtgcacaacgtgcaggtttgttacatatgtatacatgtgccatgttggtttgctgcacccatcaactcgtcatttacattaggtatttctcctaatgctatccctccccccttccccaccccatgacaggtcacggtgtgtgaagatccccttcctgtgtccaagtgttctcattgttcaattcccacctatgagtgagaacatgcggtgtttggttttttgtccttgcgatagtttgctgagaatgatggtttccagcttcatctatgtctcttttcttaagcaagaaagagcaaggatatttttctagtcttcctttgggcatataactgtgctatatggacctgaacagtaaagctcaatctatagtagataatagaatttaaaagacatacgcagttcctaataacctgtataatttactaggtatttttaatttccaaacaacttcatgactatctgtttttattaagcacatccatagaatgataaagacaaacaaaatagaaaaatatctaattttgaggaatgtattttaccaatggttttgaggcccagaaattggctgatttgcccaaagtcaaaaaatgaagttgaggcaaaactaccccaagacgatgtagcaactagaacacaattttttattttcagtccagtatgacattcacagaacccctttttatacaatttctttgaaattctaacaatgcctgtgaagtaatgaaaggtatatcaaggtcaaaataaccacaacttgagatgtccaaaaactttttctttctttcaatggtgtctcatcattttaagtggtgctgctttctacagataaccacagtcaaatttcatggtttaacttaacattttgagataaaagataaggggattagagtgtaaactagaaatgattttcaagtgactgaacagagatgttcatatttttagggatccctttgcaaattttaaggatttaagttttgaggattttgagttgcaaatttggggatttaagaaaattgatacacaataaaaacaagttgctgctgcagtgtagtggtacaactgtcgttgcctattaagtggaactacttgaggggccaaatgtaccttcttgtcactctgtagacatcgccaggggaagaggaatagcacaatgtaaattaaaatagacacaaatcacacatagccggcagtgcaaatttctccccctattccttccaggggcaaagacaaaaaacattatctaaacttagatattgtcagttgacaacataagcacttacaaaagaaaacaaaaatcactgaaacactgctatgtaatttgaaactaaagagatagaagcagaaacaaaaatgatttttgttctcaaatggaatgtggatgaaaggtacaaataaccatgtcagatggcatgcctcaaataaatagccagaggtaggtagttacacttgcatcctttaaaacaaaactttatcattttgaagttagaaaaaagttttttgcactgtttagcttctcatcaataaaagattggctatttggatttcaaaaaattttttcgatacttagattttttaatttaaattacatcttaggaaaaacatagtgcttcagacattataaaggcgacatgtataattataacttcttagaattaagatgcgacctttctgtgaaaacagtaccaaaaccttttaagaataaatattttaaattccataaagaaatattttcatgtttgaaaatacagtatcaatttgaattaaaatgtaagtatctatatactttctccatatatttacactcaaatattcagcacattgttatagatttattgaagtttattcagaagagacctaagtgaacacataatacaaattttttcagtagtatttttatttcatttatatgctttatttttccttttactttaacttcacttactctttctgcatagatagcatatttatatacaaattattaatacatacaaattataaatattaaatatagatgccacagaaatgtataaaatacaaatacaaattctacaggatagatataagtatataatgtataagattatactatgtataaaatattatctctatatatcatatatatgacataacatatatatcaataaatatcatttctataattcctttgccttttcttcaactttggttaaagattaaaaattaaaaattatgtataatttctttttttttttttttgagacggagtctcgctctgtcgcccaggctggagtgcagtggcatgttctaggctcactgcaagctcagcctcccaggttcacgccattctcctgcctcagcctcccgagtagctgtgactgcaggtgcctgccaccatgcccggctaatttttttttgtatttttagtagaaacggggtttcaccgtgttagccaggatggtcttgatctcctgacctcgtgatccgcccacctcggcctcccaaagtgctgggattacaggcgtgagccaccatgcctggccaaaatgatgtttaatttctactcatttataataaatattatttcagtctggacagaaaaggaaaagataaataacacaaacttttatagcaacttctaggctgttttaattttaaaaatgttctgatataacatgtggtagtcaaaatagctagacaatcagtagatctggcctcaaattttggctgtttctcttggttctgtgaccttaggcaagttttaaatactctataaaataatggcattggttccttctagctgaacaattctctcactctaaattttatgcatttatgggacatataaagccaaaattaagaaatgaaacttttgcaagttaataagaatcatgaggtattggcatgggttaattttccaatcatttgccacagtctactaatatttgtgggaaaagaattttggcataacattgtaacatcaataaaactcatttttcaagtttgaaaaagaaccagcacaaacaaatgggaatgctgactttcagaaaaacagacagctattttaaagtagcctgctataaatcatacccacagagggtataaaacaagaaagagataaaaacttaaaagacagttatttcctttcctaaaccaatgattccacttgtcagattttgtggcccttgaaaataacatgaatataggtactgattttaaaaaaatcaaaacaaatgcatttgccatcttcaattgagttgaaatagtttttaagaactatatattatgaaggaagtatgttggctgaaaattgtagcataatacaacttttaaaagatcaacaaatttgggccgcttgcggtagctcatgcctgtaatcccaacactttgggaggctgaggcaggcggatcacctgaggtcaggagttcaagaccagcctgaccaacaaggtgaaatctcgtctctattaaaaatacaaaattagccaggcatggttcccggcacctataatcccagcttctcgggaagctgagacaagagaatcgcttgaacccagtaggcagaggttgcagtgagcaggcactctagtctaggcaacaagagcaaaactctgtcccaaaataaaaaaaataaaaaaaaaatcaatgaattttgaaacgtttctgggaaagaaatctcttcagacatactccattccactaagcctttcattttgagaaacaaaacatacttagatatgttccctaattagacaatgaaaaataattacatcagttaatcatttctgccatgttttaaagatcattcattcataaagatcattaactattttaattttagtttagatgaaattttttggaaagtaaaaaaagttgttaaaagatatctcattttataattcaaaaatattttaatcaaaatatataataaaattttcatgaaattttatgccagtttgtcaattttccctccaacaggtgtctttggaaaacactgcgagttgaacagttatggatttgaggagttatcatacatggaatttccaagcttggaccccaataacaactatatttatgtcaaatttgccacgattaaaagtcatgccttattgctttacaactatgacaaccagacaggcgaccgggctgagtttttggcccttgaaattgccgaagaaagactaagattctcttataatttaggcagtggtacatataagctcaccaccatgaagaaggtgtcagatggacattttcacactgtgattgccaggagagcaggaatggtaagatatttcattttattgttgttgtatatccaactggatcttcaaataaagtatgaattggggtgcaaatcatgttaaattaggtttattcattaaatgaacactttagttatgaaaaacttagacataatatttttcttttgctcatgacaactctgttcaaaaacaataaaaaggagaacaattgagaatatagcctagtgcgtgaaataatttcattgatattttttgtatgtttttaaggccatgtcaggactatacttaaaataactacctttctttcctaagtatttctgccttgactaagtatttctgccttgactgaagaaacaatttaggaacagaggagacttttctacaaaatctacataaaataacttaatcaaaaacactttattgttaaaaaatggtaacaatagtcttagctagtcatagtctttttgctggtggagggtcttgccttgatattggtggctcctgactgagccaggtagtagtggctgaagattcgtggtgggggctatggaaatgtcttaaaataaaacaacaggaaacgttgtcacattgattaactcctttttcatgaaagatttctctgtagcatttgaggctatttgattgataccattttacccacagatgaaattgtttcaaacttgaagtcaagcctctctcaaaccttgatgctaatttattaattaagcctatggaatattctaaatcctctgttgtcatttcaacaatgttcacagcatcttcacctggagtaagttgtatcttaataaaccgcttcctttgtttatccctaagaagcagcttctcatcctttcatgtttgttttgcaagattgtagcagctcaatcacatcttcgggcttcacttcaaattctagttctcccactgtgtctaccacattggcaattacttcctccattgaagtctggaagccctcaagctcatccatgagagtcaaaaatcaacttcctccgaactccttttaatatttgatattttgacctccttccattaatcatgaatgttcttcatggcatctagaatggtgactcctttccagaaggtttttaatttactttgcccagacctatcagaggaatcatcatctgtggcagctatagccttatgaaatgtattttttaaataataggacttgaaagtccaagtgactctttgatccataggctgtagtctggatgctgtgttagcaagcatgaaaacaacactaatctccttatacatcattgtcagagcttttgggtgaccaggtgcattgtcagtgagcagtaatattttgaaaggaatctttttttccgagtagtagatcttaacagtaggctaaaaaatattcaataaaccatgctgtaaacagatgcactgtcatccaggcatttctgtttactgatagagcacagatgcagtagatttagcataattcttaaagaccctaggatttttaatatggaaaaggagcactggtttcaatttcaagacaccagctatattcacccctgatgagagagtcagcctatcctttgaagcttttaacccaggcattcacttcttttctctagctatgaaaatcctagatgacatcttctaataaaaggctgtttttttacattgaaagtctgttctttagtgtaaccaccttcatcaatgaccttagctagatcttctggataacttgctgcagcttctatatcaccattcactgctttgctttgtcctactaccttacagagatgacttctttccttaaacctcatgagccaacctctgctacattccaacttttcttctgtactttcctcacctctctcagccttcatgcaatggaagagagttagtgcctttttctagattagatgttggcttaagggaatgttgtaacaggtttgatcttctatccagactgctaaaactttctccatatcagcaataaggctgtcttgctttcttatcatttgtatattcactggagtagcacctttaatttccttcaagaacttttactttgcatttacagctcggctaactatttggcacaagaagcctatttggcctatcttgactttcgaaatgccttcgtcactaagcttattcatttttacattttcatataaagtgagagaaatgcaactcttcctttcacttgagcacttagaggccattgtagggttattcgttggcataatttcagtagtgttttatctcaaggtacaaggaagcctgaggataggtagagagaccagagacagataattgctggaacagccagaacataaataacatttatcaattaagcttgccatcgtatatggcacggttcatgttgccacaaaataattataatagtaacatccaaggacacttcactcatcacagatcaccataccacataaaataataatgaaatatttgaaatattgtgagaattattcaaatgtgactcacagtcacaaagtaagcacatgctgttggaaaaatggtgctgatagacttgctggatgcaggattaccagaaaccttcaattggtaaaaaataaaatatctgcaaagtgcaataaagtgaagagcaataaaatgaggcatgcatgtatttatagattatattgattttattatgtggctttcatgttacaagaatgacatatctatttaggacttgtgtttattaaataaatacttttctttataaaggaaaatgcatcacatcttttctttattaatgtttgaaaatatttgacatagtataatagaatggaatggcttatttattttttattctttatttatcttcacaactatctctccatatttcccccatctctaacagctatcaaggatttttaataagaaaatgctaacaaatctgtcttaaagtatttttgcactttaactttgagcctttaaaagtgtagttactggtggccaggcggggtggctcacgcctgtaatcccagcactttgggaggccgaggcgggcggatcacgaggtcaggagatcgagaccatcctggctaacacagtgaaaccctgtctctactaaaaatacaaaaaaaaaaaaaaaaaaaaaaaaaaaaaaaattagcccggcatagcggtgtgcgcctgtagtcccagctgctggggataggcaggagaatggcgtgaacctgggaggcggagcttgcagtgagccgagatctcgccactgcacgccagcctgggtgacagagcaagactctgtctcaaaaaaaaaaaaaaaaagggtagttactggtaagatttataattcaccctagataaaggaattgtgtaaaatgttaaattgtctgttaaaaagaaagcctagccaaaacaacaaaataagtgcccttaaatcattttaaatgaaaaaacttggtatgtaaatgattataattgtatttctgacttcatggcaatctttaaaatatatgacaacttatatagtccttagactgatcatatgaatcatacatttgtgtgactatagagaaatttttgccactaaatgtatggaatatgttatattgctgaatgcatatcagcaatattcagaagtaatatttaaaatgtttttaaccaagcttttgctagtttttttccctatgacacgtagttaattttaaaggctaaaatttatgcaatctataattaccaatttcataagggcataagacagaaactaccttataatattaattatttttgaccagtacacataacagacaatctattatgaaagaacaaaatttgtcatttgatctcaggaatattttataaatccatgtttattttgaattggcatcagatacaatgacatttctctcctccactctaatttactacaacattaaaggaaatttaagcaagttttaaaatacagaactatttttaattatgagggggaaaaagaataatgattagctttaaatataaccaattgattgtgtcaacatggtcaagggtagctgctcagacatgtcattcacggatatcgccacatccatcaaactgcattcagggtcctaccaggttattaaatgtatgttacttgaaatattggtgagaaaacaacagaagtattgtatggtttttatcaatcattttagttatagatggttttccatttccttttgaacttagtgttaatattttccagctggaacatttttctaatatatttaatttatatagtgtttacttaataaaattacccccaacattccaaaaatgttgtcaagacataatgttatattttatattttaattctaatatgcccacatttccatattattgtaaaggttaatattaatcataattaaaattttatttctgtgaattaggtgcttaaacaggtgttggtcaccctgaattatcaccaacacaacccacatataaccttttgaagtaaaataatggaatattttacttgatcttggtctcaatgaagtttacattatgagtagtgcctaaaaatccacctgactttaatgaacattagtagaggtataacaaacaaatcttggataaaatatattttctgattagtataggttactgcactgatttttgcttgagattttaaaaatccagcattctctggaagaatatagatttaatcaattctagtattcctgatgattgatgtaaccagaaatattgggccttaaagaattagaaaaacatttagagattgatatatatagattgggctcacattagccataataatatcctaaaactgatgagtaatagtagacatcacctcacccccattctccacacatatgtaagataaccatatttctgatatgttgtcaagtatactataatgtaaaataaacgattttacctgatgacctccaaggtctctttaaacttcatgagcatttgattctatcagacaaggacatgggatcaagaggtgagtggagaaggatgcagtttcatttgtattattgtgaccatagtcatcaatttttaataataccaaatgtgaaaaaaactctgtcattattacttgagtcataggaaaaatgtcttcctgtttcagaaaacatccaaaataaggcccctactggattctgaatttgtcattttctacatttcaaaataattttggttggaaactggcaaaatcattaacctctaagctttaagtcattgcatagttgggataaaacattttaatttatggtggtaaagctataaaaattcaacagtaaaagagaatttaactctgaagattaaattgcataagcttactattaaaataaaacatctcctccattattctttctttgagttgtatcagcaagcttttagatgtatacgaaatattaacaatgactaaaatataattatgttatccaaggttatttttctaattgaggcatttataaatatccatgtggtactttctagtttatgatacttttagggatctctacaaggatacttgcataatatatgtggagagatgtgttcaatcaagtagtcacctaagcagcagaagttgaattataaaaacctaatactgcttttgagattggatgtcaccgcattttacagataactgaaaataatcataactatcaaaagagtaaactaaatggggcatgaatgacttgccagagaattggaagtataaatttttcctacaaatgttagtatttattataatttacttgaaaaaaatggcaaaaaaaattccatgtggctcacaagagtttactgtatagagcttataataattaacttagaaacatttaagaatatgttagccagtaatatttgataaacaattaataaatggattatacattcacctcagtctttgtttttaaaatgtgagatacttcagataaatttttacaagtctcccatttaaatatatgttttatggatactgcctaaaaatcataagcaatattgataaaagtaggatattaaggaaattaatcattttcattcctaatgaaagtggcctgattttttaatacagaaaatttgatatccaaaactttgcatttaagtttggcatgttattagtcaacttgcttaacttcctgcactgttttctacatttgctttgctcttattaaactgaaatgataagcatcctgataaatgaatagttgcattgtatttatatttctctgctacatatgtaacaaatttggattaaccctgtctgtggcattcgtaaatttagaataacgctttattgtctgcattgggagaaacctttcaacctcttgtccatttggataatgaattattgctattcctgtgatatactggcactacactccatccttcttacaatttcagcaagtaaagtgtgcaaagtttgtcatttgtcaaattttaatgaagtttggggaacaaaggaggtgtatcacaatagcattggagattacacaataatatagatatacaactttggtcttagactgcactgcagccatcctcacttgctggtactcattatacaggactctgacttgtatggttatcatgttctgaggccttttaaccataaatttatgactttgtttatcaatcaaaaggagtattcatatgttctactaaacagaaggcttttgtctcaagggaatacgcatcccttagaatgcaaaaatactacttagtcattatttaaatactattggggattttttactgtaaagtgatctacagtaatacatcctgattatacagaaatatgctgtaatgttatttataaataattattcttaacaaaaatgagaggagcacttacttgatttaacaaatttcaaattttaatccaaatatttaaattttcatagattgctatatagtatttatattgtattttcctaatctttttgtaaatgtggctgaaatcatattagaataagacttttgaaaatcaaaaattaagtgtcttttgttaacatagcttgacagtacaataaacacgtttcttaagattgtaatctacaggaagatgtttcagacctattgtgtattattctaaaaaagattaacggcatttttatcttttttcacctataaaacaggggagcaggagaggatttttaaaggtacccttttacctctcataggtatagatagtcataattttagtttgagatatcaaagaaacatgtgcccatgattcaatattataattatgtgatttatacattaaatcaagatgttatcatagtttctaagtcatgttcacatagaagcaagtcatgggtagtgttggctggaaaggctaatagggacggtagaactcaaagttgaatgtttctttctcttgcttcgtaggcagcctccttaactgtggactcctgttctgagaaccaagagccaggatattgtactgtcagtaatgtggcagtttcagatgactggtaaggaataggattagtttaatttttattattacttaaaattttttaaaataaactttatacctaaaaataattataggatgctaagtagtacataaagcttaagatattttatttccctctccaaattttcataatataaaatagtcaataattactgtgcaaaatgtgttaaaatgtgtgaaatgaagtggtagaaataaggataaaattggagaaaaggaaattaaatatagccagtagtctttggaaagattcatgaaataattgcatatgaccttcattctgaaaaacatgtaggataaagacctcagttctttcaaatgcgtttctaaaagtttacgtgaaaattattaacagatatttttccatagcacttaaagctgagcacagcagtaatctaccagaaaataagtgattttaataggaaaaatgataaacagagaaaaataagtagtcacgcatcatgatgcatcattcattgcctcaatcaacttattggcatcccttgcattgatcaacttactgatattctttatcatctcttcagggaaggagcagtgtaatctaacgtaaatattagagttgtcactaattctacagcattttattttccctctgagagtatgctccttcttgttgactcagtattgtgataatatacatctaacttgactaattgaaaacataatttccataaatattattatttttcataattcggaagtctaacaactctgtgtgtgtattggacactcttctacatattttccattgaaatttatcacactataataaatgtcaaaaaaaagctatattcactctttttcgaactaaacattatactaaaaatgtaatcttttgacactaatatttatatcttccattatttatttaggactcttgatgttcagccaaatagagttacagttggaggtatcagatctctagaaccaatccttcagagaagaggacacgtggaaagccatgattttgttgggtgtataatggagtttgcagtcaatggaaggcctctggaacccagccaagctttggcagcacaaggcatcctagatcagtatggcgattttatttcttactgttttaaagaaaaaaaatgcaaaaaagtatgcttcagtgagcatcaaaagatgaaattattatgctcaaatctctaaaaataccaaatgatttacattgttttgaattttaaatactatacctttgaaattttggcataaagtatgatatttaattagaaaattaatatgtttctagattcttatacatatatatatatatatatatgcatgtgggcatgtatatgttttatcctcttacagagagttgtgaagattaaattagttaagttggtaaattatataaaaaagggttccagcacagagagatatgtagatgttagccatcatggacacatagaactttatttcacattaaatagttttacttatagacatacatattcctaaaaacttgatacagctttaaaaacaggcaataacttgattaattatgaactgtaaggcttttttatttgattattaattaggtttctagcaataacttagggatgttagaaattacatattttattttaaaattccttttgttcattatcgaagtttgaaaaattctgaaaaaatacaaggaagaaaacaaaattaacctataatctaaccacccagagacaactactcttaggttattgtcatgttttgactgcttagtatcccaagatgtgaatgtgctatattttaactgttgctatacactttagttatttccaattttattaatataccaattaccctgtgatgaacacattttcacaaaaatctttgctcacattattttttggatgagattaccagaaataaaactattaaaggcaaagctaggaatactttctaatgtttgtaacttaagtattttaataacattttctatttgcctttcttttcctacatgttgttactgttttgttacaaagtcacactagttcgttattattattaatcaaacagtacagaaaaacaaaggattgggattgccaccattgttaatacttcggtgtgcatccttttatatctccgtgttcacacaagtacttttttaaatatcaattttttttttcatttagagatattttgtgaacatctttttaggtcaaaacctactgaaacaaaacttttagacttacctttaactcctctgtttctgttagaccttatgtccagaatgatgtttctgtttgtttgtttgtttgctttttgagacagagtcttgttctgtcgcccaggctggagtgcaatggcgggatctcggccccctgcaacctccacctcctgggttcaagcaattatctgcctcagcctccggagtagctgggattacaggtgcctgccaccacgcacagctaatttttgtatttttagtagagacggggtttcaccatgttgaccaggctggtcttgaactcctgacctcatgatccaccacctcagcctcccaaagtgctgggattatagaggagagccactgcacccagcctagaatggtttttaaaacataagtcagttaacttttcacttcttggctcaaagtgcttcaatagcttcccatctcacccagcttcaaagccaaaatcctgaccctgaatgaaaacatttttatgatctgccatctcccttcacttcctgaacatatctaactattcttcttcttgtgccctgagctccaaccatgttgggcctcggtgtttctcaaacatggcagtacgctttcacttcaaggctttctcactggctgtttcctctagctgaaaagatattctaccagatatacttcattcccttattttatttaggtcttaacaaagattaagattaattcactgcctaatctaaagattcagcaaacccgcaaactcactataccctttctcaccttgattttctctatagctatttttttctttattttctgcctcttccacaagaaaaaataagtacttcctcagtacacggttattttttcattactttacttccatgcttagaacagtgcttagcatatggtaggcattcaataaacattagttgcatgagtatcctgatagacatgtgtcaaaaaatatgtggtccctggatcatatgtattaaccaaagtgtttatttgaccaaggtattttattcaagtaagaattaatttaaagaagaaattgtcacagctttctcattattatataagacataattttttttgaatcttctttagtgtgaggcagactatgttttctaggaaaacttctggtttgattagtttctccaaatgtagttgtaacttgagcttcaaataatggagtgcttgaaattaaacaagctaataaaagtgtatattgagttttagcaaacttctcctcatcttttatgtgcgttattgttctcattatgatttattttagatgccctaggctggaaggcgcttgtactcgcagcccatgccaacatggtggcacatgtatggattactggtcatggcagcagtgtcattgcaaagagggactcactgggaaatactgtgaaaaatgtatgtaaggtcttccgtcttcccctggaaattttaataactatgaaaagtaaaatatatgcacccaagtatgtaatcaaattaaaaattatgctttcattctaaatattaaaatattaaatggacaataattggtaaaatacagtgacattttaaaaattatttttgtaacctgaagaagaatgatatccttttaaaaaatcgtttactaactaaatctctagcttccactttaaaggtattttattcacttatttttgtttgttttatttcttagaattctaggcaatctaaaagatcaaaggttatagttaggctttttttcatattatctgcctttgggggatatttttctggtgaatttttgtgcataaaaaggtatacacactaaatcactcaacactgagatcaaaacatcatacagagccatcataatatgttaaaattaatgttgatactttcattttaatgtacaagtagtagaattaattttgaatattactttttaaaatcctttcatcattgtcttctaagcctaatgttattatttagacattaatgatgttcatatcatcattagaaaatggtgctctctaatttcgagctgcacatctcactaactaaccctaatggttcctcttttgtaaaaattcttcattttcaaacaagtggttactacttaactccattgcaggtatctgactacatttaaggagtcatttgattaaattatattatgaaaacaaatagaaatgcataataaaattgaggatataatataatctaaaaggtcttagcagaaagtgtaattgtgtgtaataatattagatataatgaaaacatagaaaatatatactgtcatgtgattttcaatgtaataaatatttattaaggagcctaattatatctgaaatatgagtcattggctagataaataccagagacactttttcttaaatcatgatataactcacatactataaaatgtattcttttaaagtgtatctttcagggctgaaatccatttgagctcattttcttaatattctttctttagctatattatttgtttctataacttaagcttcaatatttctggaatgtggatttttttcagattacaataaactataatatacatactgattatacatgatgataaattatatgtgatgattactgaaaataaagttagttaccgatgtaaatacttgattgaacacttctttgtcctaatttatagcatactagagactaaagattacaaatcattttaaccatgcaaacgtatattttggaaacacagtgaaaatgattacaaacaaatttttcaagtacatattaccaacaagtgcctgtctttagatattcataatttacgtaatgtggcaaatagtttagtaaaatatttcccaaatggttaatgactgtcatagagtattttaagttcatggttctgaaatgcatttaaacatgtgaaatcaacttatataatgattcataaatggaaattattttttaagagtagagttgggggacattaattcccaaaacgacattttcattgtcctttttatatttttgtcactatagaaaacactccaagaaatgccaaatgaatgcattcattttcccttttttcctttgacttccagctgttactcctgacactgccttatcattagaaggcaaagggcgcttggactaccacatgagtcagaatgagaagcgggaatatttgttaaggcaaagcttacgaggtgccatgttggagccttttggtgtgaacagtctggaagtaaaatttaggaccagaagcgagaatggcgttttaatccatatccaagaaagcagcaattacactactgtgaaggtgagataaaagctaatggtgacttcatttgattagaccgcctgccgtgtagtggtttaaatcacttcccccataatttctgtccttttctttacaacccattagagttccgactaatgctgggcactattccaatgtcatctatcttaactattccccaggcattggccagagtaacaaagatctgaatggtttggtttctacacacttttgtgttgctttagagtagagaaccctgccaggtaggccagcacacaaagaattagttgcaatctatttttctggtaagaatttatatcacttcttttcttacttttagacaaagcaaaccaaaaatataatgtttgtttgaaatacaaaaatatttttctccaacaattatttcaaatattgatatgtatatgtcaattgacaggattagaataaggaaaaacattttgaaataagcaaaaacattttgaaattatatgatttctggagcatatattcaattctctatataaactctgtggagtaaagtatatttggaattcattataattttacttaacctttccaaataatttttaaataatcttaaaaattatgcttcatgagaacaatggatttatcattaggcttttacataatttgttttttcttatctgtaaataagatactagacttatatacagatgaataatttcattagatatccatttttgcatcggcccttagctttctgaagttttaaacctatgttctgctttctttcccacaaataagtcatctcctagaccaacagtttctttagtttagttatatttactgccttccattaatattactttgtatcattctactgataattttttatataaattttagtaaattcttaagataacaaatccagatttcctgaattattttcatctattagtcaatatttaataactactccagggatagttcacagagaaaaagagcaatttgttcagaaaaattatttggtttaattcacatataatactaaaaataaaaatagatgttcacttctaaacttcagcctctttcatcctcaaaatttttctctgtgcaagccaaccatgattatgttgcatataaatatatttaataagtagtacaaaaaccaatatttcttaccttctcaaatgataattcctctagtccagtcatttccaactaggatagattttacccccatgggacatttggcaatatctggagacattttcaattgtcacggttaggagttgggagagtacttctggcgtctagcggtagaggtcaagaatgctgctaaacagtagcacttcacaacaaagagttatctggccccaaatatcattagtgccaaatggcagacactctacccttttcccttacaagagaacatcttcaggttttaactttacctctattgaagcaaaggacccagttccagagttaataaaacaactgtaaaagagaacacataagccattgtattacattattatctggtacttataattttcattgaaaatggtattagaagtaaacaaagtaaagaagcaaaaaaagaaatagatcctcatcttctataagaaacatattttatatggtttgagaggctttgacattgaggtctgtgtgttatctgttaagttgcttccaagtcttcgtgccatttaaatgacatatgaaatatttctgtactaacgtacacttaaagccaaggaattcagtcaaaatacaatgtggttgaaaaaaatcagagacacatttttttcttcactaaggaaaaagctgaatgtcaggatccatttttgtcaccataaattcttctacttccaacaggacagcgcatacaactccagattttgttagcttggtagcaataacttaatttttttcctgaaaggaaagtaagtgcaaattaataaaaaaatgaataatacagaccaaaatgcatagttttatatgaaaattttgaaaagaagcttttcaaaggggcttggcaggtaaagagaataggtaagaaaaaataacaacagtgaattaagaataactaagtaaaccaaaagaaagtggctgttgtaagcaggcaaattatttggatgataggagtatcaagtgcttatacagactaggaagctagttaggatggacttttacttatcaattagcttattggtcaccaagaccccagggttccgttttttttttttttttttttggctccttttctgatcctttctttaactctttcttatggtttgcattctctctctctcattctcttttctatcattctttctctctctctctacagacacacatacacacacacacacacacacacacacacacacacacgcagacagaagatgaggacattttgtgaaaaatgaggaagggtgttgggtaaatgggattccatgtggctagaagagagagagggtgtcagtgtcaggtgtgggcagcaatagtgatgagaggagagagaagaatatgtagaatcaattgggtctattcagaaaaagaaaaaattaagaaaagaaagtttcagagagaaaggcaaaaggaaagcataattgtgtaaaactttgtaggccaatatttaactcatttcacaaatctctcttcattcatggcatgccctatagctccatatttgatgttctgtaataatagtaatgtgatggactttatttctactctaaatcagttcttttgtgtttgtctggtttttttaagtgggcaacataggtgatacagaataattggaataaggaattcaaagctctatagattcaaattaaataaatgaacaaataaatgcagtcatgagttgcataatgacaggaatgcatttcgataaatgcattgttaggtgatttcattcttgtgcaaacatcatagagtgaacttgctcaaacctagatggtacaacctactatacacctaggctatatggaatagtctattgctcctgtgctataaacctgtatggcatgtttactgtactaaatactgtaggcaattgtgacacagtggaaagtatttgtgtatataatcatatccaaaaataaaaaaggtacagtaaaaaggctgcattgaagatttttggggggatgggggacagcctgggcaacagggtcttgctctgttgcccaggctggagtgcagtggcatgatctcggctcactgcagcctctgcctcctgggctcaatgtatcctcccacctcagcctcccaagtagatgggactacaggtgtgcgtaaccatgccgggctaacttttgtatttttttgtagggatgaggtttcacatgttgcctaaattgcacttactgtgactgaagcttgtaggactgaaagttgctctgagtcagagagtcattaagcaagtggtgggtcaatgtgaaggcctaagacattattatacacttctgcagactttataaacactgtatgcttaggttacattaaatttatcaaaaatatttttcttcaataataaattaactttagcttactgtaactcttttagtttataaacttaaaatttttaacttttttctcttttgtaataacaattaaaacacaaatacattgtacagctgtacaaaaatattttctttccttatacccttattccataagctttttttctattttaaaagttttttatttcattttatttttacttttaaacttttgcattagtaactaagaaacaaaaaaacacattagcctcagcctacacagggtcagtatcatcaaatccctgtcttccacctccacatcttgtcccagtggaaggtcttcagggacaataacacagatggaactgtcatctcctatgataacaatgccttcttctggaatcccacctaaaggacctggatgaggctggtttacagctattttttatatcattagaagcagtaccctctaaaataatgattaaaaaaacggtgtagtaaatgcataaaccactaatatagtcatttattatcaaattgcatgtgatatacttttatacaactggcagctcagtaggcttgcttacacctgtatccccgcaatgagtaattcgttgtgctatgacattacaatggctactaggtcactaggcaataataatttttcagctcctatggttcatcattgactgtttattaataaataaaaccaagcaaaaattagcatgatgttttaaaagtgaagaattatataagtgttaagtacagtactgccagggagaaggaaaacattaagaatgttataatgggaacttatattcttatccaccccaatttgtggtatattccaagtgctctttcatcaaaaatttattgaataaaaggatgacatgatgaaatcaattaggaggaaagagctgggagaaggcttttcctttttttttttttcaaaaaggactccagctataaccaaagaaagttgctgtttttactgtgtgtcatgagatgttgcccatttgatgaaatgttattgtcatttagctagaattttctgttttttttttttagtttggtactgaaatatattattatctggaaaaattggctttaataaaatattgctatatgaataacatatgtaaatgtgttagacatcttttcggtaaagtacaaatgaactgatttttagttttaccagatgtgtttgttacatgtagaaatagcatttgatctgagtgacaaaataaactgatccatcttttcattcccgttatttgaggaacagtgccactgcatccccctgccaacacaccagctctgtctggcagtggtaacaggattatgctccctgaaccaaatgttcatcttgcctcataaattatctcattttctaaaatggtctactcaggatactggaaactcggtagctggaaactggagtgggagcaccctgttacccaatgttctcctggacaaaataaaataaaccaaatatcctttagataaattgtaaaagacagccaaagtgaaggcttgcccagacacctcattaagaattcactctttgttcatcatagtttttgatctcaataaatgatataaacaataggcatcattttttcctaaaatttgtgtgtaaaagatgagaggtaaaacaattattttcatctttatttttaaactatgcttcccttttagctgagcattctttttctttttgcaagtggttttcacaattttttagtactatgggccttttactaaacgaaccagcataacacactccaatggcaggttgtcattggaatacaaataatttaaaaaggtataatttaattatcttaaatggacattcgcccctttattatttcaattgtgttctggaaaataattcatcaagttttgagaaattaggtatacatataagaatacgttgaaaaccattgaaacttaaatgtaaaagtacatgttgcctaaaattagagacaaagtgtgtaagtatattctaatacaaccagattcttcagctattctatctgctgtggactggtcaaaaatttaagtttagttttgttaatgatttttatttaagcataccatattttaattgcatactatttttaatatgttttacagattaagaatggcaaagtatattttacatccgatgcaggaattgctgggaaagtggagagaaatattcctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacaggtaaatgcctttattaagtagagtcacaagggaagtaaaattgttcttcaaaaagtaattgctttttcttgtggcaagactacacatttaacatgaatctcatatacagaacaatttcattcaataaaatttatgtttaaaaaagtagtttgatgtctgataatatcaattataaatatcctaagaatgtcataactatcttcagaaagtttgtaataaactattagccaccactttctcgagagcttgcatctttcttaccaaggttgtaattcagtccatagtgttttgatgctttgcttgtccaccaagcatttcatatacatttgttcatttatttattcattcacagccactctcttcatagaccattaatggagacaaacattaatcaaattcttacacaagtaactgcattattctaatgtgtgataaataatacaaatgaagaatgtagaattctaaaatatagtgaaaaaagagaaaggaaggggaattttgctgtggaattgacatgtatacataaatctgaatgatgaggaggatgaaagtgtacgaaaggttaatttatgttgataggaatttttttaaagaaatcgtttaagccaaagttatagaagacaacacattggaggctaacatcataggcaaatgatgaagttggagaatgaagcaacttcctgaccatgttgcagttttggtcttatttacagagcaatgggaagtaattgaaaactttaatcacagtaggatcaagttagatatgcagtaatattacagatcattcaggctacagcatggagaatgaattggaggaggacacgagtggatctacagaaatgagttgggatctgggcaagatgtcttctgagctcctactagtgtggtggctgaggagttagaaagaaatggataggcaagaaatattctgggaactaaaatcaaccaaactgttagtgattatggtaaaattcaaggaggtttctacttctcaactcaaagaagggtaggtcagcaagagaggaaactgcagaaccctccaaaagcagcatatgtctgagaaatattagatttggtttgggacattttggatttgaagcatctttgagaaaatcctttggatggatgggctggaaatcagaaatagactttagctggaaatatatatttaagagtggtcagtgtcaagcaggtaactgaagtactggacatggatgtgatcacctaacatgagggcgtagagtgaaaagaaagcctgggacgtcatcttgattaaccgtaagagttaatggttatgtagaggagaataagtcggaaaagaagactaagtaataggaagaaaatcaggagtataggaacaaaaagaaaagatgtcacaaaagctcatggaaaaaatatatcaagaatgagaatgtcactatggtagaatgatgcattaaataagaggaaaaaaatgcatgtgagactaatagatttaaggcataaaagttaaagtccaggtcataagtcctttttatatggttattatagaatgttgtgagaaaacaaaccaatggaaattacgctttttgtagtgtcaaaatagattgttgggccctgagataggaatatcagcactgttaacacactcaagtgtaatgaagtgtttcttaactttgcattttatctttatcattcccctaaggagacacttaatatagtctaaactttgccatccccaagtcataaaatgttaacaccagaggtatgtttttatctgccttttagaggcccacaaaccattgtaatagctaagatttttttgttttgctccccaagaacctatgttccacacctttggtgtattatcaccttcaatgggaatgcatgatttagtagttgaagccattggcctatttcatgttctttacaaatttaaaaaatatatattttatttgtatgtatgcaatttttggtatatgggatgtaaaaaggaaggaaattgataaataaatgagtaagaaaaagaaaattcagcctgcccaagtcattcataaatcttcagaatgagtgggattcaagcaatctgacccatgtttggtcatggtaatcttaacgcaccttgctaagttataagatgcacagcttaattatctttcagctggatgatggttctgagactgaggtttctgtattcatgtattcatatgaggtgattgtggagcttctctttacaagaacccagcagtgtagtataagctctttttttttttttttttttttgtaaaaagccttactccttcttcttctcccagcaggttttgatggctgcattgcttctatgtggtatggtggagaaagtcttcctttcagcgggaagcatagcttggcctccatctcaaaaacagatccctcagtgaagattggctgccgtggcccgaacatttgtgccagcaacccctgctggggtgatttgctgtgcattaatcagtggtatgcctacaggtgtgtccctcctggggactgtgcctcccacccgtgccagaatggtggcagctgtgagccaggcctgcactccggcttcacctgtagctgcccagactcgcacacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactat

SEQ ID NO: 38532 - DNA, 13589 bp, Homo sapiens
gctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtgtgagtggggccgtcgggccgggctggggctgagggatgtcctgcctggggtcagaggcgcgagttcgaagtccgatgccgcggtgctgtttgccctggagcagtcctcgtgtgtctctaagtctcggaggtcaccatctgtgcaatgggagctggattttggcttgcgcgccttcccagctctgaactggggctcccactgcacattttctgggtcttccaacctttgcagcctggccctcttgctttgactcctcccatgccagcttctgtatcccctcatttgggttcagttcacctcacctctctgtgtgcctttgggcctcaacggccccatctgcacaatggggaactggactctggcctctagctggcaggcggatgcctcctgtctattctgtccccatgaagcttgcccatgggcttgcatcctgcttctcacttctcacctgtaggactccagcgctaagtcccgttcggctcagggggctcctgggacgtgacaatgaatgtaaaagaagctgcaactatcctggcatcttacctgcaagagaggtcttggggtcattgccctggctggtgcctagaggggagctcagtctcctttaaacctagtgcataacagccaccatttattgagggcctacagtgccagaaccggggacaaagcagagaacaaaccagagaaagtggtttgtgtcccccagaattggcatcctagtggcaacgtgggatggtgggaaggatgtggatgccttggcttgaaccctggccccacctacccgtgtgatctggaggaagtcatttagcctctctaagcctcaatatctgtaaaatgggcatggtactagtacttatactatcaggattgagtcaatatgtgtgaaatgcttagcacaggctggccacggtggctcacacctgtaatcctagcactttgggaggccgaggcaggcggattatctgaggtcaggagttcgagactagcctggccaacatggcaaaaccccgtttctaccaaaaatacaaaaattagccgggtgtagtgtcacatgcctgtagtcccggctacatgggaggctgaggcaggagaaccgcttgaacccaggaggtggaggttgcagtgagctgagattgtgccactgcactccagcctgggtgacagagtgaaactccatctcaaaaggaaaaaaaagaaagtttcatgaggccataactttatctattttgttccttggtgtattactagcacctggtatttagtagtttctgaaatatttattgaatgaatgaataagtgtgcaagatcagaattgccattgtccccattttccagatgaaaaggctgtagctcagaggtagacccattgctcgtggccacagcacttggtcacggttggagccgggattcaaacccaaggatgcctggcaccagtgccaggctcttggctcccatggacactcaagagtcaggtagaactggttcccactgggtctggccaagggcatatccttgatgtgccctgagataacatcagtaacccttttgccaagttttttttttttttttttttttttttttttgagatggagtgtcgctctgttgcccaggctggagtgcagtggcgcaatctcggctcactgcaagctccgtctcccaggttcacaccattctcctgcctcagcctcctgagtagctgggactacaggcacccaccaccacgcccggctaatttttttgtatttttagtagagacagggtttcaccgtgttagccaggatgggctcgatctcctgacctcgtgatcggcctgtctcggcctcccattgtgctgggattacaggcgtgagccaccacacccagccttggacacaggtttgattccagtcttttgttttttcaaacaagcctgcagtgaacattcatgtatatttggggagacaatagtatgtggctcatgaccattgtctcaaggaggctgtcaggatttttagaccttgtagcctggtaagaccagggttgggtacctggagaacttagggataggggtaggggtggaggtgtccaataaagaagagtaagaaaagaagagacactaatattgattgacctaggaacttttatatgtgcgtaactgccaaaagccattctgtaaaatggagaataccttttgttgatgggaaaagggaggttcagagaggttaactaatttatccaagctcacatagcaaaacatggcagggctttggcccaaataccactgtctttctactattcatctgagtatagttaaaacaatgaaagtaaacatggtcttgttcacgtcattcctagatccctaaatgaggaggggaaaggaagggtgggggaagaggtttgaatcttaaaaagaggcaattatgtaacaattatgtaacatttaaaatatttaataatttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctaaaatatttaataattttaaaagcagtacttaatcatagataattctggaagtctagaaaagtttaaaaagcaagcaaaaataaattatatctattatatattcctccagtgcagtgggcattgctaataacagtggcatatttccttccagttttttattttattttatttttgtttttgagacagagtcttagtctgctgcccaggctggagtacagtggcacgatcttaactcgctgcagcctctgcctcctgggttcaagagattctcctgcctcagcctcccgagtagctgggattacaggtgcctgccaccacacccagctaatttttgtagtatttttagtagagacagggtttcaccatgttgtccaggttggtctcaaactcctgacctcaaatgatctgcccacttcagcttcccaaagtgccagcctttttataaatgcatttttacaaagttgaggtccttctttgtataatagttagaaagaggtacattttgaataggtacagtgttacctaacagctgttttagggaatctgttaactttaagatgagctaagctgaagacagaaccttctagaaatgacattgtcatgggtaaggggtgttctggcatcggtcagtcaacagttatttatcaagcacatgttatatgtcaggtaccatgtggggtactatgctagggactatgcagatgacaagccagacacattccctgtcttcacagagcccacagtctagcacaggaaagagatcattataatagaataaatactgaataaccgagtcattaaattgggaagatgaagtgctggagagaagttttgggatctgtggcaatgaaaaattgctcaaacctaggctggagcatcaggaggcctttgcagagggcccagctgagaccggaaggctgagggaaggtggctggggaggagcacgccaggtagtaggaactgccaggccaaagccaggagcagagaagaacctgatgtgtcagatgcagtccaggaaggacagtgtggctggagcagcagaggagggccctggggtgaggtaggagcagtgagcaggggccaaggctatagcactttcaaggctgcagggaagagcttggaatttgttctgtgagtagtggaaaggtgttagaggattttaagctgggagtgatgtgatgagattgatgtttttaaaagatgagactggctaggacaggcaggatggctcacgcctgtaatcccagcactttgggaggccgaggtgggcggatcacctgaggtcgggagttcgagaccagcctgaccaacagggagaaacctcgtctctactaaaaatacaaagttagccaggcatggtggcacatgcctgtaatcccagctactcgggaggctgaggcaggagaatcgcttgaacccaggaggcggaggttgcagtgagccgagatcatgccattgcactccaggctgggcaacaagaacaaaacttcgtctcaaaaaaaaaaaaaaaaaaaagagactggctgcagtgagaacgtcaggatggagcagagggagcaattccacaaagccagttgagcaaggatggtggaccttttacatgtaccatctccttccatcaaaattatggggcggggcacagtggctcacgcctgtaatcccagcactttaggaggccaaggcgggcagatcacctgagctcaggagtttgagaccagcctggccaacatggagaaaccttatctcatactaaaaatacaaaaattagccaggcatggtggcacgtgcctgtaatcccagctacttgggaggctgaaccaggagaattgcttgaacccaggaggtggaggttgcagtaagctaagatcataccactgcactccaagcctgggctacagagagagactctgtctcagaaaagaaaaaaattacaaccagccctctgaagtttaacatccctttttgaggtgagtggatcacctgagatcaggagttccagaccagcctgggcaacatggtgaaactccatctctactaaaaatacaaaaattagcctggcatggtggctggcgcctgtaatcccagctacttgggaggctgagacaggagaattgcttgaacccgggaggccgaggctgcagtgagccaagattgcaccactgtactccagcctgggcgacagagtgagactccatctcaaaaaacaaacaaaaaacatccctttttatgctgagcgtgatggcacacacctgtagtctcagctactcagggaggtgaggctggaggatcgctggattccaggagttcagggctgcagtgagctatgatcgtaccactgcacaccagcctgggagacaaagtgaggctctgtcgctaaataattaaaaataaacatccctttttatggtgcggaaactgagtctgagagaagttaaaggacgcgcctgagaccatactaccaggaagtatcagagccaggatttgcatccagcatgatttcccctcccaaagtggtgttagaatttgggatggggggagagaacaaggggtcaaaaggacagcccaaaaagaaagtgcgacacagtgacattatagtaactgttttcttctgtttctacagctatggagccaaaatccgggcccctcacgcgctggtcatgacctttctcttccggaatggcaggtacacatccctcaaactgggagagaatgtggtcagccctcagtgccaggacagtcgtaatagcttcttagctgggtctaccctgtccccccatcacgccttctaaagttcaactctttttttgttgtgttttgttgttgttgttgttgttgttgttgagatggagtctctctctgtcacccaggtcagagtgcggtgatgatctcggttcactgcaacctccgcctctggggttcaagcgattctcctgcttcagtctcctgagtagctgggactataggcacccaccaccacacctggctaatttttgtatttttagtagagatggagttttaccatattggccaggctggtcttgaactcctgacttcaggggccttccacagtgctgagattacaggtgtgagtcaccgtgcccggccctaaagtccaactctgatcccattatccctgcttgaaaactccctgtgccctccaaggaagcccagcttccaggcctggccttcagggccttctgcagtctggcctcagctgacccccgttgtgtccaccctggcgtgcccttggcacacagaactcgctgccattccatgcacatgccatgtgtatagctccacctgcacacatctgctcacgcagcacccccgccaggagtgcctttggctcgcactccacctttacttccctcctggcaatccagaccagttctctgaggatcacttcctcctcaaagctccctgatctcttgtctctcgctgaagcatcttcaccttcctgtcatctcccgtagctcttccctcaaggcacttctcagaaaacgggttgcggtctagtgtttaatgcatataggctcatgtggaacatacaggaatcatgcactggcagcctccaggccaaatccaacttgcaagatgtgctcattttgtatttttatcttatttatttttttctattttgtttttgttgtcctccaagtcattttttgaaaaactgaactcatgtgttcattcagcagatatttattgagcatctgctatgtgccagacactgttctaggtactggggatacagcagtgaacaaaacggacagtgactcctgctgacattctagcagggggtggcagaaaataaacatagtaaggagagtctgtggtatgttagaaggtgctatggttatggaaaagcaaaattagagcagggaaaaagggaaagggcatcagaagtgctgaggggacaggttgcagaattaaatagggaaggccgctatgagaaagtgacattggagtaaagacttgaaggagacagagttgtccaggtggatatgaggggaaagagtgagtgttccaggccacgggcatagccagtgcaaagaccttgagataggatcctgcttgataagtgtgaggaggctggagcagaggggctgaaggggagagaggacagagaggcgggtcacagcttgacctgggttggtcctttccagctttgggtcatagagaggaatttggcttttcctttaagtgcaatgggaaattgttgtaagattttgagcagggctgcaccattatttgacttatgtgttaacagcgtgagagttaagaatttgctgctaggccaggcgcagtggctcacgcctataatcccaacattttgggaggccgaggtggtacacttgaggtcaggagttcgagaccagtctggccaacatggcaaaaccctgtctctactgaaaaatacaaagattaggttgggcacagtggctcatgcctgtaatcccagcactttgggaagccgaggcaggcagatcacgaggtcaggagatcaagaccatcctggccaacatggtgaaaccccgtctctactaaaaatacaaaaattagctgggcttggcggcgcacacctgtggtcccagctactcgggaggctgaggcaggagaattgcttgaacctgagaggcggagattgcagtgagccgagattgcgctactgcgctccagcctgggccacacagagtgagactccgtctcaaaataaataaataaatgaacaaacaaagattagtcggatgtgatgttgcacacctgtagtcccagctactcgggaggctgaggcaggagaatcgctcaaacccaggaggaagaggttgcagtgagcccagatcatgccactggactccagcctgggcaacagagctagactccatctcagaggaaaaaaaaaaaaaattgctgccaggttaagaacagattggtgtggggggaggggagcagggccacccaagggcagaagcaggttccctccaagaggctgtggcagtgatgcaagtgagcaaatgtcgggcttggacctcagtggtgctggtgcaggtgagaagagtggtcagtctctagacacattttgaaggcagggttagtgccaacatttaaaaactggtagattccacatggaaatccagctttcctgccttagaactggcaacactggggcctgtgtttgcgcggggtgagagccatctgctcccggctgtccccagtcacctggaagatttccccgtggaccctctcactcatttagggtcttcgtctagccttaagagcacctgagtttgccattcctgaattgggaggagtagactctgctccttctctgtgttatccttcctgccccctagtgatttttttttttttttttaatttttagagacagggtctctgtcacccagactggagtgctgtggcacaatcacagttcactgcagactcaagcaaacctcctccttcagcctcccaagtagcaggaactacacgcgtgtgccaccacacctggctaattttttctattttttatagagacgaggtctcattatgttgcccaggctggtctggaactcctgggctcaagggatctgcccgtgttgacctctcgaagtgctgggatgacaggtgtgagccactgtgtctggcctcctagtaattttttctttttttaaggtagagtctctgtcgtccaggctggaatgcagtggcaccatctcagctcagcctcccaaagtgttggggttataggtgtgagccactgcacctggcctctagtgatttttaagagataaaaagaatagcctcctctatctaaatgttcacttctcaggataaagaccaaactcagcatggccccactgtctttgccctgcaccctccccacaaactctctggttctctgcccatggccacggtggcttctctctgctcctttcctcatactccctgaccctcctccgggcgtggcacgtgctgagccctctgcctgggatgtggctctcctcccctcttgacctcctcatcgggaagatcccagcgccatctcttgtcaaggtcaaagttctttttgtgattatttatttaacattttcctctcccagtagatcataagcccctgagggtggcgagcagatctgtttcttctcagaatcgtacccccacatccagcacatggcagacactcactccttcacatgtttactcaaaaaaacatttattaagcacctactacgtgccaagccctgcagatgaacaagccagatccagacaccaccctcctatagctgctactggggtgagggaagataataaacaagcacataaatgtcggttggtgaccatagctaggaaggaaaagaaaattagggtcaggacaggatgtgatgggtattctgttctgtagggtgatcagggagggtctccttggggaggtggcactgagtcaaggcctgaatcaagggagagaacatgaagggtagaggccggtgactgaatgagcattactccgagctccttggctggttgttaggcatgcccagtgcgtaaaagccctttggggctgctgagcctgcactcatggcaggggcacctgtgtttgtgcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccaggtaaagatcctcccgagatgggggtagtgaagggggcgtggttcagcacagaggtgggggtgacagaagggggcgtggttcagtacagaggtgggggtgatggaagggggcgtggttcagtacagaggtggtgacggaagggggcgtggttcagtgtagaggagggggttggggaagagggcttgtttcagtatagaggtaggagtgggggaaggggcgtgattcagtgtagaggtaggagtaggagaagaggtgtggttctgtatggaggtaggagtgggggaaagggcgtggttctggatagaggtgggagtgggggaaagggcgtggttcattgtagaggtgggagtgggggaaggggtgtggttctgtatagaggtaggagtggggaaagggcgtggttctggatagaggtgggagtgggggaagggcgtggttctggatagaggtgggagtcggggaaggggtgtggttcagtgtagagttatgagtggggacaagggcgtggctcagtgtagaggtaggagtgggggaaggggtgtgggtcagtgtagagttttgagtggcagaagggcgtggttctgtatagaggtaggagtgggagaaagggcgtggttcagtgtagagttaggagtggggaaagagcgtggttcagtgtggaggtgggagtgggggaaggggcctggttccgtgtagaggtgggggtgggggaaggggacgtggttcagtgtagaagtatgggtgggtgaaggggcgtggttcagtgtagaggtgggggtggggaggggcgtggtttattctagaggtaggggtgggtggaggggcgtgtttctgtatagaggtggggctagaggagggggccctggttctgtatagaggttggggtggaggtgattaagatgataagctcttggctcttttgcatgtctgagttctgtgactcaccagtccctctgtgaccttgggaaggtcactttcctctcagtttttccatctgtaatttcatggttcccaaaaatcaatgcatgtgctgctctctggggcaaagattgtttttaaaaatcactctgtagtgaaatgagggaaaaaaatgaccctgaagtaaggttttcataaaagaaaacttaatacactctaaaaactgtctctcattctgtgacttgtcctttttctgggttaaacttcgcttttgttatgaaatgatgatgaataagagactaaaagctagtcgttgggtttttgttctgttttgtttttgttgagacagtcttactctgttgcccaggctggagtgcagtggcacgatctaggctcattgcaacaacctccacttcccaggttcaagcatttctcctatctcagcctcccaagtagctgggactacaagcgcctgccaccataccagctaatttttgtatttttagtagagatggggtttcaccatattggtcaggctgggtctgaaactcctgacctcagatgatgcaccccctcttggtctcccaaagtgcagcgtgagccaccacacctggcagaatgctagttgttttttaatgttctttggaaacctgaaaagttggcagcctctctctacttgcctccctcaaatttcttaaatatttttaaattgtaaaaataatttttaggccaggcatggtggctcatgccggtaatcccatttccattaaaaatgcaaaaaaattaggcatggtggcgcacacctgtagtctcagctgcttgggaggctgaggcaggagaatcgcttgaaccagggaggcagaggttgcagtgagccaagatcgtgccactgcactccagccagggtgacagagcaagactctgtctcaaaaaaaaagaaaaaaaaattttaccattttttagccataatttttattggctgtcacatataatcccagcactttggtaggctgaggaggattgcttgaggccaggagtttgagacagccagggcaacagaccaagaccctatctctaaagtttttttttttttttaactacatccaaagtaagctgaagaaaagaagcaataaaaataagtgcagaaatcaggccaatgctgtggctcccacctgtaatcccagcactttgggaggccaaggtgggcagatcatctgaggtcaggagttcaggaccatcctggccaacacattgaaaccctatctctactaaaaatataaaaactagctgggcatggtgggcgccacctgtaatcccagctactccggaggctgaggcaggagaatcacttgaacctaggaggtggaggttgcagtgagccgagatccagtaagcccactctctctagcctagccgacagagccagattctgtctcagaaaaaaaaaaaaaaaattagtacagaaatcaatgaaattgcaaacaggaaatcaatagagaaaaggacctaaaccaaaagttgattctttgaagagataattaaaataaataaacccctagccaggctctctaagaaaaaaagagaaatgaaacaaattattaatatcaaaaacaaaagagggacatcactattgatcaccagtaattcccatcattccctctttgcagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcactcctgtaatctcagaactttgggaggctgaggcaggtggatcacttgagctcaggagcttgagaccagcctgggcaacatggtgaaacccagtttctacaaaaaatacaaaaaattagccgggttccatcacctgtggttccagctgaggtgggaggatcacttgagcctatgaggtcgaggctacagtgagcaaagatcacgccactgcactccagcctgggcgacagtgagaccctgtctcaccaaagaaaaaaaaaaggtgagattaatcttcactatatattttaacacaaatttctaaaagttatttcaacatataattaacatcattagatattttgtactcttttttgtattaagtattcaaaattgggtgtatattttgccacccacattttcaggacccagtagccacatgtggctagtggctgctgtgacgggcaacacag

SEQ ID NO: 38533 - DNA, 8408 bp, Homo sapiens
tgggctaccagtgggctcccatcctagccaacttcctgcacatcatggcagtcatcctgggcatctttggcaccgtgcagtaccgctcccggtacctcatcctggtacggctcacctagccccttcccaagccaactcctctcctcacccctgcccactccacccctccctgctcctcaaaaccagaactgccccccaacactggggcactggtcttggctccacccaaaacaagatggggtgaatgtgcacagccccatgcttctttgctcagaggagacaagggttttttttttcctgaagaattttttagggaaataatccaaatataaacaaaatggatcatgtagtgagtgcctggcacgtgccaggcacgctgcgaaatttcacatgcttcatctcatgtctacaatagccctgtgaggtagatcttaacagctccattttccagatgaggaaactgaagctcagaaaggttgcgagtcttcctaaggtcacacagctaatgaaagcaaggcaggattagaacatcagatcaacagtgaaggctcctgctgcggcaccacacggcctcaggaaggggtgggcgcaaggacacaggagggatgggcttcatcttatttagtttctcaagaagcttcaggaaggcttggcatttgtctctcttgcccgatgtacatcaaggatgtgttctggagcagctagtgtggctttgaggtcagtgcctccctgcactccagccccaggagtctgggtctctctcctcctccccgacagcctcttcccaagtcctggtccctgatagtctctgtcaaactcctgctttcagctagattcacccatattccctgctgttcctcagtgacctcttcacatggctctcttgagggaaaaggcttttcactagatttactacatacatgcttgacacctacaatcacaatgacatgcaatgtcatgctgcctccagagcccacacacactcattctaggacttctctccccacctccacaggctcagttcccagaagccaggtgaacaggaccctaacaaggctctctctcatctgacataagagaacacttctctccagttctcaggaaagccccagacaccactgtcaacaacactatctgccaggtgacagccactagaattgcaggcacaggacttgggtagaagcatccaggtctcaaatcgaccctaacctcctctccagctcactaccgtgggtggaatgctgttctccccagaggtggccacattcgggatgtgggaaaactgaggggcccaggggcctcagtgctgacctagcattgctgctccagcattgctgctcccagtccctcccatcccagccctctccttccagacagatggaaagattgctggagcggggcacattgacctgtgtcattcaagtacaatttatagagcaaggaagggagggaggaaagtgatggagtgagggcatccagggcccaggctggactcccgttctatgcttggggtctcagtttggtctgctcaccccagcctttctccaggccccatccatgatcctgcctccacctgccctggttcccttatacccagactccagccacagccatgtgagaagatgtcacacacatactcaggcacaaggctgcaggataacctcctgtctcttttggtctaaagttcccagcatccactgccctccagcctgggtgacagaccaaaatcttgtcttaaaaaaaaaaaaaaaaaaaaaaacacaaaagaattaagactttttttttttttttgagacggagtttcgctcttgttgcccaggctggagtccagtggcatgatctcagcttaccacaacctccacctcccaggttcaagtgattctccttcctcagccttccgagtagctgggattacaggcatgtgccatcatgcctggctaattttgtatttttaatagagacagggtttctccatgttggtcaggctggtctcaaactcccgacctcaggtgatctgcccaccttggcctcccaaagtgctgggattacaagcgtgagccactgcgcctggcctcttttttttttttttttaaatatgggttttctccatattgcccaggctggtcttgaactcctgagctcaaatgatctgcccacctcagcctcccaaagtgctaggactacaggtatgagccactgcacctggcccatttcctatagtcttaatgggttcatccagctattctgtgctaggcattggcattgcagtggtgagccaggcagtcagagtcctcgccctctagtggcttaccacctggaacatgtttctgaaagtgtcatctgagtcacaatctcctagggattgcttaagcaatcccttttaaacatccctagaaattcagaatcagtaggtctagaggtaggacccaagaatctgcatttttgacaaacatccttgaatgattccagtattctagagacagctggtctagaggatgttgttagcacagtggatgggattagctatcagagaacttgatttgagtggcagccctacctcctcctagctgtgtgatcttagaaaccttaaacttcctttcagttttaagttagttctctctaaaagagggcagtgctgaccttgcagggctgttgtaaggcctgatgggtgtgtaaatgatttgtaagctacactgtgctctctgagtgaggtattctcataatttcccctgcccagatctcctcatccctgagctctgtctccattgacactccccatcccccactccccaggccccaccctgatcccacctctgctttccccagtatgcagcctggctggtgctctgggttggctggaatgcatttatcatctgcttctacttggaggttggacagctgtcccaggtaagcctcagacctggcagtgccatagggcagagcctgaccattcccatcccctgccctaagggtactgtggtataggaccagagcatcatgtctcgaagaagtctctctctccttacatgcccaaataatctgtgtgccccatttcctacttacacaatttatttctggcttcctcaaacacaatgatggagcagataaggctgaagagcagtccatgtgaagatgagccaggggtcccagttgatcacaagctcagtaaaaaccaacagtatgtgggagcccagaaagctactcttaggccccgctaatagaggtagagtattcagagcaagggaggtgaaaatgccatgcgctttgtagtgcttagaccacaaagatttgggttaattctgatcaatatttttcagaagggaaagagactagttagagtttgttcagggaagattgagcagaccaagaaagtaggactgtttcgcttgaataagagcaagcccagagagacacaacttctatttttagatataaaagaggcaaaatatgtgaatttaagagcattggctttgtagtttgaccctgctagattcaaatcccagctctaaaaccttctagctgtattaccctgggcaagtggctgatcctctctgagccccagtttcctcatctagtaagtggacataagagcaactgcaacttcatgtggttgctgaggggataaaataaggtcacacatctgagtgcttggcccctggtcggcaggcagtgagtatttatctgttgaatgagtgactgcatggatgggcacatgggtacacaccctgggtaagaacttctgatctaggccagccccttctccatttaacaaatgtggagaccaaggccccaaaggagaggttcgcccagggtcgcacacagggggagcagtggagatactgaatgggctgttaaggggctggtactgaggatttcacctgtggctgggaaattgttaatgttccttccagctctgaaaattctgaggcccctgtgagtccacacaaaccccttcccatctcagtgacaaaagagtgaggcctgtgtggtcattaagtgccacctgttggtcaaatatggacttgcaggtgcaggctccctgaatcccttcaccgatcaatatagtcttcctgggctgggggagtagctcccccctccctctccctcacactcagtatcccaggcccctttgcccccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcagtaagtccttctgtcccccaccctacacacacttcccgatccctttctttagctctggttgaggggatgggttgggcgcagtggctcacgcctgcaatcccagcactttgggaggccatggctggtggatcacctgaggtcaggagttcaagaccagactgaccaacatggagaaaccccgtctctactaaaaatacaaaattagccaggcatagtggcacatgcctgtaatcccagctactcaggaggctgagggaggagaattgcttgaacccaggaggtggaggttgcggtgagccaagattgcaccattgtactctagcctgggcaacaagagcgaaactccataaaaaaaaaaaaaaaaaaaaaaaaaaaaaaaagagggaatgaacctaggtcttccgcctgtctgtccttttgtctggatctgtttccatatcctgtaccgtcttccctcaccgctgccccagcccctgtgcagagtgaacaggtttagtgagtaggatgaggcatcagactatgaatcaatcctgggtttaagtgctcaatacacccactatgtgactttggacaagtcacctgccttctcggagcttgtttccttattcacaaaaaagaatgacaataccagcctcagagttgtgagaataagaaagtgaccccagtgggcgtgatgcctcatgcctgtggacccagctacttgagaggttgaggcaggaggatcacttgagcccaggaggttgaagctgaagtgagccatgattgcagcactgcactacagcctgggtgacagagtgagaccctgtctgaaagaaagaaggaaaggaagggaagggaagggaagaaaaaaaaaagaaagaaagaaactccaagataggagtagttcctgtttctagaagggccagccctgtcctaggcactttgtacccacaaagtcacataatcctctttcttcttaacaagccataaggtattgcccaagtccaagtgggaaaactgaggctcaaagaggtaaaatgattacttgtctcaagttacactttcagaagagttagaccatgtatgtttgactttaaggtgaaaacatttaattggaagttgttacggtttgccttcatcctggcatgcctcctcccttgccagtcagagcgtacagggcccggcagggggcggaggaagaggttcccactcctccttcctccctgacgtgtcatctccactcccagctgttcggcttcgtgttcgcctgctacgtgagcaaagtgttcctggaggaggaggacagctgtgagtaaggcgcccctggggaagtggggaatctggccctgcgccttcagcaccctggacagaggcctgtgactggccccggcgggagggagcccagggtcggccacgggcccctttcgaggggaagaggcggctggtatggaaggctctgcataccagcccgttccaggctggggtccagacgtccaggtgcccagtccctggccccagcaccccctttccccaatctcgccccaccccatcagaggtcttgtcccgtttagaggctctagccccgcccctgagagccttctctcccataggactgcccggcctcccaggcccaagccttaaggactggggcctgaccctcagctggcccggcctcgccgcctccagacccccagaggcccatccctcagggtccagccgaagccccgccccaggccctgcacggggtctgaccctcgcccctcccctcctcatggcttctctggctccgcttcctagggtgggagtcctgccctcagattcttccccttcaggacccagtctccctctcctcgcccccgccgccgatccctaacatgcgccgcccctcttccgcagttgacttcatcggcggctttgactcctacggataccaggcgccccagaagacgtcgcatttacagctgcagcctctgtacacgtgggtcacggccccctgctggcttggggaggcctgggcgtcggggttgcgaaaaggaggggatggaggagtgggcagggcaaccgggtctctccgcccccatacttttgggatccactctccctaacctgcctttgtttcccgcaggtcggggtagcctctgccccgcgcccaccccggcgcctcgccctgggctgaccgcagctgccgcgagctcgggccaaggcgcaggcgtgtccccctggtggcccgcgcgctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctct

SEQ ID NO: 38534 - DNA, 61186 bp, Homo sapiens
agcgactcggtgacagcggcgacggcggctcccaccgcggcgcacccccttcaggcggccggcggcgaggccagaccggagagttccagcacactcgaccaccccgcggcttcctggaggcggcggccgcgattgcgaggtagtggccgcggcgcccccgtgcgggccggggtcacccccgccctccccgcgcggagctgccaccgggacgcagggggcgcgccgggctgggcgcgcctggcggggcccggcgcccggggaggggcctgctcccgggggcaggacggcgcccggaggccggggccggctgggagggccgggcgggggcggggacgcgggccgaggccgccgcccgtgtggcgcgccggggccccgctcccgttcccggcgccgcgcactggccggcggggccggggactgccggggaggcggcgccggccggcggggcgggggccccgaagtgggtttcgggccgccgcccgcactggcatcgggcgcagagggcggtgcacggcggactccgcgcccaggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggtgagtgtgcgtcggcgccccgggagccccggtgccccccaatgcccagccccggggtggccgcaccagctcgggctttctgccatgttaggcaccgagcaacgttctcgctgcatttttgcgtgcgtttcagtggcgccttttgctgcggagggagttattgcttctctccgcggtggctttttcggggttggggttgtgctctgtgtgtttgcttgtttgccatttaaagcccgactattgttcaggataagctccgcctgggtggggaaatggcatcccaccacagttgctggcgaggggtagaaatgttgccaaacagctgctgctttgtgtttccctatcagaagtccttggagtaggtttggggcacgacggatggatggagagagggatggggcacggaagaagaaggtggctttggaggagcgggttgttacccacaccatggcactcactcagtctccctttctgcctgccaaacttttatgaatattccttttgtggcagagggaagcttaatgaatttagcccagttttccaaggaaaaagcaacccagctttaacaatggtttgagaacttaatcaatgaaaaaggcaggagaggaggacaaggaggcgccgacaccatatcgggtatgtggctgctgcttgcagagtcaggtaggggagaggtggggagggcacggcgcagcgtctgggtgaccgtgttcccggaactgttggtagctctcacctgtgcccgctggtgccacccaccgtcgtgcccctatgtcgtgggctgttcagaacccagcgatggggtttgaggggcggcttgcggcagtgcgcgggccggcccccctcatctggcgtttttaaggatgtgtaaatattttgctgaggataagtgacatcaacagaatgatattccgcagagcccgggtgtgcagcgatgataaatagatatggccaaacaaagttttgataaccgcgtattctcatggctctgtctgtttcatttgggtctttgtttttgttggtttagcattatctcgcatcctctggtgtgatccctttatttaactgattcttggaagcttctctttagaacagagagaaaagcagccagcagggagaaaacaattcttagccttgcaagcatcaggcaaggttttctgtgcttttcccagggaatctttcccaccgttttctggatgtctctcttgctcctttggagtcatcagaattggttgttggtggaccgagagacttgtgacaactttgaaaatgtggtgtggacatgcctttgttacagtagaggggtggcaaggtgggagggggacaatacggaaggggacagtatggaggctagttttcttctcaaacgggaacatgagaagccaggggtgggctggaaggcagagaattgtaagatggtggcatcccagtttctctgcctcttacaagcccagagaagccacctgcccccacacccccacatacacacagtctccttcaaatgggcactcgcttctcgtcctgacagatgcccactagaggcatccccagggcagcccaggcactatgaaccaagtcagactggaacttgggggtagtgactactttggcaccagcccaggggaccattcagccacccgagggggttcctttatgatgaaaaaaagccaagacctccagtggtgatgttttgcccaggaaaacctgttcatctgaggaacaaatgaaaagacagttttccaagcgatgccgatcgctggggtgagaacacggtttggtgggcagctggggaagaactgtaagacacatttcaaaatcttgtatccagaatacagagtccctgaaacaggaccatctgaactacaagaaagaaaaatcaaagactggaaggtgtgtgaggagctgttgctgggagtgctctagctgtaatgacccagaagctgaggataggactggcctcccaaatccattgatccagaatggagatactctggatgtgcagaaagccctgcacagcgtgctccaaatttatgataagaaaataggaaacgtctgttctctggcttctcccctaagcttagaattttggagaggatggtagtggagggaaataaattgggaagggaactaacatgtattgttggcctctgtctgctaggcacttcacatgtggtaaaccttctcagccaccctgtgatggaagaattattttacagataaggaatctgaggctcagataaatttccagttgtgtatctgatttcagactttggtggttatgatttaaaggggcaacatgtccctattcccctgctccaggtctcttatttatttctcttaacctgtctgaacctcagtttccttacctacaagatgggaataatctttcccatctcacatagacgttgtaaagattaaagtgggacacgtcagcatggaaccacgaaggactaaaactggagtatgacaccaggaactccaggcccctaaccaaacatacaaatctctggatctcttcctgctggatctttcagcccctccaccttggcaaaatctggtacacagttggtggggattggggggaaggtggaagcccaccagtgggcaacccagtcacccacagtgcatacttatgtgccaagtagatagatccgaaataccctgtgtcagatggacagactgtaccctttcatcttggagtccccaccacccaactgttgcttaataaatgagagttgagtgactaaatgatggcactgatggagtgaatggcagtggggagggggctgtagatcattgttaagggagacccagcaaggagagatccagagatttgtacgtttggttgggggcctgaagttcctggtgtcatattccagttttagcccttggtagctccatgctgacaagccccagtttaatctttacaaaatccatgggagatgggcaagattattcccatcttgtaggtgaggaaactaaggctcagaaaggttaagcaactaactcaaagtccacgagggaccaaaggctgggtgaggtatttttaactagaaactgtctcaaataaacaaacactctataggaaaatgaggagggaacttgctatgcaaatgtatcgttaaagcaagccccgtagcccccttccaaccaggtggtagtcttcaaactcctagaaattctggagccaccgagggagctgggctttgaatctatgtatgaggagctcctcaatgctgcctccctgaacagaatatgagggagacctcagagaatgagggggaaagatggctaattgcactcttcccacacacaaaagcctgcgtgggattctgaattaagcttgatttggggatcagggtgacatccttgctgtagagttggcagctcttgtctttggagaatgcctctgattaccacttctccctcccacctgatcgtctgcccgggtgcccatcatctcattctttccagactcaaagcctttccttcatggctcacaatgttgatgagcctcttgagtctgccacttcactgtcctctgatggcagctggtgagaagctgattttggcggccaggttagtacttctggagttcacacatgaccctcctctctcctgccaagaacacacacacgaacacacatgcacacacagacacaggcacacataatttgatcacgtttctgtatctgcttcaccaaattagattcaaacccagaattgttattggaagaagtatgtgactttggtgttctctcccagcccctgccctgaacagaccagaacagctaagatggaggcagcttagccagcagatgtcttgagccatgatcatacttgctggccttcccactgctgtggggcagcaccgcaaaacatgggcatggtctgccttcatccgtctgggctgctataacaaaatcccataggctgggtgacttataaatgatagaaacatatttctcaccgttctggaggatgggaagtcaaagatcaagataccggcagattcagtgtctggtgagggcttttttcctggttcagagatggcatcttcttgctgtgccctcacatggtagaaggggcaagtgacctctctggggcttcttttacaagggcactcatcccattcatgaaggctccactctcacgacctaatcaccaaccaaatgccccacctcttaataccatcacgttggggattaggatttcaacacaggagtttggaggggacagacacattcagactatgcatggtcccagggcctttcataaaagcccattttaatctctactgagacatagggctgggctccttgaacatcccaatccttgtaattccaatttctgctgtaattagctccaacaactcagtaattctagagaactttggagcacactctgctcacacctgtcactcctcttcccacaactttttggtcttccagcacagcactgtctaataaaactttctatgatgatggaaatgtcacatgtttgcactgtcccacacactagccactagccacatgcagccatagagtgcttgaaaagtggttggtccaaattaggatgtgcattaaatataacagatgcatgggatttctgtgacttaatacaaaaaaagaatccaaaatagctcattaataagctttgcattgattacatggtaaaatgataatattttgaatatattagttaaatatgatagagtattaaaattagtggcttcttttatttttttaaatgtgactacaaaaaaaatttaaattacataaacatttctattagacagagctgctctggagcaaactaaccaacctcgtgacttcagcctccagatgttctggggacataaacgctctccatctcgatggcaggtgggaggcagggggctgagtcagtagccacagcagcctggcatcaagcgattttgattttcagtagctcaggtgccatgatggaggttccccgtggaaactagccatgagcatgttggctcagtctcatgctctatgaggaatgtgggacccagaaacccaatagaatgggcacaggcaggactggcttgaatgaaatggctctttcctttcctcgaccccacccaccccacaggccggtgtccttgtccatcggagaattccttgacacctgctctagtagcagcttaaagtactatccatcccagggatttgtgcttggagagtaatgtcgccagtagacaccctcatgctgacagtgggttatttagggccagggccagccttaaaggagagaaaataaaaaagagaatgcacactgtcatttcctgacagcttgatgagaacaagagcaaggacataaataaaatttctgcgagggagacagaataaatgcaaggaaggtcaatttcacacaaccatagcacagcagatgaagaaacctggccaaaggagagttcagggaggtagaagaaggattttggctggcactatggtatcatcacatcacatcatttctgggtccttccctaggcactggtcatggcataaatagacggaaagggatgggataatgaacttgggactgcagtgatttacaggtcaggcgcctgtggctctggctcctgagggggctgccctcacaggggacccttggctgacccccttgggctcctcagaaggagttggttttgtttcacatggcagaagcagactgtttactggagcacaggaagaatccgacattctggcgaaaaataattcattaacagccagggtattaccagttccctggaaaagctcctccagctgcactgtagcaactgttctttttcagcagcagaatcgggccgtgctggcagccaagactgggtgtgtttgggcgtttttattgttgttgttatttttgcctttgtgtgtatggccacttttcccttataattcagagaaagaaatggaggcctggaagggttgaaatggtgtagctgtcagccattctttccttcgtgctttaagcctggaagctccaggctgactgtatgaacataggtttttcctgatcaaagcccatccccaaagtgggggcactgcagaaccacatagaatgttctaggatgaaaggaattttagggaactgaaacacctgttcttaagattctctgaaagcaattggctgaagaatccctccccacccccgtatgcacaaccaggcagaaagtcctatcttggccgtgtggaattcttttgcttactattaattggcacaatggggccaaagtatgtgattcatcatcctagttttgagggcatttggaaagccaggcaagcataaccaagagaatgggctgcatgttttgctcactaaggaatgattgaatctacagtaaatacaaggaaagattcaggaagctttttgtgctctggaaaaatatgtctttttaaaaaaataaggtttttgtctgcctgtttgttttttaatgcctcatgctcagaagtgtgtgcccagctagcaaaaaacgggaaagaatagcatttccttgttttagtttttttaaaactctaattgcagtttaggtaagatacagtgtattgattttggttttgtatggaacataactagataatcattttattttatgagatattaatttccacccatttagactgatgaaatatgcatttaaaatatcccatacctacccccaccatcatcacaatatttctttaatgttcctagattcagatggagaacctatttcatttatatggaaaaggagtaaatatgttagtcaacatatatgtaaacctgccttagattttgaaaaaaatgggatcctttccctttttttaaaaaaaaaatgaatgttaaaggccaagcatatttggctttatctggagcatggtttcttcaccttggccctgttgacattttagaccagagaattgtttgttgcaggggactgtcccatgcaccttaagatgttcagcagtatccctggcctccacccactagataccgttaacaccacatcctcctaccctagaccttgccaaatgtcccctctgggacaaaattagccctgttgaagaccacttgtctagaccaaaatttaataagtactttgtgtttttttggaaaattccatttgacataataaaagacacaattttccccctctgacttttataaatacaattcatgggcatgattaattaacggttggaagtgggtcatgtgcgtgatttaattctaaggttggtggaagggtctataagattgtataagcatagagactttttcaaggcaggcaattttataagtcataggtgattggggggcacattgtaagaactagtggcttctctggtttttcataaagagaacaggtttattcctccctaatttctttttcatatgcacctgattccaggcatgacttcaaagtcagcaggcatcttcccccacccccagcccctccccactgtcatttctccggtagcatcttaagcccgagccaattgatttagccatttagtgtacttgtgagagctctgctcgtaatattgtaatggactcatttcagattgtagcagccctttacccaccactaaattccatgttttccagtactattgagagagaaagtcaacagtactttctcggtagatggatcatttttcgtaatgattgaaattcaggtagcccccatcacccctggcaattttgtttccttttacacacatttgtttccttgaagcaattctccttcaggcagctagcacctggtaatgcctacaggcagcaacagcagatgaaatgttgccaccaggacaagccctcagccatattctttctggtagtcccttgaaaggctagaaaggagggtcatgccttacacaaggaaggtgtcatgcgggcaaaccatgccctgcccatacatggaaatggaatgggtgtttggggggcagggagagggcagagaagtggatcactcattatacagggaaagtgttccccagttagccctcccctgccagcctctgagagtgatatgggagcaggggatgctggtgaaggataggggcagttgttcagtgcagaagtcaacataggccacttcattttgcagccatccaaggtaggctgaccttttccaaagagtgtcatgtgtaggattcccttgcatactagccagtgaggaaaaatggaaaggtgagcattgagggatttggcaagccagcgacacttcattggtgagttccagcatctcttgaagagtagttgaagtcttccttgtcgccatgaagagagaggcaacaagctggtagggatccacagtgtgctgggctcaggcggataaataattgatttgtagcacgtgacacttggacattctaagttgccagtccgttgcaggccaggattcaggtgatggttgcaacactgggagaggaaataggatcataaatctgggcgttggaggccagtttcgtggtgcagaggccactggggccaccgctgtgtgtgcagaagcaaacagacagatctgagtggtatgttgttcctcaaaataatggcaatggaaatggctgtgaaaaacatttaggaacttgtcataaaaatgcaaacagtcttccttctatagggaaaagctaaataaaccctattgcagctgtattaagtagaaacagatttgaaaatcgggtgttttttttgttttgttttgtttctgagacacttatttatagcaggttgggcagaggctgccactatctttcgagactccggaagagtgttttccagatggtccttgctgtttttctctttattaagcttagctaaacagtgctgtgcttggaaagggtcatagaaaccagtgttactttttttcagattacaatggtcattgattggctagcaatcaatggatgggaatggattgagcctgtgccgatgaatttcctattgcattttataaacaagaaaaatgtcaaggaaagcacagaatagggatactctttcgactatgcacatcaaagctttgaaaaccatacagagttacatttcctattaatttccatttaaattttgttctaaaataatgctcccctctttgtgaaagctctacaatgttaccgtttcctttccaacatctaaacaatgtccagatccatttcagattgagcaattagctctggatgcaatttccttttatgaaaaaaagaatcactagccctctagaccaaatataaaattattgaatgtgaaaatatcaatatggggccatttgttctaagatcctttttggtctatcactggcattttaagaaggttagaaaaggccaattctgccctgcccttccatgttcgacacagccacaccagaaaccccaagctttgtttgtgctcatagaggctgagcagctggatttgaggtcatcagggctgaagcttacagccaaaactgcaaggggaaacatcttagaatgtcccataagccagtggtccccacagaccaggtttgcagaccactgcctgtatcggacaggatttctgccccctcacagtgaagtggaagaaaagtgaaaatgcagtaaatttattttgtttaaagctaaaccttttccactttacaaaactgccctgtattccaaaatgatctttcccactgtccttggtgtgaaactttctcttacgacttatcaagagatagtggatgacatttgtattttgacatcttgatttaacaaagtcagaagttttctaactcatattggatccttcattttaaaaatgctactcatccataacattcaaaagtctgaggttcacccaggaggcccaagtagacctggaaggggaggctttgttatgattcctaagccagaaacagcaacctgaggaaggatcctgggaccgcttccctgagtcccttctttactcagctcttctgacccctcactcatagagagctggctttgtcctaagcccacgtgaagaatggaattgcttctttggaggagtttgagggggcaaaactggcctcttgaacatgaacgcacaagcgtgcagcctcaatgctgagagcctgggccctttatccctgactcccaatgtcagcgccattgccggttctcgtgggcttgacccccttcaccctctcctcagccatgcccactgctgtcatgagcacaggcctcaaaaggctccccggtgtgaccctgttctcctcactgctctgcatgatttgttgcattgctcccccagctgccgttccacaggcctgcatcagcttcctcctgctaaagcacctctctagtcttgtcaccctagctcaagaacattcagtggccccttattccctaataaggttgaataaaagtccacatatgaagccctttctactttcccagcccatttctcctgtcctagagcttcgactggcattcagtaaggcatcatgggagggcgtctacaggttttacaacttctctgtgctgggttttgtttgttttctcatatgaggggagatttccaaaaaggttatggggtatcttggacatctttctagatgaagaaaatggaaggcttgagtttaatgtgagagagaaagagagagaagaaaagaaaaaaagagaagaaaaggaagcctttcacaaaatgaggctttctggtttcaagaattgcagccttactacaagtctcttaccactctgggtcaggataccacctttctggcctgccagcaagtgggtattgcttcagaattacactactacttatcctgttgagaactgagccacttacccaagctttggaacgtacaactcaaacatagtggaacgggtccatcctagccaatgcagaatgtccattctgttaggaaacatcctccaatgactgctcatgaaatcataaaagcaattatattacctctcatttatcaagctcctgctataggctggacagtggtaccaagtgatttacatatattattttatttccagctccataacaaccatatgaggtaggtatacgtattatgaactctatttcacagagaaggaatcagaggcttggatacgtttagtaacttacacaagatcacaccacttacaggaggtggaactgggattctgtacagcgtggttcagtagaactttctgcaatgatggaaatgttatgcacagtccagtatggtagccactagctacaagtaagtggctgaggaagtggattttactgaatgtacactttggtagcagctctagaatatgcttgtttcaccgcaccattccgtctgtctgctctctgcagactttacatctctcttcctccctctagacaaaacacagctctgctttttctcagaggcctgtagccagcagttctcaagggcaagtgtgcattagaattgcctctgtacctcagggagcagtggtcgctggctcaagtcagcagggagaagcttccttcccactgctgtcctgaagagcttaccctctcgtcgtcatcccagctttatttgggcgactgttagatttggtcacttccttagcaattgttcttgaatgcattcattttaatttgggatcttttgggaggaagagggtggagagccagttgcgggtgaaggaagaagcatgggctctaggaactgcctgaccaccctagcaatctagggcaagcccaggcagagaggcccatttgctgtccaatttgctgttctctgtaattaaacagggcagaaaagttgactaggaaagagtgagacagacagataatgaagctgggttttcccccacccctccatgcccctacacttatttcttcaccctaattaaagtctttgtccattttggagggcaaaagccagcctccctggggcaggggtagaggtgagggggtgtgagtggccaggaggccagggaaggtctggaaaggtccctggaaggagattgtgatgtcagccaccttaacacttgatctccatttcagcagtgctaagaatgttcttgtttttttttttttttagatacaggtggaaagaagtagttgaggttactcaccaaagcagctgttgagctgtttttcttatgaatatttgtaaaatgaaagagtggtatggaatatttttttctgagtatgcacaaatcttctgttttcccccacagagactaagcttttttcttttctctctgtctctccctcccctaccctttttttttttttcattttttgttttatttgagagcagaaatcatgtgtctttttttgtggcttggtctcaaaccaacattcattctcttgagccaggcagcacttcctaaagctcattttaatcacagtctatgacagtccagccctccttggctcctggcagcacttagatgctgataatagattgaacaaaaaagtgctaacacacaagtttccctcagtttgtctgtttccaaaagtaagtctccaaaggcatgaagttaagtcctcttttgcattattatagaggctctgtccccattaattggtgttgaaatgtaaattccttgggcttttaatacttccattttcctaccacttagctctctgccatctacccatgagcggctcagtaaataccagcatgtagtgggtcccagagctctggccctctctggtctttgtcaccatcatcaccaggggctgaggcctgctttcctctagtcagccaaacccgctgttaactccactgtggatatttggacaggaagctcttcattcccccatccatatggatacttatttgctgccttcaaattcgttgctttctgcagagggctatgccaagtgctccacccttccccttcattccttttgaccacttctgtggctgggggcaaaggactccatgttctccaaacctaagatggagttgaaccactgcagggctttaatatatgtgctttcacttcaactacacggtcactttcagaaacagctattttcatttgtgggatgaagaaacagaggcagcaaaagggccagttctgagtgatgagcagaaaaggtgggcagggcccacatcataatgggtcttgtgtgccttgataaagaccttggacttcatcctgagcagttttcaggaggcttttgaggtgacctagtttatgtgtttggtctttttcccagtggagatgtactggagggtgggggatggggacggtggagggaatgaagaccaaaaaggccctgttgcagtaacccagaaagagaggcaaggaagaaccgaagtagaggagtgcagcggatggggaggctagtggctggattcagaaagaatcttaggaggctgcctctctgaggcttggtgatggctttgtattagtctgttctcatgctgctaataaagacatacttgagactgggtaatttataaaggaaagagatttaatggactcacagttccacatggctggggaggcctcacaatcatggtggaagactaaggaagagcaaagggacatcttacatggtggcaggcaagagagagcttgtgcaggggaactcccatctataaaaccatcaaatctcttgagacttattcactaccatgagaacagtatgggggaaaccactcccatgattcaattatgtccacctggccctgcccttgacacatgcagattattacaattcaaggtgagatttggatagggacatagccaaatcatattaggctgatagacagactaaatgatgacagcaccctggtttctgtcttttgggccccctggtgggtcaggaaactcagaagaagggagagagtgggtatctgggcctcccctccccctgcagccaggcctaggtgagtagtcagaaaatcttggtatggcctaggcaatcctattctgagccctcagttctgaaggaaatgcaatgaaaacaaattgatgggtcagaagagccttttgaagccattctggggacaaaaacaaaacctgacagacatagtcaacagccaggagcaccttcagtccgcagctttaaatgcacttcacaaatacatacgctttaaataggtcagactctgtaagcaggaggggactttgggtgagcctgctggttcaggctttgactgggcccagctaggggagaggggtttagctggtggcctgctgctagcatgaccacccatcctgtcctcatttgcctgggattgagagggtgcttaagacacaggactttcagttttaaaactcggacagtcctgggcaaaccatggtgagtgagtcaccccacctgccaggggaaatgttgcaacatggatggctgagctgattggaaccaaagcagtggagatttacttccacctgaactggcatcagtatggggatgccaccacagagaagaaaaggagcttgggaatagaaaaggcaagaacatatccgaaaccctttccaatagcttctctggttccaactgaagcacttctcttaaaataggagcctgagatccttaccctgtcttcctggaaactagaccgccctatgccattcttgttatcccacccatctgatgcctgtctagatatttcagttgaatttcagatgagtgaacaaatccttcagtcctgctggaatctgggacttgaaagtccttaactggacatggaaatatgttaaactgagtcttgagtgagaaaaacactttctttacataatgcattcctacgtccttaaaatcatgattagaaaagactttttatttttctaggagcagcaagatgcagactcttgtgtagcagtagaccattcagattttaattttgcaaagcaactgtaatcctccattattcatcactctactgaaaccaaatttaaaaaattttaagttttcaaaagcttcctttctccacccccatcccaaagatttctcttgcaaagcaaacctcagtaaataaacaggcaacatgttgtaaatggtacaaagtggagagcttggagtaggaagctaatgaaagggatttttcctgttgggtcctggtgcaagccttcaggtacattcagaaatacaaagagaaatgcagagtgaggtgacacactcatcttaggacaccagtgacagggaaaagcactcagagtttattctcgtggtggcacctgaactctcaacaactagaatatggagggtggtctaggaggaattcagttcagggaaataaaagcgaaagggaaaactagaggaagatgtgaaaaaggcaagaataagattcctcggccatggccatgtggttcagatagttgagaaccaccccaaatgggacttaggtctttggaaagtgccctcaatgataccctgccctcctaaaatgagtctgagagagaaaatgagtcttcttgttcatttgtggcactctgtaccactgtatgaggagtagatattagaacttaaataatagcatcagcatttttaaaaggttgtctatttcacacacacttcaaataggtcaatttttaagcagtagggtgacatggtttattctttccttggtaatgtttggtttttaaagccagctatatggatgggagatgtgttaaaaattatctaacacaaatttttatttgtggatttttgtctaaaattcttacatacatacacaaaattgcatatattattaagtgtacatcttgaagaattttcacaaacagcacaccgatgtcaccagtgccctgaaggagacacagactgcaccagcccctggaagcttcttcatgccctcttcattatcctcaccaacaatagccactatcttttaacagcatagatttgttgtatcacatgcagggatttttaaatcatagctttgtgtatgagtaccaaaaaaatccagtcctgtgatttgttttgatggagagggtgggagcagaaattttgtaatggttttctttctctggctgctgtgagttaggcttgttaaacaggaagtttccaagctgggttcttgctggtatagggtttggggcaggctggtctcttctgcccaagacaatgcccaggctgcaagccagtaacctgttcttggcaccacctgggccaaaggcagccaccaagcttgctttatctgccttattaaagcctctgtcagagcttgcaaagacacatgtctgggagcaccaagaataggacaatataatggctgggagtcctctgaatcaactggccttctggaaggtaaggccaggcacagcgactaaaacagcaatagcatatccaacgaggacatttttctccaacttccaaatgagagtatgattgatgaatttctcttcttcgtaggtttcattgtatttttctatgtgcattctgcctccttttctttttgctgcaggaggcaaaaagtgggaaggtgggaatcaagctatggaacatacatcgtaatgtgtctggagcggcatcagcaaaggacttatttgttctcctgggctgtggagtgccgagtgattgaatactcgccaagctgtcagttttatgaaacaaattccctaaccctcttggcccagagctttgctctgcctgaaatggaaaagaaataagttttaatagaaaactcattgcaaaaatctaagataagattcccaagcaacttctctcctaagaataaaatgaaatattgaagaaagcatttgatggggtactcttagggaaccttatttctcagttcttagttaacaaaccatgttaataaaaatatttagactttcgtgatgcataatgcatttttattcctagtgagctggcctgtttgtatacacagatgtttcctgtggcccttctatcatagcttctattttttctgaaacaatatttctagcaggaaatagaatcttatgttaagaacctaagcccctcacagaccctgttagtttgagtgaggatattttcatttctagatttaatacttgagggagtagggtcagaatctttttttttattcaagaacatggaaaatacttttaataaaaagataatgcaatgaatccactgtatcaagacattagacagttcttccttggcttctagattagacctgatcagttcatccaggcacattcattgctgaagggttggatggcttttctgtctccattctcactgtcaaagctgccatgagtaatgtctgccctttcatgcaaaccttaggtgtgttcaactgggttttacagattttccagagcattgttctcacagagctgcagtttcctttccagcaccaggagcactgtcgcaacacagctcacgagctcagtttctctgccactcgttggagtgcatggaaatgcattacaaacaaaacccacaggcaagtgtgctaaggaaggaaatgagattttacacatcagcactttaaaaaaaaaaaagatgaacctgtcttaattgaaaaatggcataatgccctaatgaaaaatcaagtttcaggattcagtccctaatatctcagtgatgagtgcatatttcctcctgtggctactcctgcgagtgagttctgaaataatcaggcagtgtgttgaaataagatatcattgggtgttactataggagtgaggcatagctgtctggctgacatgctggtcaccgcctacgtgccaggagagaaagggatgaaacacaggaatccttctcttctggctttttggagttttattttctttaccttggtagtaaatcttgtttttctatgatcataaaagtagacatacttactttaaaacatttacaagtatgagaagatagcaagaagagaataaatatcattcgcattcttaccacccagagattgccactatcaccattttggttcatgtcctcacagtcttttttttttttttttttcctatacatatattctttatcttctccaggagtttggagctttacaattcaaagtcttcttgtgcttaaattgattttctcaaaactttgccgatcatttatgtttccctaatcattaacatcaaaaatgaaaaggtacctgttttattacttctcatgggtgacaaagaaatttttagcatatttatttctcttcttctactgactgtcatatcccccaagcatgtggaacctagcagttccttaatataaatgttgaatcaatgaatgaatgacgacagtttatcctcatattactcccagggggtgagcatcagctcctgagactaacgccttccaccatcctttgctgcctctccctcgcagtgagactaagcctccctctgtccactgggtctgttctccctggttttccatggactgtgggcagtaaggggatgcaatggaaagggatcgccctttagagtcaaaggggccaaattctcaggtctaccaactactacataatgggacgagtgtcttcatctctctggcctcagagatgccaactgtacagtgggtggcagtgatacctgcctgtcaggatgagtgacaagtatgcaagatgcctagtacacaggagagatccaacgtctgcagctgctagtactttgcccactttctttctaatgacagcataaataaagagcccttggggccctagagcacttcctttctcttcacatttccagtcgtttcatctaatgagccataggaagatttctgatgagttacttgatgcttctgtgccaagtaaatcagagaaataaccaagaattgagtggcctttttaataatctgtttcttgtgcttcttctactgccatcgcacgtgcttccactgcagcaggtgtctggctgcattgtaattgtgtgttcacacagctgactcccccacgacacagtgaatgtgtcttgcatcttggtatcctcaacccgggacccacagtgctcataattgaggagttactcaatatatattgattgaatggatgaatgaataaatgaacaaatgaatagtatcgtattgtacacgtattgtccctatctcgaccacacacatggactttctgcaaaccatattgtagaattaaatcgtaagccttctgaacctgtgatgtaagcctctgacagacagacatataagtactggttctgcaaagtgcgagcttaagggaaaaaatgatatttccttttagttgccatgattaatccatggattcactggttcgcatgtgaggttctttagtggagtaggagtgacaatgtatgcatggtacagcttcttgtctgcagcttttagtttgagttagatgcgtgttggcatctctttcacacagaatctgaggagctggcatttatttttgacagcatctcaaatcttgtgaaagtcagagcttggggctggcattgttttttagtagtatctcagacggtggcaggacaaccttgatgataaaaaagaggcttaaacagatgtcttcttagagttcttccaaaaaactaaaagttcagcaaaaaaataataaaaaaaaaagcttctgaacttctagagcaaagacttctttgagcatcagctatttgcagactggccacaaataaacactcacaaacaaagtcatagggatttgtttccctctctaattcactacggtagtgattgctggttagtccccaaaacctgttttgtttatcttcctaggtacccagatagactacatttcccagtctctcttgcagttgtatgtgtggccatctgcctgagttctggtcaatgggatgtgagtagaaaggatgtgtgcacctctggtccaaccataaaagctttctaggttttcctccaagctcttctcttatccactggctgtctgggatggagtgaagtcccaaggtcaccttgaaagccacagttaaagatggcagagcctcttctgcctagggaaggccatttcatggaacaaaactgccagatctggagcccccaccctagacagttacataaacaagacataagctttcattattgagcaattacaagttaggagcaattcactaggtaacttatcctaccttaactaagtcatgctccttgggttttttttttaagcagccgatagttttcaaaggccttttatgtgcctggaattgtttgtgttactaatcctttcagtagccctgcaaagattccttattttacaccgatagatgcaactccaagtaggaaggggatgagcattttgtccaccactgtcaccccaggattggcacagagggtggcattgagtaggctctcaatgaggcttgttgatgatggataaaaggaaggttcaacaaggcgaagtcacatgcccagaccccatagctagaaaatgctgaactcactggcctcaaggtccagctgcctctgagtattggtaatccaagattttaaaaagaatgggtgaagggccagtgatggacacttagaaaaaaatgtttttgtctctttctgactgaaaaaagtaacacatatttaaaaataaaaacattatagatatctgaaacaaagacatgaatagtgctctgtaatattatcagagaaaactggtacatgcttggttttattctttaagttcttaacacacacacgtgtacacacatgctcactcaacaaaaattagttcatgttacatgtagaaaatatagaaaatctatattctctcctgccaaatgacttcttcacctatttttcccttaaatagtttccttggacatttttttccatgtcagaacagaccaacctgtgtcctcctttgcaaggactgggtaatatttggtgtaataatctgggataattaactaagccaattccctctcagttgacatttaggttgtttccagtcttcataacacaaaagagctgtgataaacctgcttgtgcatttatctttgggggagattcctgagagttaaatggtgcatacgctgatgggaatttttcactgtcttccacacatggagacctattttctgcagaaggtccagatggtcaacagatattgaaatggactcagtggagttcttcaagttaaggtaacaacagcagaaaaagggttttccaggatctcagaaggctgcagctatggcagtccatggcaaagactaacagcaaggaggcgccagcatcccaaattgagaggatggcaccttctggatattggctggtttctctgcattcccctggcaacgaagtcagcattatctggaaggtcagggctgatctgggcccaggatggacactgttccacactaagaagggaagcaagtctccttactgcgaagggggcagtggccagtaggacagagaaagagagagggaggaggatggtgcatagatgtcgctgcagggttcctgtcagggctggagctgaaggttgcaggacactcactccacagaaccaggcagaaacctgatgtgcccagacagcttttggggtgagcaggcagctccaggcagatgtctttgtttgcaggcacagctgcgtgcactctgagatgttcctgtccatgagggatgtttctggaatgatgatgatgatgatgatgacagtggctgtggttggcagcgggaagaaggaggtgattacccaaacagcgctggcattctaagagttggccctgagagggcaggggctgcctccactctgtgtgtttatgatcccttgtggtatgagcatgtgatgtgtgctttgcgtgtatgcaggtctgtgcagtgtgatgtggttgagtatgtgagtgtgccgtgtatatgatgtgtgatgtgtgcagtcccatgtgtgtgactgtgtgaggtgtgttgcagcagcagtgtgggacgtgagtgcatgtggtgttgcagggtggtgggcatggagtgtgtgtggatgtgattcaatgcatgagtgtgctgtgttttgtgtgtgtgtgtgtgtgtgtgtgtgctgtgtgtgtgtgtgtgtttgaggcggtcctgattaaattcccccaaactattcatgttgcgcaccaaagacctctgggctcatgttgagtttttccttctgtcttctctgtttcctgtggcaaaaatgccaacttcaccaagagaaccctctcaaacattttctccctaaggagaccaagctctaggcaagggcttaagtttccactggtcacagttagagaaagacagagagagacagtattctctagagctgtcctattttattttattattctttcaacttattgttatattagtctatcttacctttttatagaggtgtatatgtaacacatacagtaaagtcacagagtacacaaatcttatgtgctgatgggttttaagtgcatgtgtattcacccgtataatcataccccagatcaaaatagaatacagtcccagcaccctgaagagctcccttgagcccatttctagtcaatatctcccaaaggcaaacactattcttacttcggtatcggtagattagttgtgtctgctctagagtttcatatgaacaggatcatgcagtataggtagtctttttgtctggctgttttcacttagcataatgcttatgagattcatccatgttgttggttgtgtcagtagttccttcctttttattgctgtgtagtatcttattgtatggatgtattacagtttgtttatccattctcctgctgacggacatctgggtggtttccagttcagggctattgcaaataaagctgctacaaatattcttgaacatgtctttttgtgtccatatgtagatctgtcttaatgttgcctgtgatagcatttgacaaagatagagcttgcaaaaaataaccccctgccaaaaatcaaacaacaacaataacaaaacccccaacttaacccagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggtaagtggggatctttggtagggtcactggctgcttcaggatttgtgagctgtgttttgggctccaatgccaagatttcccattagaagccctgtaaggctgggtgcagacaacttctaaagatacccaatttacttttagggaactcagaccttgggaaaatccagcctgttgcccatccacaggatgtcagtaaggatttcagagagtgaagaaagagaaacaaacaggcttgcacctgcacactggtgggctttggtcttttgggtgtctgcagcagctcgctcttcgactgattatctctatagtggaagctatcttggctgacccctacctcctgggtactcacctccacctatctgtgtgctcacttcgaacccctgcagctctctcctccaagacttcagtactggccctggaagcatgcttagcccaggcacaggacaagcaagaggctctggagcatatgtcaccaggagcagccctcaactgatgatgcaatgtaactggaagacagatgccgctgttttctctccctcagtagggagaaacctgaggttaactcccagtgggacttagccccagttgctcatggcagtcagctgcttattaacgcatcctgaattgtttgccttcctttcctgcctcacttctctattgttccatgggtgctgcctgtggtccccttttacatacactgtatgcactcagatcttggtcacagggtctgcctttgggggaatccaaatttaaccatgctcctccccaaggaaaaatgctttctggcacatacactaattttgtctggggattttgcaaattccatgacactgtctgcatcgcctggtttggggttcagcaaggccttcgtcagatatctttgctgtggagaagcttgtgatcaggggccaactcaggggaggaccataataaatacagatggcccccaacttaacgatgttcaacttagaatttttttcacctttacaatggtgcagaagtcatactcgttcgctagaaattgtgcttcgaatacctgtacagccattctgtttttcacttttagtacagtattcaataaattactgagatagtcaacactgtattataaaatatgcttgctgttagattattttacccaacaataggataatataagtgttctgagcttacattagggttggctaggctacgctatgattttggtaggttaggtgtatgaaatgcatttttgactacaatattttcaacttatgacaggacataaccctatcgtaagtgaaggagcatctgtagtacttaattttcaagctacaatgagggcagacagcttggtcccattgctccctgtccttgtcactcccgatactgtttgtgcacgatagacatgtaactccaaaaagatgtgaggaaatggaatcatttaagatacaggggttgcaggggtgggagttgaggggtgggtattgttacttaaggtgattctcagatactctgtatctctgaggaaaatggcttatcataaaatacagtgtgaaaaggaaaagacaaaaattgtatctgtgccatgataggttgtttcctgtaaaaaataaaacaataaagttaaatagttttgatttgttgggggcataagagtcctgaatgaatttttccattttttctaatttttccaaaattcagttgtaacataagcatgaatatttttaaaagaattccaggatgaatctttttagggagaaaaaccataatgcacaaagcagtttgtccagtttccttttcatcttttcttggaggggtatttttccacataagaaagggaacagaggaaggaggtggggcttagggcagtaggatataattagctataacatttgatgatttgagtttgagtttgtggttctggggggataaacacacggacctatctcagtggggctggggtgatctgaaggcctacagcatttaaagagggcaagatgtcaaattgcagatacagatcttggttgatctgtgtggagggcacagctggtgcaggaagggctggggagcagggaatatgaaggcacagataaactcaggctatccaagagttgggaatggtagagggaggagtatggttttggttttgaaggattccctttggcctgtgcccttcattgcctggggcaaatttagaagcacacaagctgtttaagttacattctattaacctttccccagcggctgtatttgcctcgtctgatcccgcaccatgctacacacattttctaatcgttttactgtttcactgattgcagaattagaagcatccactgtctggtaaaagtaggtcagggaagttcctgacttcgctatgttactaatagatttctgaatggtagcgtatgggcgccttaatgtgacatttgagcggaagaacaatggtgatcactcactgacgattttgtgcttgaatcgttcttttctccaacatgaacacatgttggggaggtccccgagattacaggtgccagtgaaaagtaaatgaggcactgatatgttcatttgaaagcaaatcagtgcttttatctgggcctgatctctctaggcctccctcttcttgtggctctctgccattgcctttctcatcacaactctcctccctgagccaccaccataaaaaccttttctgtaacccctgccatatgaaatagtattacatacgcgacctctttccatcaacccaccgccttcccctcctgtaagctaccttggaatcccacctctcttctcttaccctgccttctcctcaacctcctttttcctcctgttgggtgttttattctcttcccatatgatccaagcttaaggatactgtgggcctcacagaatccatagaaaatgaaactgcattgccttataatcaactacgaaatccttaggttgtccccaggaaaaaagtaaagcgagtcaaattataaagacctagacgttgtcaaattcaccacatgggcattgctattgtcaagtaatgatttagataggcacgctgtgtgtatctcgcttgctgtcttctttaaaaaaaaaaacgaatcatttttgcttaaactacttcttccttctagctccagactatggtgatcataattatgtccgaccaaaacatattgcttgtgtgtgttcatgtttaattggaaaaatgacaacagtgatttctttgaagtctcatactcacccagagctaccctgccagtgggtgttctagtatccagaatttcttagaggaggaggaagaataaatcaccataaaatgatacaataaagtcttttaaaataacaaccaggtagtaaattaacatatacacgacctttgaaatgattatgtatggggaagttgaatccagcaaacagctggctgggtgcctgcctttgactaataggctgagagatacagctgctagaaagatatttgagagtaagccctaaatgcagaaatcttttattaaaaaaaaaatcagcttcctcatttgacaaactctaatttcattgggattgacagcattgcctttgtcgagcatacatttaacaaatgagattgaacaaccaccccactcagttttatctaatttaatttgacagccaaagcaggtaggtagaataatgtacttacagaggaggtaagaatgttttccccagggttaaatgacatgcctgacatggcttgctggatcaagctcaaagcaagtatctcccccattgcttttgtatttttgttttgttttactttttaaattgaggtataaagtaagtaaagcgagttcatcttaaatatacaagttgataaatttttgcctatgtgtacgttcatataaccaccacccaaatcaagacatagaacatttccatccctgcaaaacattcacttcccaatcattatttttctcttcttctggctcaaggtaaccactactctgacttctaacagcaaagatcagttttgtttgcttttgaacttcagttttgttttgtttctgagacagagtctcactctgtcacccaggctggagtgcagtggcatgatctcagcttactgcaaccttcacctcccgggttcaagtgattctcctgcctgagcgtcctgagtagctgggattacaggcgcacaccaccatggctggctaatttttgaatttttagtagcgacagggtttcaccacattggccagcctggtctcgaactcctggcctcaagtgatctgcctgcctcagcctcccatagtgctgagattacaggcctgagccaccatgcccagcccgaaattcatatgaagtgtatcagacagtatgtacttctgtgtctggtttcttttacgcagtgtaaatattcaagattcatccatgttgttgcattgtatcagtaattcattctgttattgctctgtaatattccattatatgaatataagactgtttatgtattattgatggacatttgggttgggttgtttttggcttttcccttgccttcagttttatgttttctggatagtctatagaagggcatcctagaaataagcaagaatgatgtgcccgtgggtgaacttgtttccaactggtggcaaaatccactcaccactgcataaacaagcgttctggatcctgagtggcaagactgtcttgggttatctttcccttaagactcaagtgagcttcatgttcccttatcacatccccagcataattgtggggtaaggagggacctcagcgcctagcctccattaaccctaatatgggagaaaagaaggtgagctttagaaaccgacaggcagggggacctggggtgggtttgcaggtggccaggaaaggagagcagcagtttttcatctggagtgcacaggtatctggcatcacgcccacctttgggcagactcagggacacagcttaaattggggcatctctcctgatcattctgacacctgcccattttctgaatctgggaaataaagtaaccattattgcctctcataaagaagctgaccaggcagtgtggctaaggtagtcatttgtcgttgggcagaaactgggcacaaagggatgtcaccttagaaggctgccccctccctccagctgatgggtgaggcgagcagctgtatgtacaggtgcgacagggttgggaactactgggaggcgagggtgggtctgcaacctggatctggtggtgcagaaacgaaaagagatcagttgtttaaaccttcccggtttgcctgggactgccctggtttaagtgctgaaagttccagggcctgggaagcccctcagtcctgggcaaaccaggacaattggtcaccctacaagagggagcccttttcactctgttatcagtgcatttcagttaataaatattattagccttctattacagaccatgcaccttgcaaggtttgggggatagattggtaacaacaagacagtggtgatctctgcccctccttctggagtacttcctatagcaagaaaggtaggatttaaacaagtgattacaatacagtgcaatgcttgctttgattagagacaataaggcaatgagtgctttaattgggaaaattctggaagctctggaagcaggtgggaaagacaatccactacaagttcatgatttccttagcatatccacaaagttctagggctgctcagaaaagccatttgcagcaaactctgatgcactcataacagctatcaacaaagagggtggaggatgataaggaaatagacagatttaggtctattgatgtaatccctttgtgctgcttacattcccaacacgtagccacatttcttctcccacttcgacagtccttactggctggtgcaaaacattcagtgtgtagtgaacaggagtccttggcattgtccgtgcccataaattcagagtgacaagcatgccttggaaaaccttcttcaagttttcagatcatgtagataaaatggggagaggggtgaagatgatgttctggggttaataattcagtatgtttgtaaacagggctccagggtggaaaacttagtgccagattttctgcgtgttgttttacaacagaacagcatgtacttgtaagtatctaaaactaatggacatgtactcttgcctaagaggcccagttattgttttttgttttttgtttttttaaaaaaaagctttttaatgtactagaaatatatggcagctgttgtaagagctgaaaggcccgcccaatgcaggttgacagatgtccatatatccatattatatattaaaaataccccctgaatattttactttctaccagctatcacacagatccaataaaacaaaacaaatctcccagaactgaagcccttatctccatggaaaagtccaaacatttattccagtatcagagacacagccaaacaagatgtgtctcgaattttagagtccctttcttgccttcctcagcccagagggtgccagtgatgtttgtgtaaggtatgtccttttatggatgtttgtagaaaagatgaggatggatggtttttctagaggatagttctcattgttttcatcatgtgttagaaatagcacagatacattgggtcaatttctttttcttctttctctacctttatcatcattcaattaaaacaaagatactcacaaactattatttttctatcatatgggaatcaatgcccaacttacctgttctgagtactgaccctttggaggttcccaactattatgcagctttttctagcctagcttgtgacaggttgtggaggtataacacccccccacacacaccccagatgacctctgagctttcctttgcaaggaagcaataatggagacttatccatgagggatgaagtgcctcttcccttcacagtttgaccatgccttcctttgtagcttgttcagctcggcttgtcctgatttatgtttttttgccatctggtttatttctcttgttgttttgtattgttttaagtgtgctccaggccatctttaactgagtctttaaaaaaaaaaacaacaacaaaaaaaaaacaaatcataggagtgtcatttgaaggttagggatgaaagagaagtttaaaatgggactctgatcttccctgcaaagtccagtagctaaaaataaagttccttttactttgctgattatgtaatagaacacgttctcagatgtgaatgctatggaatgtcacagttgttcagagaatatttttttgggttttcctaaatggaggtgcaagagttctctcaaataattgaattcattcagttagctgttgaggacctactgtgtgcaagccactttgctagacactattgtggaccactttgtgatgctgatgagctgtaaccagaggcagtacttgcctttcctttggtctaacctcagttttcattctattacaccatataactctttctaaagaaaaaatgatgtgcgagggaagtggagagggagttattttgcaaaaggaaaggatagagttgggcaagggcagtgtttgtttgaaaaggggaaggttctctctgggtactgggtgctgtctgtgttctgggaagccatgaaatatcagtgacctggataactatgtttaaaccatgttcttattaaaaccagcagtcctggcttacccagacaaagaaattctgaaacaattttggaaatacattcacaagagtggaattcataaatggaactgtacagccatcagctgcactgtttagacataaagttggatgagcaaagggggaattttacaagtatggattcaaagcttttaaatgaacttgcctaattggtagtagtgatgtagagcatcttgctggaaggaaaacaaatctcatatctaaaaatgttctcttagatgtaaaagcaaatgcagcctcaaacaatgcttgcgaaacatcttggttaaggattttggaagagatttaaggatcatgggttgttgcctggcacttggtgaactgctccacacaatttagaaaccctgtcaagaggttcctaaatccagctgaccttagaatcacctggggagagtttagaacttgtacatttctggaccccattagatgcatgaggttgggctcttgggagtcagatggagaatctgtgagctcagagggatccccaggtgatttcaatcattagccctgttttgagaactgctagcctaatccatttctctggacagcatcctatccacaccattacagaccttttttttttttttttttttttccatacagatggccatgaaatcacatctcagcacatgcctttgactctggattgcacatgtattcattagctgaagcccaattttaaaatccaatcaactctatgattccttgaaatgactgcaaatcaagtcacatccagtgctcctcaggtttatttttgttcattattattctactgagtgctcaggacattctactgctcctgagttggtgagctagaggcataaatagcttttggatccctcgggtgtcgagatggttaaaaggataaatggtgataagtgaataaaagggtgaacattggcaagtgaacaaacaaaaatttgataaggctctactctaagccacatgcagtgtgaggcccttgacggcctcccccaccaaccctcccagtatctttatgggggtgtctcaaaccccgttttacacatgggaaaagcggagtgataatcccaggccacaaagctcagggacagagccagcaatcaagcctgggccttctgggtttaccataccacgtaattcccccactcgctcccatcctaaatctgatcctgagttttcttcattttatcatccataaagagcattctaaattctcttgtgctctgccctggggtccagcttgggctcatcaaggtccgcttacttctccagagatccccataatctatttggaggagtagcacagttctactctgatttggcatgttttagaggaatcaaaggtagggccattcatttttgaattatacataggtttcccttcatctctagaatgtaattaggcaaaagggcttgaggaataccaaatgccaagccaagagcattaagaagctgccaaaggaagcgggtattagcaacctctgttatgtgccatgtgggccagagctgttcttagcttctcggcaggagggagaggctgtggttccaggaatcaggagagagagggaggcaagcaggaaggtctttgcctcttccctgcagattttgtagtggagcagctggcatttctcggtgattcacagatgggcctgcctttgatggccttaccacctttcttattaattttctgataggtagtctctggaccaagaccagggtgacccacccgtagcactactaccatttgggaccagattattttgtgctgcgggggcctgtcccatggcttgtaggatgtttagcagcatccatgacctctacccactcagtaccagtagaacctccccacctcccacaagttagggacaaccaaaaatgtccctatacattgccaaatgtcctcttggcaacagggacagaattgtaccaggtttagaattgctggcctagaactatagtagaaacatgaagggaaaaagagatctcctgcaggggtagggatactgggttggaaatggacccccaagcttcaacctccccaccttccctcagcctgcagaggtggcaccaaaaagtggtatatgaagtatgtgagacttaacccagcgatctcttaaagggtaaatacccacttgccccattcacccttttcccatgctgccatcccacccacctgttcttggtacatggtgctggtgctgtggcagtagacactcttgatagcttgggctggtggttaagagcatagattctggagccaaggctacaataagttcacgttccagctctgcaactgagtagcaagttccctgttctttgcatgcctcagtttctgcatctttaaagtagtaataataacagcatctctcttttgggggtgtttgtgaggcttgaatatttgtaaacatttagaagagtacctggcactgtgtatacacagtaagcactgtgtataaaagtgtattgtaaataaaacataaatagtattgtgaagaagttctgttaaatacagccactcaacaaatgtttattggttgtcgaacaaggccccacccctaccctcctggaactcagagtttggttatgggccaacagtaacttgggcggggttctgagccatgattctgtgtggcctgcaaggggatcacagagtttactccctccctctctgcactaagggctgctgtagaagcagagcccactgccctggccatgctcttctatgtagtctcaaagtcaagttctccatatcccagtgggcaggccatctggccttagctccccaatgcagtgcctcttactcatcataagtcaaatgctgctttactctgcatcaactgaacattccatgtgacaatgactcaactctctatatcttcagctgtagccaaaataaatggaatctatgcattagtttgttttcacattgctataaagaactactcgagactgggtaatttataaaggaaagagatttcattgactcacagttccacatgactggggaggtctcaggaaacttacaattatggtggaaggcaagggggaagcaaggcacatcttacatggcaggaaagagagagcatgaggggggaagtgtcacaattttaaaccatcagatcttgtgagaactcactcactatcacggaaaccagccccgtgacccaagcacttcccaccaggtccctcccttgacatgtggggattacaattctaaatgagatttgggtggggacacagagccaaaccatatcaattcactattcaatatttggtagcacctctgtaatgaatttgaggtatatcagtctttggacacactagttgggaacattgtcctccctccttcactctcttgctccctccctcccttccttcctccctccaaataaatattcattgagcattgtctatgaaccaggtattattctgggtgctgggtgaggtctctgctcctagagacccaacattccaggttaagtagaagagacagactataaacagaaaacaaaggaaaaaaaaagatagcttgcaaatgtgataggtgctgaaggaaagacacaccgagactgatatgagagaggaaaactgggatggaggtggtgactgttccaaatggtcatagaaccttctctatctaagaaggctgttctgatttgagacttagctgagaaggaaccagttgtgagaagggcattccaagccaaggaaatggccagtacaaaggccctgaggcaggaaagagtttggtaccttcttggaatgggttaaagtggggccagatcagatagggctttgtagggcttggcttttattttaaagtacaatgagatgccttggagagttttatgcagacaaataaaactatttgatttatgttttaaaagaaggagggaatagtcactgtgtcaaacactgctgagatgagtaagatgagggccaagagaatctctcagtggatctggccacatggaggtcaacgtgacctctgtggagaagtagagggcagctgttctctttgccttttggttttagaacatatggtttcaccaaggaataggcacttgtatttgaagggatcaataattcaataacatttcttaatactgctttggtcagttttcagggaattacttggttttattctttcttcagtaagacttactgtaatggtcacaatgatgtttgtagtggtgatgtcatccttggtatctaagacatcactacctgcccaccatcaacccccttgatgatttcccagtgtgggacagtaccagcccagccacacatgcacagcccctggaactctgtgacattcatgacccatgttcattgcagaatggctggctgaggccaagggctgcctgtgactcaggagaactatctaggccctttataaatgggccaggcagggcacagagggttgacctcagccttctcagtgccatgttctcatggttgtcccctatgtggcttttcacttccaaagtccatccagccccttaaccttgcctgaacttttaagcccaagaatggcagaaaatccctcagaataaatccttaaagaggcatttgacagagcatatagaaacttacacttggtaaaaagtgaccatagaaaaaatctgtttagcacaagcttaaatattactgtgctttttatgcggtctcccgcagcattttggaaccgggccatttttcctgagtgatcgtttcctttgatttttttccccccactgctttgattttgtaacacaagaataatattttttctggaccaaatttcttataagtggtcttgcccagggaatgatgattctattttctcttaagtaccaagaagtacatacacatacaagcacatttaatagcttcagatgggatggtttgactgtcaaaggcatatttgcaaaattctgttcctgttgattccagcccctgattcaaagccccaccattataatgctgttgcagacacagtggagaaagcccttcatcacctgcacggtagatgcaggctgttcttcctctcttgaggagcaagccctgagtcttgatgaatggattccctctaatgtgtaatgccttcaagatggactcaaaggtaaatccatcccatttgcagaaagggaaggttcctaacttccccaagttaataaccatctgcagtgttggacaaggcttcaaattgctgacacctttgttcataccagctggcaagattgggtcacataattaaccacacaggggcacattttgcagttaactcatcctaggggggctgctctgctcaaaatcagacattggactctgccttactgtgattttttttaaaggcctaactgactggctggcaggactttcctgtcagctttctcctacctagaagagtctctttcatgcttaggccactgaattctggagtctgcactgagttcttaactgaaagtctgtgcaaatcccaaatcctaatgaaagaaaaaggtatggtccttgtctgagggtgcccctctctcgcctccccgtggaaatgggattgcaagagcaccattgccctagagtgtctactcttcacttctatagcccttggatctccctttaatcagcgctgcaggcacttgggagaaaatccagctagggcctgcatttccttgaggtgattccaaaaagtagattttctaggtcagtggatatgaatgattttaaattgccctctagaaagtttttaaccaatttacttccttatttgcagacatttgctatgcagctgtattcgtttgtttcttcgttcgttcattcattcgtttatctatttattcatctattcattcacttattgattcagcaccaagactgtataccaggcactgtggacctgtaaacaaatattaattgattcctgccctgggtggggcttggtgggttttctctttgtctctttgaagagaattgagattgtgtctgggcctcctgaagactggccaggataagctatccatttacgtagtggtgaacggggatccagacttgggaggagggttgctcacccctggctgcacatcagaaccacctggggagctctaaacaaatcctgatgcccaggcccaaccatggatgattttgatttcactggccttgggtgtggcctgggaatctgggtcgttcaaacgagatttggtgggttcagggtggtatggctgtagacttatctgggtctttcaaagctacctgatcaaagtctcttgtgcagctagagttgattgtccctctccaccctttatcctagagagtctagcctgatgaaaatcctgcatcaggtccccaccacctctgctcttgaccttacacttgtcactttagacttgatgatagttactgttccaccgcacatcttgcctactgtgggccatgggaggccagcaccatgccaggcttatgtttgaatagactgaccattgccatggaaaagctgctgagaagaaaaaccatccctcttttcatcttatgtattgtttatttatagtttcaaatataatcctcgccttatttatttaggattccacagtgaagctcatttggctccctatcttttgttataataacaatagctaacccctactgagtatttaccatgtgccaggaactgtttcaagcatcttgcacatgtgaactcacctacccttcttaacaaccctgcggcatatacactgtcatcactcccattttacagatgaggaaactgaggcatagagaggctaaaggagtttgtcagtgttcacacagccagtcagtggctgagttgggcatctacatctcatttcatttaagtgaggcctcttctttacaagtcggaaggacttctcttggatttattatgcctttgcattgtattttctttctcaaaacagaacttcaggggacgagtgagtgtacacctatgagatctatcagcatccctatgctctcacagtggcagagtggcttaggacagagagcttaggaagagaatcattcaacagcttgagtcactttcgttgcatccattggaccaagttgtcttgatcttgtggagacataagtaactaaaagtagacggttcttacctgtgccaagggcaggcaggaccctctgcagttagcactctcacatctgcatacttttagaattgtcctcataagaaaaaggagagactgagaaaagcctagccatgattcagaaacagcctgaattcatctgtctttgaaagtacctagaacttctcctctgctcattcttctgggagaaatcagaggctctcggaagtcagtaattgtgatctcttgagtcataatttctgcagttgtatcagagcctaatgtggggatgcaagatggaaacagcacatggggctgttgccatagacgaggcagagagtggaggggctgaaatctcctggaaggaagggattagctgcccaaagaagaaaacagatttgagaaatccatttaccctgaaggtttaatagggaatgcaggtcagacttactcaaatgtctttagtcacgggtctctctcctgtttttatcttgtacccagctcagagtttcaaaagagagggggtaagtgaacctttaaaccccgacgttaatatttacatccacaatattaggaataagaattcttgtcatctattgaactgaaggaatggtattaaaataaatgtaaaattattaatcgtatatttctcagctattaagacaaactcttgcttgtgcttgtatgatcataacacccaactcagatttctaagaatgtcactagcatgtgtttggtttttctctaaagaattaatattgcctatgataagaaaataatttggaaatattcacatggatttttgacatggccctaaggaattagccattaaagaatttcagaatcctaattagtcttcaaataatcttttgcatggtaaagatcttctgcttggaagaacactatttcaatatactgtttgtcacttcattacctgaaagctgcttggaggcattttgtggaatgaaaatcatttgagggcccagagggtcaacacaaaggtgcacagagccttgaattctaaccgtaaccctgcccctacctagatgcgtggcctaggccaagtcaccttttctgagcctttgtttccccagctacaaaatgagttgtactagtctttgtaaaaatggaaattagaaagccatatgtcatctatcccctgcctttctttcctaccactctgaaatttgttagctcctctcctccccttctccaacctctctctctcgcggtctctctctctctctcttacacacacacacaaacacacacacacacctccttagagtgctggaatgtcattttgccatgatgccatggtgtctcctttcctttttcagatctttgctcaacaagaggccttccctgatcaccctcttcaaagcaggcccttccccacaccctgctccctgtcactctcagtccacttactctgattgactttcttcttagtgcctagcaccatcagaaagtataagaagacaacatggtgctggcacaggggtggacagagggactgatgaaatagactggaaagtccagcgacagacctacatgttgttgagtcgggggacagttcacacgtttattttattattttaaattggataatattaaaaagaaacaatttttagaataaaaccaaaaaagtggaccatgtatagaacattgtcatgatccaaggataatgattatgcaaattcggtacacttcggatccaaaaattaaaaagaaaaaaagaatgctaatttaaggttgggcacagtggctcacgcctatagtcccagctacttgggaggctaaggtgggaggatttcttgagcctaggagttggaggctacagtgagctatgattgccccactgccctccagcctgggtgacagagtcagaccctgtctctaaatgtctctatttttttttttttttacaaaagaatgctgatttggctggagaggattccttcttcagctgagaggttggcatagacaatctgcaaagacccttggagcccaaatatgattctgtgttcagcattcactaggcttcaggcagtttctactttgccagtagtaggtgtcattttccccattttgcaggcaaggaaactgcagctcagagaggccgagtcactttcccaaggccacacagttcttaagaggtcagaaccaggatatgtgtgcaggcttgactcacaagctcattcctgtgccatagagcacaagcttctgctggctatttgaaggtgtatgggtgtgactttggccagcctcttactagggaaatagaatattcctctccagcatgcaaaataggaggcctttgcctttaaggaacttctgactttccacttcagtcggagcttttatgggtgccgcatcccagagacccacagaggaggtctcagtagcagcactttgaagtctctcccacagggccccctcagttgagcacaattgttgtccaaagaccaacacattttggctcttgcttgccttaatactccctctccgttcccaaatacaaaaacattggcatttcttggaaagtggttttggctcaaagcctgctatctatcccacactctcaagccagcttcctcagggcccctgttgctttatttcattgagtgtttgtgtttgggggctgatgttgctgcctcctttgtaaggggcctcctggcaggtgcccagagaagtgtcctcaccagctaaccaacagtcttcactgcagctcccctctccacactgggctcagtagtggtgaaaacccacaatgcacacatgcagaaccactgagggtttttctcctttctgtggttattcaatagtatttttaatatctcttttcttgaatcaagggataattaacctaaattcataagtggtcagatggatacattttgtacacacctttgtaaccacctgaaagaggctataaaacagtcttgtcaccccagaaaaggcccttcaggctcctttccaattcattccctctcctccctccctggagcaaccactttctgatttctagcattgtaagtatttttgcctgtttttcgactttgcgtcaatgaaatcttacagcatgtgcacttttgtatctggcttccttccttcaacatggtggttttgagatgcaattgtgccattacctgtagcagcagtgcattgctttttattgctgagtagtattccacagtttgggtgtggcatttacctgttgaccaacatttaggttgcttccattttgtggttctcatgaataggactgcaatgaacatctgagtacaagtcttttatgaatataggttttcatttcttttgggagaatacccaggagtggaatggctgacaacagggcaggtagttactgaacttttctagaaggtgtgagacagttctccaaagtggtggtgccattgaccagtggtggacaatcgtttcacttgcaccatagcctcaccaacttttggtgtttctagtcttttaaatgtttagctgttgtaatggatgagatatggttgcttagttgttttttaaggacattttaaagaattttccagcatgtcagtcaatgccagctcagacactgaaaaggtcccataggagggaaaccaggtgttaaatgtttagggacaggaggtttctactaatcatccctgtccctaaagcagagtctttccagccctgagggctgtctgtgggctgcctcagggcaagctcaaggccgaagccctagagcggggaactagggaaggggaaggaggccagcaagagagtcagagtggagaagaggagggcccctgcgcagggaacactctgaatcacactgtgatagccacaggacaagtctcagggcaaatggtgtggcacgccacacagacactgatcgtctaacgtgtaagcagccggcaggcacagaacagcccgtgagcctgctcagggagtcccagccggcttgtcctctcagctgctctgaccattcaaggcagatatgacaacatttccgaggcagaattttgttaccgtctatttggcataggcaactggaaatcctccaaaatccagttgccaggcatggaaccagttaggtggcaagcatcagaaccattgggagccatccctggaagtgccagctatgggctttcctggattctccaaccatgtcctcacaagcgtgaagcctgcctctaaaatatttcagccaatccgtatatcttgaaattgagtattatgaattttaccctttttaaaaatagccatcatgctaaagagcaagccatcaatttcaccacttaaaaaaaaaacacacatttctagcattcctggtgctcttgagtattgatggagatgaagagataactggaactccagtagcagcctcaggatgggagcttccagattagaacttgagcttcccctccatggggtgtgcacttgctagcagaatggtggctaactgggttaggggttcacctaagtcagacagaaaatgtcccactgtaggtgccagtgtattttaagttacagacaccatagccctgagtcatgtacctctggagccagagagcttaggcctagggagaattttatcaaccttggtttagggggtgggaggctgggttcaagtcagctctgacgtttattgcagggcttgaggtgggtctggggttcttgatctataaaataggggcaatctctgcttacctcctcaggtggttgtgaaggttacagaagatacttggatgggccctttgcacacaagagcccccatggtgtcagtttggtcactccaagatggcaaggacccagtgtgtttagaaccagcatttgggagaagaacccagtgcaggaggaggatgcttttgaatgggcagtctttgcctagaaaatcaattatatagggcaccaagggagaaagctggccctaggttcttgagccatagatgctaactctcctaaaggactatctacagggacctttcctatagaaaatccagtgtggggagaaggtagaaatccaggcctccctgctctgcaaaccagcaaaccatcaaagggtacaaggagataagggggttgcagtcctagcagattcctctggcgagaagccaggtgtgccaacttcccaggtatgtttgcctgtgttgtgccagggacctgctgcttctccctcccacaacccccaccttctcacatgggtgagggccacctgagcagctgtggggctccagggagtgaagctgctgaaaaccctgccttttcctgctccctggaggcagctcccttatccctgccagctctgtgaatgccaatgaaacagactctttcagtggatatttatgcagttacagagcaaagaatggtcctgaccccatgtaaatacactgattcaagtcaggaagagcagccaagggtgttcagtgaatttactgcagaaaagctagcacgtggaagcttggaattgggctgtgagtacttgggctgcttctaaggttctggtttgaaagccactggtatgaaagccagtgggttctggggtgctctgagcttggtggaagtaaaagagtgggagctcccaacaagcagagagaagcctgcctgcccccagcactgtgcacagggtgggtcccaggaagctctgcattacttaaggtaatgctagctttgcttactgacacattgcaagagtaccgtggctcaaacacaatagaagttgatttctcactcacttaaagccccaaatggtttttcctgatggcaggcggcccttccccctgcaagccgtgattcaggcatgcaggcccttccatcctgtggctccactatcttcaacagggagcttctaaaaggtccttttgcatcaagctgaggggaaggggaaaagggttggagcatcacatgtggaaggaagctttgtaggatccaggcctggaagtggtgcccctcactttcaactcacgttccctttgctagaactcaggcacatggccacacccaactgcaagggaggctggaaaatgtagtccaggaagaagatgagatgggtttggtgaacagctggccagtcagccacagatgaaatatttctgggaagcacgggaatgaacccctgcctgggatgcaagctggaccagaggcatgggaagtgagaattgagctccaaaaagaaaagggagcacctatttcaagctgtgtccttcatgggccaatattcgctagctgcagtggtaatggtggagagggaagtccaagcagggctgggccaagacagcaaagctaggcagacctgcctgaggtgcagatgcaggctgagaaatcctaggttctggtcagagaccgaagacatctctacttcttccttcctgcctttctctactcccacctgctctctgcacgcaaccaggaacctttgctcctttgctgtctctcttccatctcctccagaagtgccttccctgcagtgaacgttgtgcatgttctggaaagctctgaccctccctcccatcaaaacaaccattcccggggattcacagctcagttcctgggggtggggagttggcgggatgggaagcaacaatccaacaaacccagtcacaccaaggtggtaccagtctgctggggatgcttagaaactgagatgagaaaataaatgtgaaatacctagtggggagcatggtaaatgcttagtaaatggtttattatcaacttgtcagtgtgcgtgtgagagggagtaagtgggggtggggggaagagagagagagagagagaaagaaaaagaatgaaagaaagaaagaaagaacaagaaagaggaggaggaggaggaggaggagctagcaaagccctgcaaattaaacggttttatcttttcctcccaacctaatggctcactagtgaattgatggcttcctgctcgtcagggcctgagagaacatcaagattgtgtcggttgagttgtcagtcctttagggcacaaggttaattgatgggtgattctgaacaccctttaaaagagctactaggttggtgcaaaattaattgcagtttttaccattgaaaggaatggcaaaaaccgcaattacttttgcatgaacctaatagataacccctctaatgtttgaagcactcttgactctccgctaagcctcaccagccctgggcttcaggcacctaacctactagcctgccccagacacacctgtcctcttctgcctttccttctgtcctgcacttttggaaaaccctcctccattccaccatctcctgcgccaaaatcctactcatgtggcaaggtccagttcacaggtcagctgcaacaataaagatttgatgactggaattcagagggaaaaaaatacctgaggtggaacaggtgaggagggagaatcctgatttaaggatcccccttgactattagagggacaacaggtggcttcactcctacttggccactctgtgtgtgtgtgtgtgtgtgtgtgtgtgtgtgtgtgtgtgcacgtgtgcacatgtatgtgtgcaaacacatgcattctggaactcttcccccaataaaataggaaataatacctataatcgttattgctaactagccagatgttatacagccgatctttttccttcccccaccccaacttcgtattgtttatgctatattagctccaaccatgatacttgctttaggacacatacagtgagtttttagggacttcaaaagcctcaccaaccctaagattctgcggaggatgttgttctgcttttgacaaaacagaattccagaaagaagcttccctgtctaaaagatgagtactcttcaccctctctttcctgcattgtctgtacttctcgggtcgaggttattattattattattattattattattaggcagcatgcagctgatgaagtgaagtagtgtttatttattgatttttggtccccgagttggaacacaagatcaccagaaaagaaactccctctgtgactcatcccaggaacatcttgcattccagccagcacaaatatgattcaaagaactttctggagggccccagttatattttagcaaaggaacacattagctatgctgaccatctcttgaacgttttgcttttggaaagatagtcatctctggccccctcgtgtgtcttgttttttttataagatcttgagtcacaccccttttgagctgattcccctgtagtgtgagcattgttattataaaggagtgtcttcttcacaggggttacagaaggtaccaccaactggggaaacatttggtcatggtggcctaaattaatgacatttcgatattcacataagcattgagactttccaggccatggctggtgtagcagacatttgtcggtgtcctgccatttcctgcccagactggcctcttatacaccaaatgctacttactgcaaacatccatgatgctccctaaaggtgtgagtttttggtttttggtttttgtctcaggagcacactagatctgcatgctgggctagctggaagtgccaaggaatgactacatcctccaggagcagcccttggccagtgatggatgggggcgggtgaataaacagcccaacttcctagcctctcggttgagatgactctgaggtctccccagtggaattgagcttcagttgcccacagtggtaacttgtttgataaattggcttccttgctttccctgtctcaccacttcactcctctactggtgttgtctgggatcttctcccaaataaattactttcagttaatccttgcctcagggtctgtttgtgggggagcccaagctaagacaactagctagttgagttcaccaaaacccaacagcctcctctcttcactccccttgccctgttcatcaccatcgttagtaatgattcaaagcacataataggtgatggtcatgaagttgccattgtggctgtagcgctgcagtagggtgttgtgcatgggagtgcagtcctttgagagccctaacttctgcatggaaacctggtaagacagaaaccagcgtttcaggaggtagccagttcagtaacagggccctggacaactttggatgctgctaaaatctctgcaccagggaggcacgtactcaggaggttcatgttgggtgagcaataagtgtttgctgattgtgtctgtaaaggaatgaataattgactcacattcatgtccttccttagttctgagtgcttaagggtcaaggtcacgcccctgccccctttatttgatctcaggtgccttccaatgggccccgcaaacttaatcatagttgtcggttcttatctctatggagagatttcaagacagctaggaaggttcctccccatgaccagtatctgaaatgactcaattatagtttcatttctttgtccatagctttattactggctggattatctttattataccaataaaggaacataatacttcagccttatcagtcatgcacctcattgagaatgagtttatcagcttctttctggaaaacccaattttgatgggagaaatctaataattctgactatccaaggagagattggaggagctggcgggtaggcaaaaataaatattagacacagaaagaaggtacatttagatttttttcctgggactgataactcagccaagccacaaggggatgtgcttgatgattttagaggcataggagaagttctgcccaaatttggagcaccttccctaagtacttgcagtactcagacttgtaaacaatgctatattttattttttttaccatgtcctcactgtgctaagaagttccagtcctgtctctccctccaccctgctgtcctgcaaccaagctattgtaggttacagcatccccttgtggccagctaagtaactctcattcagtgttttcctcacagctttcctcagtttctctgtgttctttcactcttctgttatagctaaccaatctttcctttggacctacatgaacttttgaatcttctctccttcgactcttgcctagttacctcaaaaaggctctttgctttctctctccctcttatccttaccctcatcctctccgcttccacttcttccatgtttttgtgagtgagaaaatgagcttcatcgccactgaaaagtaggagaggagagctacttaagctctcgtgcaaaggagaaggaaaactgaaggatatgaagtgaaattatgtgcggtcaatcagcagtaacttccgaacccttgaaagtgctcatgagtccatattcaagatacaaaaggttctggccaccttttctttctcccccaggctttcagtctgaatgagaaacagatttgtgtatttatttgtcttcccactatatttaatttctaacattgggagagcattgttttctgttttcacttcaaatgctcatttcagctatgttgggtgttaggtgggtttttgtgggctggcctggaaaccttcccgtcaggtgtaacaccaagcttatggtaagtgccttcttagttcctagtagctgatttttacatgaatctttgaacaaacagggttgcgaatgaataaagccattcaggtgcaaagggagcatgggtgatactactcaagatgctcacaagaaatatggccggtggatctgatgatgccaatgatgccaatggcacaatgatgatgatggcactgacaatgagaatgatggtgaagatgaagactgtatcgacagtgctgacaacaataatgctaatgacattgatgatggtaccagtgatgatgatgacaatacaataattgccatgatttactgagcactttctgtgtgtcaggcactgtgccaagtacttcacttagcttatctcctttaatcattacaaccacccaatgtgacaggtttttttttttaatcattttacacagagagaaactgaggctgagaacttacttgccccaggtcacacagctagcaaaattaggcagagctgaagtttgaacctaggcctgtctaagttcaaagcttatactcctaaccactctcatagggggcccagggcccagggtgaggctgacactgtctccatgccaaagggtggcaagggattcacatgcattagaagaaggggaaaatctgaactccagttctttgtacttcagaaatctgcaccccttccttccagtgacccctcagagggtctatttctggcacactggtctctggaaaatgtcctgctaatgacacaggattataaacagtctttttcccagaacaaaaatttaacctttgtatctcaatctaattagaagtattttctcttccagaggcaggttttttcctcctctttgttccaaatttaagaggtttctttgttgccagaaaaatgtccaaaaaccgtagctctttaagatgatagaccttggcccaagaccttaaacgtgacctgagctcctgcatgagatggctgttccagcagcagcacctgagggtgcttggggttctgggtgtccaaccgaactgtagggcattggcccaatgcagggatgggcacttgctgactctcacagtcccctgtccaggtgagtgttccctaccaccaccagcagctctttatgattttcttctgtgatgctgaggtttgccaagacctgaggaaggcagttcattcctgttagtatcaggagcagccatctctagaaaatatacatttgttcctttccttagagagatccttgcatgaatatcaccccttccagctgtctagggactggcattcttaccttagagacttactcctttacctctgcaggaaatgtgagccttaaaggagccctgttaaaagcagataatcctgggataatatggatttggttaatatcttcagaatggagccaagagagatggcaacctgcctacaaagaaagtggtatcaggttggaggaataagagatgcatgcctggcacacagtaggtgcccacatcatttttgaaagaatgaataaaaatgaatggccacaaatctagttccatactgtagccctgcagtcaggcccgtgtgggcccccaaacccatcatagatcctttgcgggcaggctgaaggtagtaggggcttggaaaaccaggcctgggagctggtggcgtcctccctccaattcctccttggtgctcccacttgcccatcctttggggcccacagcaattcctcctccggcagctcctgggaggctaggtttgactcctccccagcaggcaccactggctccaaggaggcctgagtgagagtagggcagtcccccatgttacaaaagaggaaactgagtcccagatgtataaaacaacattccaacagtcatgaaaagttcatgtgtgtcctgaatctcttcatttcaatgacttatcttttggatatcactgagtcaaggcatgggggtgttctttttttgagcaagctcctcacctgtcaaactttttgacattttgttggttgaataaagccatcccacatactttggcgttagatgctggttccaatagagatgttctaatcttgggtgactgactgtgctgactctatagctcgtgtgttaaactcaagtgctcctcaacatcctttgaaatgtgaaacagaggcaacaggtggggtaatgtgcctttaaggaaggagaacgggtctgggagtcagtgtactctatgctgtgtgaacttgagcaagtcacttctcctctgagcctcaggttcctgttcttcaaaacaagaggggtggggccgggcacggtggctcatgcctgtaatcccagcactttgggaagtcgaggtgggaggattacttgaggccaggagttcaagaccagcctgggtaccatagtgagattccagtctcaacaaaaataaaagtaaaaatcaggtgggcattgtggcacacacctgtagtcccagctacttaggaggctgaggcaggagggttgcttgagtcttggaggttgagggtgcagtaagtaatgattgcacactgtactccagcctgggcaacagagtgagactctccccccaaaaacacaaaaaaacccagaaggggtaggttgggccagtaacactaagacttgttaaggcaggggcaccctggaagtctccctgggccctgagagcttcatttctcctgctgagttgtaacgttttcattctcacactcctattagaaaaaaaaaattttgagcactccccttaacacacacacacatgcacacacatatataattagatttatatgccttcctatatttattacatacactataaaataaaaaacaggaattaaaaagattagatgataaaacaaacataaataagttttatgatacctcagggcatgaccttacctcctctcactgggaagaccttgggccctcctgctgtttatggccagtttctgacgcttggctccacttctcctatttttcacaaatatcagatcagagataatatttgtactctgtcctccctaacagatcttccccgtagccactgtccgtcctcatgaagtttagtcccagttgcaatgtttgtggtcactactgttttcataaatgaattagcgtgtcagggaactcatctgtaaagctaatctgggcattcatattcccttcagagggctgtgtagacctctggatgtaaaaggcagtcgaccataaggcaggtgactattttgtgtattcctcatattttaaccaatttgagactacattcatgtggtaattatgttcacagctttggtaaaaaggacctgtactgatgtttaaagcttagaaaatttaaccactggggcaagtaattgacaattattataccctatggggagaggaaaaccagttgttacccagttggaattacttcttagatatttagtgcatctcaagtcccgaatggtaaaaccatgtacatgtagaattaaatgatgaaaattatgcttttcttacttggctcatagagagtggctggtgatttttatgcagaattaggttagtcattgaaggtttggtttaagtactgaatggaaagcacaaaatagactcagaatagggcattgatggaaggggcaagattcttagcagaggtctctgggaagtcagccttgcaagagggagagccatctcacgtcttcctgggggtgagggcacatggggagacactgcgggggccgggggggaagaggagggagtttggtgtgttgatagcctcagtcttttctgggaagtaagaaggaagatgggcgattgagaaggtcagcagaccagcagtcgtgtgctctggcctttagattaagggtccgcaacctcactgtacattagaatcacctgctgcatcctagaataattaaatcagagtcttaggggtaggacctaggcatggttttttttttaagttccagattactccaatgaatagcaaaatctgagaaccagtggtagaccagcacttctcagactttaatgtgcatacacatctcctggggccctgtttggaaggcagattctgattcagtgggtctgggctgtggcctgagatttgtatttctagcaagatcctgggtgctgctgctgctgctgctccaaggaccccactttgagcaacaagggcatccaggggtattcaatcttttggcttccctgggccacattggaagaagaattgtcttggaccacacataaaatacactaatgatagctgatgagataaaaaaaagaattgcaaaaaaaatctcataatgttttaagaaagtttacaaatttgtgtgggccgcattcaaagccgtctgggccgcatgcgacccttgggccgccagttggacaagcttgggtagacagtcctactttgactagaaataattgatagccgtctccatgctccatagaaaccaaagctgttgatattttacaattggaaaacccatatcttgagaaaattttcagcatatgttttaagatgtgattgttgtaggggaagaaacttaccttgatagatggcttaatttaaaaagcaaaatacttgacctctaatttaggctattctccaagtcctaaaatccacctatttgttggttgcgggcatctaacactgacccatcagagcctcccgtggctggtgaaggtgagtggctgccatgttctcccaccatggcacctgcgggtctgaccctctgctcttcccgaaacaagagcctggtgacctctgtaagaagtggccttgtgtaagttttagtcagcctttttgagttgcagcttactcatcaataaaaagagtcggcaagagacttgagatgtcagctttaatgtccctgcccaccttgacactccatgagtgtataaatggtgtgcctgcgacaagagggtgaggatgagaacaccaggctcaggaaggcttaggcgttcatttgtgcaccaattcatccagaagatatttcctcagcacctactagtgccagatatgaggtgggagactatcccctgctcctggagaaagaagtaaataagaaatcccagtatgggctgggcagagtcaggactagacaaagtcaagttggggtcctttgggagcccagtgagggtgggggatgatctcagaagaagcaactttagagctgaaccccttaagtcagacagatgagcaggagttggctgggtgaaggctgaggtgggagagagctccaggctaatggtcagaccctagggagaccggcctctggtataattagatctttgcaataattagatgaggggttcagataacagttctgtgaccccatgatatggtttggctttgtatccccacccaaatctcacggcaaattgtaatctccagtgttagaggtaggggcctagtgggaggtgattggaccataggacttcccccttgctgttcttacgatagagttctcaacaaaatctgcttgtttaaaagtgtgtggcacctccccccacctcttgccggccacgtgaagatgtgcttccttccccttcaccttctgccatgattgtaagtttcctgatccccagaagcagaagcctgtatggcccacagaaccgtgagccaattaaacctcttttcttaataataaattacccagtctcaggtatgtctttataggagtgtgagaacagattaatacaccccaaaagtctgcaagcagagctagtctcccagtccctccctacctcctcatctgtcctgggccctgagtcttttccccactgtctccatacagggggcacatgggctacatgggggtgaggccctagcaactggctgcaaaccaagatggtgaggtctccagggtctccagcaacttgcagatccaggttgcctgcttcctacccagccacactgccactgtttactgacctccactcccacacccctggggataatggggacaggtggaatggatgggtgccctcatttaaacccatttgaaaatgttttgcaaaacgcaaacgaaatgttccctgtcacctctgaagaaattcatgccccctgggcttgagcatcaaccggctcctttgatgctccttgatttgaagaggtcccccacccaccctaggcccaagctaatcagcagcttgtctgagtggggagatgggcctccaccttctctccagtcactatctggctacttggcttgtcctcagggacacagactcaccctttgaacccacaattcatgagatagttttgtattcttagggcatcgccgaggcttccagtattagcccctgcagcagcaacacccactatgctcccactggatgcacccagaccacctcagctgctgactcagagtcagagtggggtgcttgctggcaggttgaacagcaagaggaggagatgtagtgagaaagaccgaacgaggctttctgggaggtgggagggtgcatgatgaaggccaagttcatgttcctttgcctgggtgtcccaaggccagcgccatacttggtggggactaggtggaggcaggcaagcctgtctcagggccagcagctctctagagaaaagcccagggctactctcaggcctgctttggctgagtagtcaggcagatctggagctgtcctgttgaaggaggtggaagtgaggtttgggccaggggtttttcccctttgccctgagatcctgcatactgctcccctctacccacaccttggcctgtcctctgtccttcatcccactgggcctcagcgtttttcccagagacttgagtcacagcaggggatgcaagggcctctctgtagctcattggtgctgagatgccctccaacccatgtgacatctgtctctggaaggcaggctggggacaggtgagtaaccagaagtaggctgagaggatggaggcccctcaagccctccagtaacagaaccatagccacttcgggctgcagtccccaaggacaggaggaactccggtgaccagagggacagacgaggccccttgtgggggaaaaaagaacaacagttcaatgactttactgggaaggacctggcctccactttgaagaaatgtgatgctctcatactgtttcctgcatgcctctgcaggcacatgcactcggtgttgaaggagaggctgtggggactgcttttcccaggaaacaaaatgcatggaggggcgtggccttcacagctctcccagtcgaagggaagcctgggaagcccagcctttatgtacctttaggctagttatttaatctccctgtggaatcagtttttccaccaacaaaatgggcataattgtaagacccctctggctgggttgttctcaacagagggcctggcaaatggtagatgctcaatgagttgtagctcttgccatccatgggaggaacaggggcctgagggaggccgcctgccctggcaaagtcctcttttcactttctgagcaggactgttctgggaatgttagcaggcctagaccaaagccaggcagggaagggactgaggtttcacaggaaatgatgagaactggtacctaagctgaaggtgtgtgcaaggagcaggtggaggaggcatccagaagtttgtcttctttcctttgggaggggattgagagaagcagacagggagggagagaagctgccatttctgcgagggtggagagatgcagctgttatgagaaagctgtctcacagctggataatcctaaccccacaggaagaccaaatgtggcacagaacatgtcttgacttctgtagctgcccttgtcctcaccagtcctactgcagcttcccttcagccttttcttacccttccccaagggttctggccactgtgagggacaaggatctggccttaggttctcagggccttcatggggctttgtgcaagtggccaacaaatatttgtcctgctgatgtggatgcctctcctggcataacgttgatgcgtttgcatgctagcagatctctgatcaaagacgtgttgcctccactagagtataatgtccatgaaaacaagaacctcgtctgtttcactcaggatgagtgaatgaatgaattcatacatgcatgcatgaatgaatggtgtattagaggccaggtgcagtggctcacacttgtaatcccagcacttgggaagccgaagtgggaggatcacttgaggccaggagttcaagatgatcccggacaacatggtgaaaccccatctctactaaaaatacaaaaattagctgggcatggtggtgtgcacctgtagtcccagctactcgggaggctgaggcagaagaatcacttgaatccaggaggcagaggttgcagtgagccaagattgcgccactgcgctccagcctgggctgcagagcaggactccctctcacaaaaaaaaaaagaaagaagaaaaaagaaaaaaaaaaaaaggcatgttggaggcatggcatcttctgggctgaatcaggattcactcctaaagaaccagacccttcagctagggcaagccccctcagcctccctggggccaggctgcctcccaactctgtcccaagggggttactggccagcatgctgggtcacctcatggcttccagagggagacacgctctggatcctgccaaaggtgtggcccaccagtcattctccacaaagttgtttgcacagcatcctttccctccccccttctcctcctgcctcagagaaactccttgttctgtgcatgtgacacattctgattgcctggaaataccacagagttgttcatttgttaaagctgccttactgtagtgagacatcatttgcttatttcttttcttttcttttcttttttttttaaaggagtctcactctgtcacccaggctggagtgcagtgatgcgatctcggctcactgcaacctccgcctcctgagttcaagccattctcctgcctcagcctcccgagtagagtagctgggactacaggcgtgcgacatcatgcccagctaatttttgtatttttagtagagatgggatttcatcatgttggccaggctggtctcgaactcctgacctcaaatgatctgcccacctcagcctcccaaagtgctgagattacaggcatgagccactgcacccagcctcgtttgtttatttctagccccatggtgtgctgggccgcctctctttctttggaggttgtgttggtaatttcggggtgaggagaggaggacgagctgaccacaggactaaagtctaggcagttgggatagatgaggtaaaaaatctcagttgcccaaggcctgcccagtgaaactgaggattattgaattattattgagcccaaccagactccaaggctgctcagatccctgagttagacatggtgcctgccttctccatggtaacgaggccaaatatggacaggtttccatggagagccctatcgcatctgcagccctgcttccaccaggaagcacacgcgctaggtgcctttggcctctcaggaggtggccagaggtctgtgggaggtgccgaggacattgagaaagtgtgcctgacctatgaggattttcgtttccaacaagtgttccatctccccagccctaggctcaccaatgccctcttcctcttggcagctagatattaggagaggccacagatcagatagatgagctgattggggaagtgacagtggacccaatgaccattcatgcaagtcatcatcgatcttcaccttgccctggggaacggattttgctgttactgggagaaatgggaatgtcattggtcagagggagacagagagacaactgtaatgacccttgtgcttatcaaacctcttttggaagaatgattgctacagagtatttaaaatgccattttccatagtcatagcatattcacatgtgacaaggcattatttttttccttaaaggaaagtaagtcttcactgcttatttgaatttgaacaagtcaaatttctacatatcttaactgtctgacatagcaacttggactgaaacttcgtttttgttgaaggccaaacatataagctgagaattaggcttaaaaaatgcctggtttaacctcacttggctatttactgattacatcatctgcatttatagcttaatcatctgttaaattggggttctccacgcacacaggatcatgtggttgtgtttgtatatattaggagatatctataacctgaacatatacatagagagatgggttatgctccctggttaactaaaacgtggaaactttctaaagatgtgagagagctcttaaggcaattataaatagtcttttaaggaagattcatattgtatgttctgtgttgcaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 38535 - DNA, 112620 bp, Homo sapiens
gggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaaggtaaagagtcctggccccgggcgtgcggtatcgcacccccgggccgccctccgtgcttgcacatcgcatccttccccacccccctcattccggggatgcgcattgctctcccccgaaaacgtttccggcttgggcatgcgtgtttgtgcccccagccttttccatccatgcatcctgcatcccactacccccactgtagcgcccactcctctgattcctggcccagcagcttgacctccggtcctcctctcaagcgtgcaagtcacacccccggaatccgtagatgtgcatctgtgccccgtgccccactcctggatgcataaatgcatgagaggcttcctcacctgtatagcataaaaatacgtgcttccctgcataaacacggcccttgacatgcatcaaatgtatcagcaacgatggcagtttctatacgtttagcactgtacggttttcaaggcattgatgtctcatctatggtctcctttgatcctcagagtgtttatagggtagatggtatcatcctccccattttatagatgaggaaaccgaggtgcaaagagctgaaatcacgcccaaggtcatggacatataatgttgtaagtgggtggagaatgtaactcctaatgatacctgttatttgtatcgcattaacagctttcctatccattatcttatttaatcttacagcaatcctgtgaggtattatctgcattttgcaattgagactctagattggttaagtaacttgcccaaggtcatacttggagctggtattccagtttagttctttccacttcacaactctgcgtaaaagagtatcttgttataaatcccagtcacttctcagaacctctttccaagaaccgttagctcttcattacttttccttccaggaattttacatgctcacttcaaaagatagcctaccacacctttatcctttggtttagaagactgctttataggaatgactggcgactcccttctgtgaaaacacacccaacaccaagtcacaacctagctgttaatgtttttctttcttttgcccccgtacatcgtctccccttcagtgtttgctttgtgtccaccactgcatccatccactttgtattactgacaattggtgtcttatttttgaatcttttccacccggggcagaaatggcatactggtggctgaattcccgtttaatcttcccaacaaccctgggaggagagtgatggtattccccaattcacaaatgataaaatttagaatgataatgtggtcccaagtccacacagccactgagagatagagctgagatttgaatttacgttgtccaactccaagtccagcgagcgctctttctgccgtactgtgttgctttccttgggaagattcataggttctatctattcatatcttagctccttcactttctgatacactttattgttgaacatgtctgcctaatttaggaataactcattcaatgcatagttgtacatattgtggagattatgatttaacccgatttattactgctttccagaaaagatataaggcagcttcaaactgattttcagaagcaagaaatgcaaagagaacttggccatttgttgaatcaactaatgtttatttagcacttactatatgccagatacccagcaataaataggaatttgtttctgtaggggaggaaggaggaaaaaccttcaactggatataatcacgttctttaatatttctccttccctttatggctaaactaattagactccagatttgcttcctccaatttatctcttctcattggtctccctccagattggtatctacttaccactcctggccaggtgctgtcagagcttaaatcctgaacatctccagctccccttttgtattgggaatgtttttaaggttgttttgcatggtgtgtcttgcttaaggtggtatctgaagtgtttcaaaagattcccaaacccttgtaattttgggatcaagcctgagagtgctctgactagatgtgaactgggtcagttagctctttcagaagaaagcgctcccttcttttttggagacagggtctgtatctgtcacccaggctggagtgcactggtgcaatcacggctcactgcagcctccatctcctcccccccaccgaccctcccaagtagctgagactacaggtgcgtgcaacagcactgggctaactttttaaattcattttttgtagagatggggtctcactgtgttgcccaggctgctctcaaactgctgggctcaagcagtcctctcaccttggcctcccaaagtactgcgattataggtgtaaggtactgtgcctggcgagaaagctctcatatttaatactgactgtagtagggccagtatagtagggctgattataatacaaagaaaatggctgaacatcatattgcagtgaggttttgcccctcaaagggagagattttgagagcagatgaataggaagtgaatgtatgatcatagtggttcaggcagtaagaatggggaggtggaattaaattgcccagctctatggtatatggaatttagaaccctgaaaaaaaatagttgggtaccatatacttcagtttccttatctggaaaaatggatttgagaaatgtttggattatgaggtgattatagggcattgaggagtccaacagagagaaatgaatgctgtagagagagagagaccggttcgttatttgggagagtagtggagaggttctttatgctaccttatacctctaataaagctagtccttgaaaggaggcagtcaagtgtagtagaaaggtggtgggatttgacatcagataaacttggttcaaatcccaactctgccatttattagctttatgactatggataaattatattaagcctgtgagtctcagttgccttacctgtaaaatagggataatatcaccattctcttaaattattgtgaggattacattaaatgaaatataatgccaacactgggcacaatgcacctaggaagcactcagtaagttacagttataatgaccagggtacctaagaggtgtggccggagcacaggttctgtagccagcctggctatgatcctcaacttaatggcttgtgtgaccctaaacgagttacttaactttgctgtggcttagtttcctcatctgccaaatggagataataatagtaactatatcatagatttgttgtcaggattaaatgagttacatgtgtaaagcacacagaacagtgcctgccactgaggaggcaccccataactgttagctttgaacaaaaaaattaaacgtggcatgagttgggatagcacgatattaaaatttgggaatatgctccattcttccccttctttttctaatgggtagcaaaattgtaccttgtaccgcttttagagatacctgtcgggctccgggaaacatctaatttctactgtgttatatagattctcatttccaagccttcttgcttcattcactgacctttgttatcttggagagaggaaatatgtatctatcccagaaagaatgaaacttgtctgtttgtcaagggcatgacacagcataggtctcagcataggcaagtttttttgtttgtttgtttgtttaatgggaggagcagttgtttttctctcctctcaatgcacctgttaacatttattgagtgcctgctatgtactatgtattatcccaagcattttcacatttcgtatgtcatcttatattaattcctcttatattaatcctcttatattaaaacttatgagggagatggaagtattctatatacaggctcaaggtcacatagctaagaaatggcagacctggtcttcagattccatatccagggatctttttgcagggctatgttgcctttaccctgtctcttctgtgtttttgagcacagaaaaagtttctttttcaggagtggtatactacggttattcctcaatatccaaaggggattgcttccaggatctcctgtggataccagaatctgtggataccaaaatcttctaatgctttagtccctgatagaaaacaccatagtatttgcatataatctgggcacaccctccatttttttgagatggagttttgctcttgttgccccaggctggagtgcaatggcgcgatctcggcttatcataacctctgcctcctgggttcgaatgattctcctgcttcagcctcctgagaagctgggattacaggcatgcatcaccatgcgcggctaattttgtatctttagtagagacggggtttcaccatgttggtcaggctggtctcgaatttccgacctcaggtgatctgcccgcctcggcctcccaaagtgctgggattataggcgtgagccactgagcctggctgggcatatcctcctatatacattttttttttttttttgagacagagtctcattctgccgcccaggctggagtgcagtggcttgatgtcgcctaactgcagcctccgcctcccaggttcaagcgattctcctgcctcagcttcctgagtagctgggactacagatgtgtgccaccatgcctggctaatttttgtatttttagtggagacaggatttcaccatgttggccgggctggtcatgaactcctgacctcaagtgatccactcacctgggcctcccaaagtgctctgattacaggcatgagccactatgcctggcctctcctatatactttaatctctagattacttataatacgtaatacaatgtgaatggtatacaaatagttgtactgtattatttagggaataatgccaagaagaaaaaaaaaagcctgcacttgttcaacacagacacacacaaaaaaaaatttttttttttttttttcagatattttcaagccattgttggttgaatccacagatacagaatcctttggctactgttgggtcctaatcacctcaactttagttatagaatgaactgttaatttggggaattatgtatcattccagtctagactgttcaagctcttgctcccccacgggggcctgttctttttttttttttttttttttgtgtgtgtgtgtgtgtgtagagttgggggtctcaccatgttgcctaggctggtcttgaacttctgggcctcagcctcccaaagtgctgagattacaggcatgaggcacagtgcccagccctcaggacttctctaataacacatttagtagagagattagttgccatcattatcatgattatcaacaacaaactgtgactaagggccctgaggtatggagtagtatcatgattctttacatcgcaggctatttatgttagaggagcctcaaagataatagggcccaaccccctcgtttaatagatgactcatcaactatgatgataaccagagacgtggcttggtggccctgcaggccacctggacatatgactaccccatacatagcaaattccagcagcattccagttttgaagtatggcaagtttttggccaaatgaaaggtatttaagatacagacagataggtaggtctctagtagtagtcctcttaggagaagaaaacaagactgctggcagtgaggtcttcattcatgtgctagaagaacctgattcatagaaacctgatattgggacagttctataaatatagcctctacatttgaatagagtatgtaaatatccaggaccatgtaagaggactttttgttttctactttggaagttgggctctgactctttgatttcactctgtgggttcttgcagagaagcatgtttagtgggctgttcctttgttatactttgttcttatgtccagattatgttatataatttgtttctaatttttagttgtagaagcaatctgtgttcatgaaacagcacaacatacaccacgcaattaggtttattcccttgtagtagtgctgtttgagtgtatctttagaaatctatgaaattattcctagctctctaataggtcaatatttggccagatgccacaccataggttattcaacaataacagtagtggccattgaacactactgtgtgcaaggtgccatgcttataaaaaataaggaaaatttgataggtagtaaagttgaataacttgaccaagtttacacttttagtaaacagtaagactggactcaaactcaaggttgtctgactcctgatcctgagctttttagagcttattcatggagtatgaaacctgtagtgagagtcctcataatagtctggtgtgtcactgagctgttagcttgcttgatctctaaattgaacaatggtttaactctttttttttaaatggggttttatcgtgttgccctggctggtctcaaactcctggtctcaagccatctgtccacctcagccccccaaagtgttaggattacaggtgtgagccaccatgcccggccaatttaactctttatatttgattttttgctcctgtttctctggaaattaaacatgtaaagaaggtgagatggctgactgttggctaacagttctagaaatacatgtacagctggaaatgcttgttctctctttccccatttcagccttagaaaggggagagaataaagataggggtactgaataagttaagtatgatctaagttggataaaagaacccaggtttatagaagccaacatctattggatccaaacactcttagaggtttgagcttctgaatagattggcgcattccagattcaatttgtagtgcctcacagaccattatattttctaattaagagcaacagaataattagaccttggtactattctgaattcccaccttaaaagattaattctacagaggaactgtttaaaagacacttataacttactgagtgtctttccaaaagacaatttatttttctttccccttaccattaatgccaaaaaaaagtttagaagaaacgttatattaacaagtaggtacatttattccagataatttatggaattagcattttacatataatggcaaaaaaataggctttcttggtttcttagtgcgattattttcatttgtattgaacctttaggggctttagtttacaactttaacctgatatctggcacttttaagtctaatgttaattttcactaaacctcaggtctatacatttctaagtatagccctcagatttacaatctttctttcctctcctccttctttctttttcttgttctttattatctatttaaaaaaaatttttattatgaaaacaatataccaacaatgagtcttctttttaaaaaattgctacataatattttgtcaggtgaatatattatgtataatagaatactgtcacatgcataacattccgtcagtctcctgttggttattccagttctcgctttttttcttccactatgttggatgacactgcagtgatacacatataattattctctccttctagatcagtaggataaattcctaggagtaggagttctgggtcaaagaatatgaatatttttatgtcttctaatatgtgttgttgccaaatcactttctcttttaaggtttatgtcagtttatactgccaccaggagtatcatgcctggattattgatgtccattcctcacagggcattatgtccttagtcttgctttcctttaatctggcctgtgagctaccgcccaaaatgttctaccagaatgctggtctcacacctccgtcgtagtcttcccctggttgcctgtcacctatttgccaattcaggtgtaaattttaaaatccatgcccttaccacctgagttcattccttttaattgttttgcatctatattcgaggcagcctccctccctcaaatggccactctctcctacctctgagtcttccctctgatcatttcttacattcagaacttcttttctgccaacatttctctatcttctttaatttaaaaaattgctgcttctacaaagatgtcaacacagaaccacctgtgatgatgatatctttagtactcagtgtacttcactcctggtgggttgccagtaaatatttgtcagtgtggctaatgagagaaagaaaaaagaaaaagtggagagatttttggtggagatttttgttttttaatagaaaggcttagaattcttaagagtacttggttctcctgaataaaacttcagaggagaatgaggaattctgtgctctatttttggggtaccattgttctttctgtgatcatgggcaagccaacttattctgtcttctattcccctctacttcagctacagagtagaaaatatagtattgccaatcattgcagaagagtcatgacactctctgcctttccagttattttttcctcataatcattggcatcatcatcattatatccctaatatttactgagtattgctacttgccagcactgagattgtgctttatatacatgccttagcttttttttaactgtcacagtctctctatgaactaggtacaccctgttttcagatgagaaactcagttccagagagtttacttgcttaaggtcacagctagtaggtggtggagccaccatgatttaaactcttattcttattgaattacttttctgaaatatcaaaccatcaagtcttccctatccacagttctctgatgatttcttattgcatatgaaaaagaaagtataaactcagcagcatcggaaggcccttccaaatcactgtccagtctacttttccattctcttcttcctccatgccccaccccaaacgtatgtcctgtgttccagtctcacaaagttgcttatttcacaaatatatcatatagtttcacacattcgagcctttgtttttgttcctggaatgcattccatttgcctctggcaaactcctgtttatccctcacgatccaacacaaatgctctgtattctgtgaaagccattccggattttcctgggcagttagtggcttggtttgctgtgctcctttgtatatatatctgctgtagtcttttcacactgctttataactatttgtttacatgcctgtctcccttactttaataagaatattgagatacgggaaggcaacattttttacagggacattattttagatgctattaaacgtagccaaaattaaaaaatacatgtatttaaaatgacattgtttcccttttttccccctcagcatagggctactttcaaatttgaatcaacagatgaagataaaagaaaggtaagccttggtgttgctctgtgaatgtttatgtgtgtgtgtattgcattcatggactttctaagcagtggtcatgttttcatctgatggttattgattggtttcttgtttcccttcattttgttttttaggaaccctgagaagaaaggttaggttaggtttagtttgggttacacgtaactctttcctcctttgtcctcgcaggactattaacacttgtataaatcaggggagtgggagggattcagaggagtctcttcccagatctactcactcccaaagactgactgtttagtggcaagactccaggttgcccaaaatccattgctaatattacaaaacttagcttgaggcaaggtctcgctctatcacccaggttggagtgcagtggctcactgtaaccccagactcctgggctcaggcagtcctcctgcctcagcctcccagtagctagagctacaggcacacaccagcatgcccattttaaaatttttttgtagagacagggtctcatcatgttgcccatgctggtctattgagcttctggccttaagtgatccctcctgccttaacctcccaaagtgctgggattacaggtgtgagctaccatgcctggccctgcctttgtgtcttgctgtactccgtacatctatccctggctatacaaatgccagaaccaaacaagagagtatgactgaatcagtgtaaatctatcactgctgctagaaaaatagcttaaatccagtattttgctagtagtgggttgacagtgccttgaaatcattcctccattcacctgtatccccatacctaatatcagtgtcttgctcattttacgttttcagatttcttccatccattttctccttaacctctgctctaattcaggcctacatctgattactgcatcagtttcctgactgttctttcattttccagttacatgcttttctagtagattggcatccataaatccaaaataacaatctgaccatgtcatccttagccttaaaacccttcatctatcccttcattgactttctttacctacagaataaacttcaagcttcttaacatgacatgctgggtgctcagtgatctgtcatatgcctactttcgcagcttatttcttttctctcccttgtattttgtgttttagaaatagaaaatgtttccagttatgcacacatccacatcccttctgtttcttgcttactacttttgcaatatattgttttctacctagagtgctctctccctcttgtacacctcttctttttctcacctggtgaatccctactcacctcaggggcacctccttcagcaagcctcctctgacattccagttaaggtgaagtacctcttcaatattctcataatactctatataaatctctaaattaatatttatgccttgtttcttaattatatatctgttgatgttagacactggtatctttatacacttgacatttggagtgcccagcacataataggcactcaaaaagtatttattggatgagtgaccatggaatataaattttgtagattaaaggtttaactctgactttcttttggatttgaacaatgtaaccaagactagaatacctttttagaacagggattctcaactagggatatgctctttggagagctttttcaaaatagccctgctcaggcccaacctcttatctaccgagtgagaatttgggaggtgagctccagacatgtgtattctatgtctctctctctctctctctctctctctctgtgtgtgtgtgtgtgtgtgtgtgtgtgtgtgtgtataaagtatataaattatttagaaacagaatcttgtttcgttgcccatgctggagtgcagtggcatgattatagtcccctgtaacactcctgggcttaagtgatcctcccgccctaggctccttagtagctaggaatacaggtatgtgccaccatgcccagccaatttttaaattttttgtagagacgggctctcactctgttgctcaggctggcctcaagggatcttcccactttgacctcctacagccctaggatcacaggtgtgagccaccacatttggcccaaggtgtattttttttttttttttttttttttttgagacggagtcttgctgtttcgcccaggctggagtgcagtggcgccatctcagctcactgcaagctccgcctcccaggttcatgccattctcctgcctcagcctcccaagtagctgggactacaggcgcccgcaaccacgcccagctaatttttagtatttttagtagagatggggtttcaccgtgttagccaggatggtctcaatctcctgagctcgtgatctgcccatctcggcctcccaaagtgttgggattacaggcgtgagccaccgcacctggccccaatgtgtatttttatagatggtcttcaggaaataaatactcatatatctgatgggagtgcaaaatggcacaatccctatggggaagaaactggcagtgtctaccaaaattacagatacgttttactctttcaccaagaagtgtctcttttagaaatctattctgcagatagattgaaccccaagtaagcaaagttattcactgaaacattgtacataatagcaaaagattggaaacaagtgtccagcatttaaggagtgtttgaagaaactatggctcatttacattatggaatattatgatgtagtagaaagagatttgctgtatgtgctaatgagagagtgaaaaaaaaaaagcaaggtgttaaaaagaacatgttgtttgacaaactcatgataagtattcaggctaggaagccagctgctatttatttaatttcattggaagatccatactatatccatagattcatggtgccttagaaatctgacattagagtctttggtagtgcttttactggtaaatacaagcatattaagacagagtctcctaccccatataaatttcaggtgaaagggagaaatttctttcacagttattaataaaatgtgtttatttccaatagggtagtagaaaaaaactaacattttcaaagtactgtctttttctgagttttagatttctgaagagagtaactactctgtagtgcttattaccagttacagtgtgtaggtttctgcttcctgggaggtctgttataaacaaatgtcattagggacctagccaggtaatcttcattaatgggaaaacatcaacaaacaaattcatttctgtgaagtctccaggggttaaaaccatttgtgactctttcatgcctaaggctctttttagacttagacatcagaactattggacagctcagaaggatctataccttaataagcttttcaagttcttaatggagagacatatagaatataggcatttctgtaccttaagcctactcagaaaataaaaggaagtcacattactgcccaattcgtttgctccctatattcgttttcacactgctgataaagacatacctgagactgggaagaaaaagaggtttaattggacttagaattgcacgtggctggggaggcctcagaatcatggtgggaggtgaaaggccctgcttgcatggtggtggcaagagagaaaaatgaggaagatgcaaaagtggaaacccccgataagcccatcagatcctgtgagacttattcactaccacgagaacagtatgggggaaactgccccatgattcaaattatctcccaccatgctcctcccacagtgcgtgggaattacgggagtacaattcaagatgaggtttgggtgaggacacagagccaaaccatatcattctgcctctggcccctccaaatctcatgttctcacatttcaaaaccaattatgcctttccaacagtcccccaaagtcttaactcatttcagcgttaacccaaaagtccacagtccaaagtctcatctgagacaaggcaagtcccttccgcctatgagcctgtaaaatcaaaagcaagctagttacttcctagatacagtgggggtacaggcattgggtaaatacagccattccaaatgggagaaattgaccaaaacaaaggggttacagggcccatgcaagtctgaaatccagcagggcagtaaaattttaaagctccaaaatgatctcctttgacttcatgtctcacatctaggtcacggtgattcaagaggtaggttcccatagtcttgggcagctccacgcctgtggctttgcagggtatagctccacacctggctgttttcacaggctggtgttcagtgtctgcggctcttccaggtgcagggtgcaagctgtcagtgatctaccattctggggtttggaggatggtggccctcttctcacagctctactaggcggtgccccagtagggactccgtgtgggggctctgaagccacatttcccttctgcactgccctagcagaggttctccatgagggccccgcccctgcagcaaacttttgcctgggcatccaggcctttctgtacatcttctgaaatataggtggaggttcccaaacctcaattcttgacttctgtgcacccacaggctcaacaccacatggaagctgccaaggtctagggcttgtaccccctgaaaccatgggctgagctgtcccttgggcccttttagcaatggctggagcatctgggactcagggcaccaagtccctaggctgcacacagccagggacactgggcccggcccattaaaccatttttccctcctaggcttccgggtctgtaatgggaggggctgcattaagacctatgacatgccctggagacattttccccattttcttggggattaacatttggctcctcattagtttcacaatttctgcaaccagcttgaatttctcctcagaaaatgggtttttcttttctactgcattgtcaagctgcaaagtttctgaatttttatgctgtgtttcccttttaaagtggaatgcttttaacagcacccaagtcacctcttgaatgtgttgctgcttagaaatttctcctgccagatatcctaaatcatctctctcaagttcaaagttccacagatctctagggcaggggcaaaatgccaccagtccctttgctaaaacatgacaagagtcacctttgctccacttgcaacaagtttcctcatctccatctgagaccacctcatcctggaccttattgttcttatcactatcagcatttttgtcaaagccattcaacaagtctctaggaggttccaaactttcccacattgtcctgtcttctgagccctccaaactgttccaacctctgcctgatacctagttccaaagttgcttccatattttcgggtatcttttcagcaacaccccactctactggtaccaacttaacatactagtccattttcacacggctaataaagacatacccgagactgggaagaaaaagcagtttaattggacttaaaattccacatggctggggaggcctcaaaattatggtgggaggcgaaaggtacttcttacatggtggtggcaagagagaatgagataaacccatcagctttcatgagactaattcattaccacgagaacagtatgggggaaaccgcccccatgattcaaattatctctcagcaggtgcctcccacaacatacgggaattatgggagcacaattcaagatgagatttgggtggggacacagccaaaccatatcactcccctcgttctctttcctaaatgtgtttttggagctctatgccagcaactacttagtaacagcgggacattttttggtaaactacattgctatctctttgaaaaacactaacccctcttatatgaaaaatctttgtgacaacttagaagtaagtgtaagggaacagtgcccttcaaaaaaaaaaaaacttgattatactgtgctttttaggagataattataaattaatgatctttagacctaattcctgacacttatatagtgttttgcagttttacaaagatttgcttcttaccggtagtgctgtaagtatggtaagaatatcaccattcctatcttatgaataaggaaactgaggctcatatgaatgacagcttgctaacactcacaccactagttagtggttcagcctcacatagacagcagattatctattatgtgcagctccttcactgctcactgctcaatagctccctcttattaccattgaggtatatttcagaaggcttgaaattatcatccagtaccttgttttctctcattttataccttgagaaaccatttaggtaactagatttaagttggaagatagcaaaggaaattagcaactagaagtgcttacatttttctagagaagtaaagtcagatacaacggctaatgtttgtgcatataatgcaaatagttccaggtgcatgtggatcattgtatacttagataaaagcacctgtgtttattgaagcatttgctttatattctgtacctaaattggtaggctgtgattatctaccagcacataaacaaatatgtcatgcaaatatgtaggattggtggggaggatataatgaataatctgaaaattcacatgttgaggaaatgaaagctcttaaacaaaaagctttaaaacaaaactgacctcaaaaccaataaagagtactaattgcaataagttttggaagagacatatcataaaatgattaaaagatttccagctctttcacatataagaatacagccttatcaaatgtggaaaatttcagttgtctgagataaatctttgtgtatatagtaattttcctcaaaagagtaaagttaaaagtagccaaatatcaagcatattttattaccttcaaattcacacagcccatatttctgtgaagccgtaaggtaattgtcaagttgagattgcaagctctttgaggacaagaactctagcttactttatattttcagcaaaataggcacctataataaatgcttgttaactgaatgaaaagaacttggtgagtgagtggaggccagaattcctgtgacttgtacatattgtttggttttgtgttctatattattttagctataaagtagaatcccaagcacagctcatgttgttcactgaaaaagcaggatacagtgcaaaagtatgcatacagtatgatcacagccacgtaaaactgataaaaaccatacaaagaaaaaatggtgacaaggagataaatggcagccacctgtatagttattactgtggatatttttcttttctgttttttaaactgttcttttatattacaatagattataatgatataagcataggttcattatataattataacgttacaatatactgttacaatagtgtgattggagttataagcgaaggactaatatttcttttttcaaatcatgtattttctctaaaattggccttcttgattacgtattccttttgggagagcataaaaaactcttactcagtttggggcagtattatcggcagagccagtttatggagtgaaatatatataaacacaaaagttcattctgccatttcaaatacttttttctttttttcccccagacacaaatgtatttagcatattagagatctctgtaatccacaaatgttttctcagtaaatcctgtattcctggccttgtgttaggccttggctcctaagttggctttttgtccatggtgtttggtttggcactttctcaattatagatgcatgctgaggcttgccattgtggactatagaaaatgaatgggtaaatttctatattagattcccccaaggaatatgtgccaaaatagaatcattaatcctagactgtgaatccatgctttggaatagcttgaggaatggatgcttgttctaaaagccctttgtccttattttggtcatttggaattgtcacactccagtttttactaaaataaaataagctttgtatgctttgcaaatttgactcaaaatttatttggtgtctttgcttgagggaatgttttgttacatagtgcaagtacagttctcacttagaaaccagtaattttcaacatcttcatctctttaaaataattgcacacaataccaaaagtacatctaaaccttttactttttaaagttcctgtccagctggaatctgacacaagacttgacttaggtctgggttgtatcatagggcaggatgaatgcttcacggtaggtcaaaaaaacaatttaaacttcattccaaattccacttttagttttagatgttttccatggcactggaggagtaaatctagaaagcaaggacaggacagccctgacttagtaagccacaggtatggcagtctatacatgatcgttggatcactttttaagatttctgtctgggataataagaatactatctctgatttgtactttagagtttcaggtgcattttctcatatagagatttcatcaagaagttccgcttccagccatgacagtgtgaagatctctacagatctgctccctaatggaactggtaaaaattatttttaagaacaaccatttaaagtctggaaatagtcccaaaggcatacagtcaatgaagaaacacctattcaaaaaaatctaaaagtaagaaaagtgggccggatgctgtgtctcactcttgtaatcccagctacttgggtggcttgaggagagaggattgcttgagtctaggaatctgacactgtggtgagctatgatcacgccactgcactccagcatgggtgacagagtgagaccctatctctaaggaaaaaaagcaaggaaagtgaaagtctgtgttatttgaaccaagacctgttctccctctcttctcttggctaagtgagatagaactcttctccaaactggtgcagggaagaatatacggttccctttccctctagtcccagttggagtgctgtcttcacaggagtgatggaatgtcagcatttctcatcctgcccccagctacctgttgctgaaactaaattctggataagtgtagctgagaggtgggtcttacctccttccattctgcccttcctcatgggatagcagctgtaccttggatgtgacactgctgagaataccggggccacagtcatcctggtggcggaacatggttccaccccaggaaaagcaaaccaaggagatcaagggttgctgtacctttacttcagttgagctgtcagccctaaagtgagggtgtcacacagaagcataccattgtctctgcccccagcatcagcaccagggctcagaaattttgtccaggggaagaagcaagccttataaaagagagtgctgaatgtctcctcaaaggaactgacttcatttgcacagaatatggagaagttcatgcctaagggtgcaggttgtgatgaaaggcacttggggtgacattaacacagtcattggagatataggttaacccaaaggccagctactttgctaggaggaatgggataactgagctagattgctagagtgaaaggaggaaagtggtagctgggaggaactatcccttcaaaagattggatctgtttgtggagcaatttttgccccaggacatttttgaagacagtagatcagtcaaccagcaattagtgtcacataagagctgtgtgtgatcaggaaaagagaaagtcagaggggtctgccaaagccactgtcatcccagtgcaactgtggacatacccaatggtgtgccctataaggtgcaacattagggcttcacactttgaggaagcagagagagaatagactgctaagataatttagccagtcactaaacaaataaacaaatacaatagcaactcctggagaaggtgggtggaagggagtgcaaatacctagagttgttacaagatgtccagtttccatgggcggggtgggggtgggggagggaagcaggcaccaaaaactgcctgtatgaccagatgttggatttaacaaagacttcagagtagccattataaatatattcagagaactaaaggaaaccatgattaaagaagtaacagatgtaatgaagtcacataaaatggagaaatcaatacagagatagaagttatttttaaaaagagcccaatagacattctggagttgaataaagtacaataactgaaataaaaattcactgaaggggctcaacagtagatttgaactggcagaagaaagaataagcaaacctgaagacacagcaatagagaatattcaaggcaaagaacagaagaaagaataaagaaaaacgaagagagccttagagaattgtggaataacatttacataccagcctacacataatgggaataccagaaggagaggagagagaaagaaaggagaagaaaaatatatttgaagaaataatggtttaaacttcccaaatttattggaaacctacatatccaggaagttcagtgaacccaaagagatgcataaatacatcatagtaaaaatgctaaaagccaaagacgaggagaaaatcttgaaaacagcaagagaaaaatgactcatcattacaagggaaggtcaataagattcacagctgacttatcagaaatgtaagtcagtgggataacatattggaagtgcttaaagaagaaacctcatctaagaatcctgtatctagtaaagctattttttaacactgcaagggagataaagacattttcagataaacaaaaaactgaaagaatttgttgctagctgactcaccttacaagacttaataaaacaagttctttagactgaaagcaagtaaccctaaacagtactttgaatccacgtgaagatataaagagtacctgtaaagctaattatgtaattgtagaagtcagtatgaatacataattctcccattttctgttaattgattttaagagcatttgtataaaacgatatgtatataatgtattgttcagtcagtaatatagagaaatgtaatacacttgccaaaaacagcacaatggtgaatgggagcaaagctgtattgaactaaggaagcaaatccagatggtaactaggatccacaagaacaaatcaagaaaaccagaaatgataaataaggctaatatatcaaaagctataaatgtatacttgttctcccagcttctttaaaagacaaaattataaagtaataattataataatgtattattggatttgtaatttttatagatgtatataacaataatactatagaaaaagggggaagggaatagtgaagtagctacgttgtctggggtaaatacccgtggttcgtcttctcacgccaagacaatttaggacatggacacacaccaggagtttaggagcggaggtctaataggcaaaagaaagaaaagaaaacagctctctctctagtgagagagaggggacttctgagaggaaaaaggagccagcagcggatgtgccagattttatagtcagatttgaggaggtgatgtctgatttacatagggctcacagactggttcgatcaggtatgatgtttacatagcgtggggagggctggccgccccaacctcatcttattatgcaaatgaactttcccattggccagcactgtcttgtctgctccttaatgtacatgtggctgacaaagagaagggaagatggagccaccatcttgaatatgattggcacaactgctggcatgtatgtctgcagctcgattttacaggctgctctttgttagaaaggaaaataatttggggctgcttttcattaaaaggaaaaccttaccgaggacttccgtaccctcactatctgcctaagtaatttcttcttaactcctgtatcaataatgttatacaggaatgtttctgtatctcactggaattagtataaatctggagctgtttctaataaggtatatatgctaagccctagaataatgactaaggacataactcatacttacactttgaaaactgtaaaacattgttaaaggaaattagagaagcttaaaataaatgaaaaaacatcccatggtcatggattagaagacttactattgctaaaatgtcagtactcctcatattgatctacagattcaacgcaataccttttagaaacccaggtggcttccttgtagaaattgacaagctagttctaaaattcatatgaatttttgacacagagtagtcaaaacaaccttgaaaggaagaacaaactcagaggattcacaattccttattttaaaatttactacagggccaagagcggtggctcacacctataatcccagcacgttaggaggccgaggtgggagggtctgttgagctcaggagttcgagaccagcctgggcaatatagtgagacccccacccccctccatctctaaaaagaaaaaagaaattgctacaaagcagtaataaccaaggcagctggtattggtgtgaggataaatgtagatattaacaaatggtgctgtgacacttaggtagccacatgtaaaagaatgcagctggattcttacctcttgctgtatacaaaaattcaactgaatcaaagacccaaatgtaagcattaaagtcataaaattcttaggagaaaacataaaggtaaatcttcatgtccctggatttgccagtggattcttagagataacaccaaaagcacaagtaataaaagaaaaaaataacatgaattggatttcatcaaagttaaaatacttttgtgctttgaaggatactatcatgaaagtaaaaagacaacccacagaatgggagaaaatatttgcagatcctatgtctgataaaagacgtgtatctagactatgtaactcttacaactcaaaggcaactcaatcttaaaatgggcaaatgatctgactagacacttttccaaagaagatatacaaatggtcagtaaagatgcttgatatcattagtcatcagagaaatgcaaatcaaaaccaccataaaatatcaattcatacccactaggatggctaaaacaaaaaagataacaagtgttgacaagaactggaagaaatcaaaatccccatacactgctggtgggaatgtagtatggtgcagcactttggaaaacagtctggtggatcctcaaaaggttgaataattaccatatgacccagcagttgtactcctgggtgtctacccaagagaagtggaaatacatatccacatgaaaacttgtacacaaatattcatggcattattcataattgccaaaagatgtaaacatgcccatcacctggtgagtggataaataaaatgtgttatatctatacaatgaaatatttgaccatacaaaggaataaactaactgatgctgctacaacatggatgaaccttgaaaacattatgttacacgaaagataccagacacttaaaaggccacagattgtatgattttattaacttaaaattttagaataggcagatctatggtgacaaagtagattcatagttgccaggggctggaggaagaggggaatcaggagttactactaatagatatcttgagcttcttctggggatgatgagaatgttctaaaattagataataagggtggttgcacaagtgtgaatatagtaaaaaccaatgaattgcatgctttaacaagttgaatcttacaatatgtgaattatatctcaagctattttaaaataaatactagtagataatgtatcctctacacccatcatcgttccaagtactgttgggtattaacatttaatcctcacaacaaagctataaagtaggtagaattttgcttattttacagatgaggaaacaaaggcacgcagagaaattactcgctgaaaataaagaagttggaggccatgattcgagcttaggcagcctggctccaagacccgtgtgctacaccgtactgccgctcattaataattggattgacctgttgtgtagtttatgaatcgattctatttatttcctgattttaggcacccgaaatgtgagatttgatggagaacataaagctttgacattaaactagttatagcgttgacagaaaacagaagatcatgcttgccagtgtaagtgactgaataaaataactagtgaagaagatagctgtgtagtactggccttataacacttaggcatatcgtagatctttttgatgcctcggattcattttttgttgtcaaaaatgtaaggtttccttttctcggtagctggcttttttcttcctttcaaattttgatcagatgctgagcaaagtgcagaaatttgtacatctttgatgtatggaaaactcatagggacctgaaagttcttggctgaccagatgtttccacgttctcaactcctctatttgtagataaaaaaactagaggttgacttacccaagatcagagttaatgagcagaaaagctggaactcaaaccaattcctctgtcttcttttctgacttcagtgatgatctttgcagggcctatcctcagatagctcacagtgtaataagggacccacagtgtcttccagtacagtatgattccttctaaggcatcctacactgagggtcatcaccctgactgaatactttcggtaatggaaagcttacagcagccactgtacttttttttttttagatagctgtaattgttagaaggctgttacttatatgaactctaaatctgctttgcttgtcctagtttacccatatttctctctgctgctgttgtccgtcatttgacttagctttccacctcttttttgccacttagtctttatcatttttttcccccacttactgcccaacacatttatcaaaaagctttctctggcaaaatttcttatagttcattccttcagtcttttagcacatagcttaaattgctgtctattgaaatttagcatttcttattcattttacatagtttcaacctccctaatattataaactacttgagtcatgttcttttatatctcactaactcaaaatagacatcttgtcactaagttagaatatatttctcttgaataatttgcatgcacttaaattttaaattgggaacattttcagatacgttcctgtatcagggtggtgtacataggtgctcagtaatggacactgtagaatctatagaattaatagaaaaactgcagtgttattttttataacatcactacttccctttctcaagtggctttgccatttcattaaaatgcaaacccttgtaaacaaaacaaaaatatttctagcaatatttttcttgtatagaatgtgcttgttaacgtttcttgatctgtttgtccatctggccatctttatgatgtaatgtgcatcaacctcctactctatgccaagcactatgctagaggtttctaatatatcatctcatttcatatttataagccctagttgttatccctatctatttagagttaaggaaatgtagctcaagtgatttcaagaaatttgcccaagattacctagccacaggggcagagcacagctagtggctgaatccaggtgctttttttacttcaactatactgtttcaattaagtcacgtaaaagatgccttatacttcataatagggtctttcatatgctgtctatgtaaataattaccataagcatgtgagatagatacatttctatcttacaaataaggaaatttagtttcagaaagatcaatttactccagatccaagttcagaaaatagaactagggattaggaagaacccacatattttgtttccgtactttttctgctatattattaatgtgttcttatgcctttgaagacctctaaaatcacacagctatctcattgagacaacttaacttccctctttcccctgttctcggctatcttagtctgcttgagctgtcaaaataccgtagactgtatggcttaaaggacagaaatttatttctcccagttctgaaggctgggaagtcaagatcaagatgctgtcaaggtagatttcctttcgaagccttttctcctagcttgtgagcagctgccatgtcactgtgtgctcacataaccacttctttgtatgcatttatacagcaagaacacaagctcttggtgtctcttataagggaagtaatcccaagagaccggggcctcaccctcatgacttcacctaaccccacttacctctgtattagtttgttcttactctgctataaagaaatacctgagactgggtaatttataaagaaaagaggtttaattggctcacagttctacaggctgtacaggaagcaaggcagcatctttccggggaagcctcaggaagcttttactcatggcagaaggcaaagctggagggagacaccttatgtggctgagcaggaggaagagagagagaagggggagatgctacacacttttaaacagccagatctcacgagaactcaggacagtaccaaggggaaaatccacccccatgacccagtcacctcccaccatgtaattctcacctccggcaccagggattgcatttcaacatgagattgaggggggacacagatccaaaccatatcactgttcgaaagccccatctccatatattaatattatcacattgtgggttagagctttaacatatgaatctgggggcatgggacacaaacatacagtccatatgttagcttaccatcagagtccctgactatctttcatacgtgcttgggctattagagctgaaaaccagggattcaaagatagaggaactagttcagagtggctaattgagtgttgtggagtagatggcattggagacaaagtaaggaaattccaaagagattgtatataggaaagaacttgattcactaaaaaggcaaagaagcaaaggggctgctataggaccaggatttatatcagccaccaagatatgaggtatatgttattgtgacagtgttcatcttgcagccttgcctagtgtactgtataatcaaactatagcttgtgctaagaactccctaaagattaaatgagtattgttctctcatttggtaaattctaatttgaaacaaatgaagataccgctgtatttgccaacatactaactttaaatactaaaatacatttcacatgggcagtggagaacagggctttctgaaaaataggcttaagtagtaaaagaagcagagttggctggtactgtgtttgaagagaaatagaaagttttgacatacccatttttgccctcaaaatggaggcttgtaagtggaagcttataaaacttttcttgtcaagaaagaaagggcagctgattggttttataagcttccatttacacctaagctctttcctgttaatgaactcttgatgatgtaatgtgtctttctcaggattgctaattagcaaaaaagtttgagccaaacttgtttaataattgtttctcagaactttattttcagtttttttgacagatcaccatgatatataacataacattgattgtgttactgaaacatgtacatgtgcaggaaaggaagttagagatgaaatttaggaagtgagatacagcctcgttcatagagacagtatccattaaataaaaagtgagaattgccattgcctcccatattacaagtaggaaaaaccctcaagtgtatataatattaatcttttacatgaactcagctgcatgagtattcattttagaagatctccatgttagctttttataaagaattccaaatttgacctctagaatcctcccagaacctttattaaaaacatattttaaaattctggcaataagtcattaactagtatttttgtgaaatacagtttttgaataggtccgtcttgtggaactgacaacattgtcccaactacagttatagtaagcttattttagaatttaatacaaccctcatcttctgcatgtacacatgtacctcttgttcccccctacatacacgtgctgtatacagagggcagaaattaaggactatcagatttaggtggctgaccttcagctccagttaagaactaaaattagatccttgtggaatatatatccagtgacgttcatcacagaagagtgtagacataaccttgagaggccagggaaacatcatccatccaagggagcctgccttaactacaaaaattcctttgacatctcattttttatcttaacattcatgtaagttatgtattgtgatttgtaatgcattcatttattttcatgtagaaatcgcctaccccaaataaatcttttagtaaaatagtggttaaagaatatgtaccaaaattaccctatgactttaagtatccctggcactgggccacatctcccagatgaatgtgcataacctattttaagattagggtctatcccgtcactataggagtatactggtagattcaagtgagtataattcaagcatgtggctaacactgtagccataatggacaaaaaagcagggaaggaggagtctattctattatctattctatttttttaaagagaaagtggcagactatagggataggtatttcactgccactacaatatgagaatttttttttttttttttttttttttttaagtagaaccatgtttaaggatttaggtctgtttatttaaggaaaacaaaaatctgttcttagaaattcccttcactggcctggtttagcccagaatttcttttaatgttaagaacactcatttttgttttagttcttgtgtatcactagataccagtaaaagagagtaggactgagtcaaataagaatttgagtccccttttctgctgtagctttctctgctaccttaagcaaatcatttagcctatctgggagtcagttttcatatctataaatcctcttgtcctgagtatgttaataggtgttattttttgaaagggttctatggtcaaagtaaggaaatatcagtttaaaaaaaatgaacagggctgggcacagtggctcaagcctgcaattccagcactttgggaggcaaaggtgaggggattgcttaattaaggcttggagtttgaaaccagcctgggcagcatagcaagaccctgtctttaaaagtaaaaaaaaatagctgaacacagttaattggacctctattcctagctacttgggagggtgaggcaggaggatcctttgagccccggagttcgaagttacagtgagctgtgatcgtgccattgctctccagcctgggtgacaagagtgatgataccctgtctcaaaaaaaaaaaaaaaaaaaaaaagcaagtttcttttccataatacatgggagaatctttggtagtttgatatgccttataagtttcccaagcttatttgcctacaaaacccatttttatagaatcttttgtactgctagtgtttgttaatggtaagtgatcattatagtgccttctaactcttaacattctgaaattggacacagtttgtttgactgtgcagctcgtttctagactgtagttatcctaggttactaacaagttgaactcaatgcttgtaatgtgtgtgtatcctgccattttttccagctggtactggaaagttattgcattttcctgtttcttgtaaataaaacaaacattactccctgtcttttgcagtttttcactttctctgtgcccctttgtttcagtgtattcaattattggcccatttttattctaaattaatctattcatctttatctgagtttcaccaactcatagtaaagatttctgaaaccctcagcccattaaatccttttgagaaacactaatgttggagagaaaactatgtcacttctacatgtggacttatttcaatcagaaaaacaagccacctttaaaatgttgctattggttaagatctttaattataggtcttgttcttagaaatgcaaaattttagctcttactgtgtaccatcatttcatttaataaaacaacattgtcatagaaggagtattatccccgttttataggtaatgaaactaaagctcagagaaacctaataacttgtccagatctcacaaataataaatagcagtcatatccaacttatattctctattataccttgtagcttcttattaaaacatatgataatactgtatgtggcatgtgtggtgtagttacaatgataagtaacatttattgactaattctagggtagcacatgcacatcatctcatttaattccctcaacaaccctatgaagtaggtacttttttttccttcctttctttctttttttttttttgagacagagtctcgctctgtcgcccaggctggagtgcaatggcgtgatctctgctcactgcagtctccgcctcctgggcccaagcgattctcctgccccagcctcatgagtggctaggattacaggcgcccactaccacgcccatctaatttttgtatttttagtagacatggggtttcaccatgttggccaggctggtctcggaacttctgacctcaagtgatccgcccgccttggcctcccaaagtgctgggcgtgagccaccatgcctaggctgaagtaggtactattataccagttttacaggtaaggaagtaaataaattggtcaggtggcagctgggaatcaaatccagagctttaataacctattaaatgtttggaaataatattctatagcacacagtgctttgaagatgtcatacttagtatgtatgtttgtaaatattcaacatatttgacagcatctttgtgcatgtggaagaagagaaatatgttaaacagaccctgcccccgccaaagctgataaaagagagaactctccataaatataattcaaggtcagaggtgttaagtgctataaaagtgctagagattaagtgttctggatttagaggtggaagggattacttcctgctgggggatggtgaaaaagatagcgtttgatttgaagggaggagtgattcaagaaggtcaggggttgggaagacgttttgaatccaggaagtaacatgagaaaaggcacagaagtttggacaggcattagagagtagattattgtgcctagatcaaggatattgtgacaataagtagttgaatgtgagttttagaaaggtgagttatgggggatcgggccccttcctggttaatgtgtttggatgtgttttatttcaggtatctactatgggacagttaaagagaaatgtctaccaggcagcaacattttctttttgctgccagctttaggaagcaagtcacctatctcagaagtaaaagataccaccaacaaccaagttatacaagttagaaatctatgaggttccttgcctcctctttcttcttcattcttgaccaatcattccaccaatcattcagtcaattctgcacccttaaaatctttcctctgctgggcgccatggctcactgctgtaatcccaacactttgggaggtgagaagatcacttgagttcaggagatcaaggctgcagtaagtcataatggcaccactgcactccagcctaggtgacagagtgagaccctgtctcaaacaacaacaacaaaaaaaaccctgtaattttcccagtttcattaccactgccttagttcagacctccatcatccctcactaggattactgcaacaaccacttaactgccctgcttctggtcctgctccccttttcttgttcattttccacattaacatcagagtaatatttccaaaatacaaatctaatgtcattatcctgcttaatactctgcagtaagttccccatttccctctggattaattccagactcttcattcttctcatataaacgtggactagtatattttctctttaaaaaagaaagaacagcctttcttgatcttacattccctcttattgccagcccatttctctgtttgtcttacagcaacatcttgaaaggtatctacttctctctctctttttcacctcccagttactcttcagaaactgtttttttgtgtttggtttttttcttttctttttgagatggagttttgctcttgttgcccaggctggagtgcaatggtgcgatctcggctcacagcaaactccacctcccgggttcaagcgactcttctgcctcagcctcccaagtaactgggattacaggcatgtgcctccatgcccggctaattgtaattttagtagagacggggtttctccacgttggccaggctggcctcgaactcccgacctcaggtgatccgcccacctcggcctcccaaagtgctgggagtacaggcatgagccactgtgcctgtccccagaaactgtttttatcaaggccatttgtgctctagcattgccaggtcttaatgctatttgatctttcatctgcatttcaaacagctgaccattccctacataaaatattttctgccatcttgtgttccagaacaccacactcctaaatttcctcttgctaatacctctttacctcctttatcagtttttcttccccacagccactgagtggtggcatctttcatggcttttagtcccccttttctctatatatttttctctaggcaatctcatttacttttgtaacttaagaatgcctttattgccggcgcaatggctcacgcctgtaatcccagcactttgggaggctgaggtgggtggatcatgaggtcaggagttggagaccagcctgaccaacctggtgaaaccccgtctctactaaaaatacaaaaattagctgggcctggtggtgcgcgcgtgtaatcccagctacttgagaggctgagacaggggaattgcttgaacccgggaggcggagattgcacgcgccaagatcatgccattgcactccatcctaggcaagagtgagcctccatctcaaaaataaataaataaataaaagaatgcccttattcatatagaaagcatagataaccctgatggctgcttagggctccagccacatacattcagcttcctatttgacatctctagttatcacaaacttaatgtgaccttacagaattttcccccaaacctgttctttcctcagtcatccccttctcaataaatggtactatgttggcttaagccagaaacttccctctcccccacaaatagtaagtcctgtcaattttccctctaaaatacacaccaaatccattcgcttgtctccctctccgctgctaccactctagttgaaactatgtttgttccagtccaacccattttgattctgtatggtacagattctgtatggtacatcaatgggataccatatttcaaagctgtattatatttaggttaaagctaagttgttttaacaaggggacctcaagatagaagtggtttacaaaatatgagtgtttattaccttttcaagtaatagttctgagataatcattcaggcagtgaatggctctgctttatgaatttattcaggggcctgtttcctttcaagtcgtcaagtcatgcttcaccttctgagcattgtcttaacctaggctggactgccactttcaggttttaggctatagaaggggataagacagtggagaagtcatacccactgtcttcaagagccagacctggaaatggcatagatcgtgtctatacactttcattctagtggcaagagctccatcatatagcagtgaagaacaactggggaatatggtgtagctaggtagccatgggccttgccacagttgttactgcatgagaaaaggacagtgagttttggtggacagctatcagtttccatcacagtgtctaacaattaaactgttagatgagcctacagtcagccctctgtatccatagattcaaccaacagaattcaaaaatatttaggggaggctgggcactgtagctcatgcctgtaatcccagcactttgggaggccaaggctggcagatcacctgaggtcaggagttcgagaccagcctggccaacatggttaaaccccatctctactaaaatacaaaaattagtggggtgtggtggcacgtgtctgtaatcccagctactcaggaggctggggcaggagaatcgcttgaacctgggaggcggaggttgcagtgagctgagatcgcaccactgtactccagcctgggcaaaagagcgagactctgtctcaaaaaaaaaaaaaaaaattaggggaaaaaacctcccaaaacaatgatataacagtaaaaaatacaaataaaaaatacagtataacaatttacatagcatttatgttgtattgggtattataagtagtctagaggtgatttaaagtatatgggaggttgtgcaaaggttatatgcaagtactataccactttatattagggacttgagcatctgtggatttcagtatctatggaggtcctggaactagccttctgaggacactgagggacaactatatttatgaaactttatgttatttatttattactctggtatctcagttttgctaccttatatggttgaagaaaacttacaaaggataagaaatgtggtctagaacagtgcttctcaaattatttgagatgaaggatcaaggtcttttcttgtttgtttttccctaatttgcagtaggccaatacttttctaaaatataataaaaattaatcactaaaagaaataatcatcaaattactatgaaagtttctaaatgcatactctttttttatgcctgtctcaccttatgtacctatctcaacatgatctagcaacaaggagctggtgaattggcactaatcaatggacaattcttctaagtagcacttgcctcaaaagtgttttctaataacctattttggattcccagagtctagtagatgaactgtggtatcaatcttttaaacaaagacattttctttatgtataaaatataaaacttttaattttttaatagttttagaaatcacctcttaagatagtatataaatcttgatagatcgtttgaatgcccacatatgcttcatagcctattttgtttcatagctaaagccaaagatgatccttgttttattgattcagagtgaaaaaaaagcctactattctggagctcaaagaaggttgtcttagagggcatttagttttaatgcacggtgtggagggaaaaaaaggcctaataaagtgacatgctcaaaatcacaataaatcggagacagctatggtatgatcataatttacagtggaaattacattggaatcagatgatccggattgagtcctgatcttttatttcttagccaagtggctccaggcaatcatttaacgttttaagaattgtgtggtgggaccgggcatggtggctcaggcctgtaatcccagcactttgggaggccgaggtgggaggatcacctgaggtcaggagtttgagaccagcctggccaacatggcgaaaccccatctctactgaaaatacaaaaattagcaggcgtggtggtgtgtgtctgtaatcccagctattcaggaggctgagacaggagaatcacttgaactccgaaggcggaggttacagtgagccgagattgtgccactgcacttcagcctgggagacagagaagactcttgtctcaaaaaaaaaaaaaaaaaaaaaaagaattgtgcagtaagtgttcagtaagcatttcttagattgagaaacataaaagttttttgtaaactgtaaagcacataagcaaaaaatattacaggttacacatcccaaatccccaaacctgaaatctccaaaatttgaaacaaaaaaaaaatttatggatacgtaataattctacatatttatggggtacatgtgatactttgacacaagtgtacacaatgtataatgatcaaatcagggtaattggggtatccatcctctcaaacttttaaaatttctttgtgttaggaacattccaattctgttcttctagttcttttgaaatatataataaattattggtaactgtaattgacctgttgggctactgaacactagatcttattccttctaatggtatttttgtacccattaaccaacccctccatatccaccacaaagccacttctactatcacttcttaggaagaaataaaacatatttattatttattatttattatttatttcttaggaaaaaataaaacataatagtagtcaccattaaagagtgcttattatgtcccagcgtctattttataacatccctgtgagatatggatgttatttccttttttttttttttgatcctcccacctcagcctcctaaagtgctaggattataggcatgagtgaccatgcccagcctcccattttttaaaaatgggaaactgaggttaagaagtgtctaaatcatacagctggtaaaaaaaaaaaaaaagaaagaaaagaaagtcacacagtggcaaacccaggtattaaactccggtctttgatttaaaagccactacaatacgttttcttcgtaaaaaagatgtcccttccgccttcagagagcttttagtagttgaggcaaactcataaaaagaaaactgacaggacggatgtgctaagcaccaaatgattgctacagatttgtggtttaggtatcccttagaaaagaagaatgttgagggctgaagtggttagggaaaattttatgttgaaagtgggttttaagcttagccttcgagaattgctaaaacttaaatagaaaaggaaaaggactgatgtgtagagggaggctgtaaaaaagcaaagaagctcaatatgagataatttggaaagaaatatagctaaagaggaaaatttgataagaatagtatgaaagaagactcagagcaggttagcagatcttaagtgccaaactgaggactttgacattttaccttataataatgtataacagataacctgtactgaacatttatcacttgccaggcactgccctatgtgtttgtacatgcacgatctcatttaattcttgcagtaaatgaggtccagagacaagtaacttgccaaggccacaattgttcagaagaagagccaagatttgcatacaaacaatttaaattcagaacttctactcttaattaccacactgatttggttttagagtctatggtgggttgaacaaatttcaagcccaggatcactgaccttaaacaagtaatatgcctcacacctttggcagtttttaacattttagttaagaaacgtaatgtgacaatagaaactgacatctcattcctgtccctgccacccttacacatctttagcacatggcagtgaaggagaagtcaaggtaatgtgctaatggttttcaagtctgcctgcttttctgtgttcgtctggtcaggtattctcagttaacccttgaccctaacgtccgaattatgtcactctgttgttaatcatagttcagtgattctcacattgtggattctggaccagcagtagcatcaactaggaatttgttaaaagtcccatttctggaccctcatcccagacctactgagtcagaaactctagggatgaggtgcaacagtctgttttttaaaagtcctttaggtgattatgatgcatgatgaagtttgagaaccacctttagagtccactctaggatttcagttcgggagcaaactactaaaaagtttttggcaatccttgatgggtagatgtagtggcagggcataccatgctgaaggaacagtggaggaaagactcaggatgtatcatggtcagggtctgggggtcaatttggaacacctgaagaagaaactgtgtgtgtttgcattgtgtgtatcagacaacagtaggaaaggggaaattgggcccatttcagcagcattctgtgggcagcaggaaggtatgaaaggtgtttgaggagagcagagcatgttttaggaagagtaaaatcaacttaaatagttatagcacagaaaagtactgacagggcaaaataaaggggaaatacaagagcacctttgaaacatggaagcagtacacaaactcaacagatagaagagctacaaagaatgctgccttttcaaccacttttatttgtttctaataatattctttaaatagaaattattgtattgagtaaaacattaaatatgtctattaaacatcacttttattttttacgtgtttttggttctaaaaattgtaatttaaaaagagtcgttgtccaaaaagtggtattaattttcaagagatatggcaaaaagctgtgcaacagtcaccgtgtgaggtaggtctgtagtgagaaatggtatgttcaagaacaactatgattaaaaactgtgcaaaaaaatcttgtctttgcttgctggatgatcttctacaagcttttagatgaagcagtttttaactataaattttgtaggcacctttaatctctttcatgtcccagagtttctcagtccatttggtttttgtatagccctggctattccaatttgtcttcaggctctgctctttttctttcttgagtctgaagttattaggaagaaaggtaccatattgcctatagtttgtttttttttttttaattttattgtcgctgttgtttttggtttagaatggaagaaagatatttgtgtgcttttagatatgtagaactccaagttcacatatataatattttataataccttattacatgtttctcaacttaaggaggatggtagatatttccttcttgaataaaattgtgtggaaacaaaggtgatctgactccacccccaggaatataccacatgtgaagcagtatgtagaatgtatttttttgtcttgaatatgaaagatctaaatatggagaaaattttccctgttctgtatacttttaattaatgggcacattatactttccactatccccaaactacattcaaaaaaagtgctttaacaatgatagtaaaatattaagagaaagtcctttctaaatatcaggtatggcagggatagaattgacaatgttatgaaatttttttttgtcttatcagataaagttcttttccacatctatttagagaacgcaatacagtcatccctctgtatcgtgcagtctgcatctatgaatttaatcaattgtaggttgaaaatactcaaggaaaaaaaggatagttgtgtagaacatgtacaaacttttctgtcattattccttaaataataaaacgatttacgtagcatttacattgtattagatattataaataatctagtgatgtcttcaagtatacagtaagaagtgcataggttatatgcaaatactatgccttttttttttttttttttttttgagacagagtctcgctctgttgccagcctggagtgcagtggcatgatcttggctcactgcaacctccgactccctggttcaagtgattctcctgcctcagcctcccgagtagctgagattacaggcacgtgccaccatgcccagctaattttttgtatttttagtagagacggggttccaccacgttagccaggatggtcttgatctcctgacctcatgttccgccttcctcagcctcttgaagtgctgggattacaggcgtgagccactgcgtccagccttctataccattttatataagagacttgagtatctgtggattttattatctgcagagggttctggaatcaatcccacacagataccaagggatgactacatttaaaataggcatttttgtagctgatgactatgtgcacatagcctaggtttcctgacaagatcacaatgggacccacaggcagcctctttttattgaagaattaagtctgatgatagattaatagaaattttgtaaaatcttatattggtaatagtagttgttgtttttataagatgtaagggagtacagaaatgttcggtgatagagtagttatacctgcttgcctcacatataagggtaagcttgagagacccagacctgcagtttgtagagaagaaaactgacattgaattttgagggagtggtcagtgatccttaaatttgacaatggtataaaaaaatcctttttaggaaatataagatatttgggttcattctagaattgtttttgagatattgatagcaaggtttggaaccagaactactacatatatttgtacagtctgtgccctacagcaagataacaaaagaaagctaaaattctgtccacagtctgagctttccaagctatgtgtgctttttaataatttgcccacccagtgggaacttttttctgtagtttgtataccaggaggggtcacctttttgcaattggctcaaggcataatagatgctaattcaactctatttggaacctaacacttgaataattttttatcagtttgtcagcaaaagttcttctctggggttgtttgatgattaaatattattagatcttagctaaagggggttcaagggtttctgaaacatgggactgctgctaaagagctataaattcagaagcaatagcatgactaaaactcagcagaaatgcatacttctttaagtctttttgcaagagcctgtactctggacaaatatgaaccaattcttgagacgttaatctttatttctgggaagggaacagctatgattcaaactgattgtcttccatcctgatggtgaccttatatttcagtttctaacattccgtgatttaaaaaataataaaaaccttttctctctggatttttaactgttgttaagtacattggcagagaaacattctgtgttaagtcatttgagccaaataatgatttttgcatactcgttcttgtttttcagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagaggtaaggtagagaaggctatttttgtctacctggaatttaattggtctgggacatccctagagtttcctgcaagagaagaatacaagttgggaaatggaaaaagttcccacttctcccattaagcaattgtattacccaggatatacttcttaaccattgtaagtcttattctttccatttgtgtgataacacctatcagaataggtgtaaaaatggactactattttgtaagatgccaaatatagttttctgagttgcattattctctctttttaagagtgccgctttcaggaataaggtttaaattataagatttgaggggaaacaaaacaatgtagttgataaagctataggcattttcagtggctgccatcttaaagaaaagttaagacagatcaagccaattgaagttgatcaatcagaattggtgtctgctcaggagagtagaagatgctctgtgtatgcctgttgtcccagtctctgggaggtttctctgtagtgttagataactatcagaggcataggaccacaactagatatctgtgctcatatataagttctagaaaacaagctgattataccagagtgtgggaaaggttattttaaaccacttgacttatttctaaacaaagatctttcttcactgtggcttggacccttcagcaacccaaagtgacgcagatttgatagtttacatttgagtacccacaagaacaatatgctaaataggaaacttagtttaaggaagtcaacaaattaagtgaagtagacataagcttttttccctccttctagaagcataacatgtcacatttattctctttttagctttaaataactgttgaaattcaccccctcctgtaaaaagaaagagatttttggttccagagcaaattgtcttttttgacaattgactttaagatttaggctaacatttgaaacacttctcacccatgagtaaagatctgtttttgccagcagcctactttaaagggattatctcagtgcattgttatagggggaatatgcagacatctgagttttaaagcgcaaatagatctgtattttgaaactaaatatttgaatatcagctctaacagctgttctagatgactgtagtatggtcagtttttcctgggacttggcaagaaaagatgtggaaagcccacatgctccatttatgcattgaaaccaaatatttggaagtatttaaaatgttatgtttctatgcttatttggtaccttctatggttatttttcttacgctgtttgttttggggtttttaagttctccatttgagaccttaaattccagagactgttggtttgccattgttagagccccctgttatttaaattatacccaaaatagtagctcacactgttcagattcctgacaaaaaagggtttaaaattcagtggctacacatcagtatatttatgagatggatgataggtaataaatatcagtatattgagattatcccttattagtatacttcagttataagtaatatcggagctagaagaagctttagaaaatgttgaagtagcaaatactcattctgtgttatagaatatttattcttcaaaagatatatgaaaaggatcagtaatcctggagcaggtatctctgacctagtacctgttgtgagtcagttgatatagccattataaaatatgcacatttaatgtgactctgggctattattgaagtgctcagaaatttaaatactattgaaaataagattcttgccaacccagttagataagaatgtcttcatgagtttccaaagtcaacttttagcaaacatttagtcattcattcatccaatcagtctgtcagtcagtgaatatttatggtcaattgctagacataatgccctgcattatgtaatattttggcaaataataggcattgtctttgccttcatgaaacttcagtttttttaggtgagataggtaataaatcagtaaacaaatatataattcaaattccgttaagtgctaggagagaaagagcgcactgattgagaatacttagtaagagaaattttctgaaggtctctcctgagatctgaaaacagaacgattcagccatttgaaaaaccgggggataaaaaattgggggatgaacattttgtggaagttaaacagtgtatgaaagacagagaccaaaacatagagtactttctagtgagggacccacaacatagcataaagaaaatctctcggccaggcgtggtggctcacgcctgtaatcccagcactttgggaggccgaggcggggagatcacgaggtcaggagatcaggaccatcctggctaacacggtgaaaccccgtctctactaaaaaaaaaaatacaaaaaattagctgggcgtggtcacgggcgcctgtagtcccagctattcgggaggctgaggcaggagaatggcatgaacccgggaggcggagcttgcagtaagcggagatcgcgccactgcactccagcctgggagacagagcgaaacactgtctcaaaaaaaaaaaaaaaaaaatctctcaccagagtgcagagaaacttgctactaagagcccatttacctggattttaatatctgcttgattgtccgacaaaagacacaaaagacagtttacttcaattgggcaagcccataaagaattgccagaattttaaaacagtgactgaaataaaaggatatggaaaacttattgtacagaagaatccaacttttaaaataaacatttttttcctttttatgaaaataatatatgctcattgtataatatcaaggaaaaaggcatataagcaataagaaaatacaaattacctgtaaactcaccactcaaaagataaacacttttttttcttttttttttgagagagtcttgctctgtcgcccaggctggaatgcagtggcgcaatcttagctcactgcaacctctggctcccaggttcaagcaattctcctgcctcagcctctggagtagctgggattacaggcgtgcgccaccatgcctggctaattttgtatttttggtagagacggggttttaccatgttggccaggctggtcttgaactcctgacctcatgatccacccgcctcggcctcccaaagtgctaggattacaggcatgagccaccgcgcccggcctctcttttttaactaaagaacagggtcttgtctgttgcctaggctggaatgcagtggtgtgatcatagctcactgcagcttcgaactcctgggctcaagccgtcctcctgagtagctgggactatgagtgcaggccaccacactcggctaattgttttttattcttttaagacgtgggtcttgctatgttgttcaggctggtcttgaacttgtagcctcaagcagtcttcctacctcagcctcccaagtagttgagattacagatgtaagctactacaccaagcactatttgccttttggtgtgtatctttcttttttttgagatggagtttccctcttgttgcccaggctggagtgcaatggcgcaatcttggctcacggcaacctctgcctcctgggttcaagtgattttcctgcctcagcctccagagtagctgagattacaggcatgtgccaccacccatggcttattttatatttttagtagagatggggtgtctccatgttggtcaggctggtctcgaactcccgacctcagtgatccgcccaccttggcctcccaaagtgctgggattacaagtgtcagccactgcgcccagctggagtatatctttttaactattcttcattgtataatatataaacgaatatatatatacatttttacaaaaatgcagtcatttaataatcttagtcttttttcttcacaataaaaattcatagagtaggttttcaacatgtgtttctttaagccacaaggttcctagcagtggcctctgggagtaattggacagtgctccaagttcctccctctcactttaaataaagagcaccaattgttcttgctattgcttttctttaaatataggttgtaattaagatttaacttgggggataaaaagggttcttcaacccaaaagaaatttttgatgaccaccttctaacttcttgtgaaataatacatacttataagtataaagagacctatgaaaataaagaatatggctgggtgcagtggtggctcacgcctgtaatgctagcactttgggaggctgaggcaggagcatggcttgagcccaggagtttgagaccagcctgggcaacatagtgagacctgatctctacaaaaaataaaaaaagataaaaattatccaggtattgtggcatgtgcctgtagtcctagctacttgggaggctgaggtgggaggatcacttgagcccagaaggttaaggctgcattaccgcattcccgcctgggtaacagcgtctcaggaaaaaaaaaaaaaaaaagaggaggaggaatactcataagtatataatatataagtatatataaaatatataaaatacttatatattatatacttagagtattccttcataaggaaagatgtatcaacctttaacaaatctcccttttgaagacacttagattgtttgcagttgcttgctgttttaaattctaatgatttttcttacaaagtctttctaggtacattcctgaaattggtgggccagcgggtttcaaagtttcaggtgtttttatatatgttgccaaatttaccttcagaaaaatattgttggtttataccttttcaaaccctgggcatttcactttttaaaatctttgcctgtttcacagctttacagttacagaaaatgcaaacatttggttttaaactgttttagttatttttatgaccactttcatttacagttcaccaaaaatagaaaattaatgactaggtttttcttgaggtttagcaaattagtgcaatttgttcattttagattcatgcctcagtgttaaattcgtgcctgcctgctgatgccatcagcagattaatttggagtttgctttccattcagtgggaaatgtagctagccttatttccacatgtggaatcagcctctgtctccctttcctaaagctagtgtgttttaaaaagccaattgatttatttagcaggatataaagtcagttttagaaaagttaattgaaatggtcttgtcttcctcctgttttaacacttttctaaatatctctgttgatggaagagagcatgttattctagggactgtaaggggtccctagaatgaagaccacattcccttctcccgtgcttccaaggtatcagtgaaacgtaataagaaagtacagaccagcagacatgttagaaacagacaacccagtgcacacagagaagtacaagtatctgagtagtcaaaggataccatttaaatgagataaaacagtgagtgtccatagaagttaattaggaatgtcacaaaagaggttagttccatgcttattttaaagactttgaaggaaatatgcagtagtagaatctgtcattaagatgtgaaagctatataaagagatcccaaagaatttcctgagtttttttctccattttaatgttacctcatttcgattttcactatcacaaccaagcctgcttgctgtctttctcttcctttgcccttcatccttagggacttcttttctctctcagcctttgaaggtggtatcatttcaggaggagagaatattgatgccctgaaaatatcaaaactaaatcaggaaacaattagtaaacagttgtataagctgtgtttgtataatgctatggaaaaagcaattgcatttctttgctggcatctttgtgagacaggagcattaacccaatttgacaaatgaggacagtgaagatcagagagtttaaattacttaaggaaagtcacacagtagaataaccaacagtagaaaatagtgtctactttaagctttgttaagacttcttaaatgatagcactcatctaacggatatttatggagacatagactaatggaatagaataaatagagttgatacagtcactgacttacaggtaacattgaagtgcagtagtgaaagaatgggctttttaataaatggggctttatcaattgtatggccatatgggaaaaaagtgaatttgaatccccatcttataccatacacaaaaaattaatttgagatggataagagacctaaatatacaaggtaaataataaagcttactgaagagtatcttcatgactttatctcatgcaagtcaaacatttcttatatgagcaaagatttctaaaacagggcaaaataaggataaaattattaattaaagaaatgacatcgattttcattaaagtgaattcatcaaaagaagcaaaaagacaagacaccaggaggagaagatatgtgcaatgactctcttcagaatacactaaaaagtcctacaaacccataaaaataaaaatcagacaccccaatagaaaaataagcaaagggcgttcaggtgcggtggctcacgcctgtaatcccagcactttgggagcctgaggcaggcagatcacgaggtcaggagatcgagaccatcctggctaacacagtgaaaccccatctctactaaaaatacaaaaaattagccggctgtggtggcgggtgcctgtagtcccagctactcaggaggctgaggcaggacaatggcgtgaatccgggaggcggagcttgcagcgagccaagatcgtgccactgcacttcagcctgggcgacagaccgagactccatctcaaaaaaaaaaaaaaaaaaaaaaaagaagaaaaaaaaagaaaagcaaagggcttgaacaggaacttcacaaaagagatatccaaatgagtaataaacatatgaaaaggtgttcaactttattagtcaccataaacatgcatactacaaccaagaaatcactacacatccgtgagaatgactaaaatgaaaaaggctgactctaacaagtattggtgtccctgtagagcaactggtggggtataaattggtataagtactttgaaacactgttcagcagtacctggtaaagattgacatatggatataacctgtgagtcagcatctcctctctagggtgtatacctgtagatatcaaatgacatgtaaaaattgtgttcacatcagcacttttcaagatagccccaagctggaaacaatccaagtgtcatcaggagtacagcagataagtaaattgtggcatattcatacattggaatactatatagcagtgctttcttaacctacctgtaggtgaggaaccagatttttttccctaaaaatctgtcaggatgaaactcttgtgtaatacaatattacatacaacgccaaactgctcaaaagtttctaaatgttcacacataccttctgtactcatggtgttgcaggccagtgatgaacagggtggggaccagcagtggtacacaaacatacttcaaatagcactgctctcaaacaatgacaaagaacagactgcaactacacagagtagtgtgaatgaatctcacaagccaacacaagagtctgtattttatgattccatacgtgtaaagttcagtagcaaccaaaatactaacctgtgacattaacaagttagaattacccttgaggagcagaagatggtcatttgtagggggtatggaaagaattctgggattcttaatcttggcattgcatgatttttatgttggctatatgggtatgctcattttgtcaaaatttagctgtgtgcttatgatttgtgcacttttctgtatgtacattatacttaacatttacattaaaatttattgatgacctattaaacacacaccctctttcctcattaaggtagtagattagtggaggaaacaaagtgtatgcaagtaaacaaatgtgaaattacaaattatgatttcatgagagaaaaaagagtcttctcggagaagatactttagctgaaacctggagtatgcaaaggaaccagcgatgcaaagagcagaggcaaacaatccagggattttggtagttgttttgagtagagaaatagagctaatttagtggatttagagtaaaagaggacattgtagacatcgggtacaacttgggagttgatgttatcaaaactggaaaaggtaaaaagtagaattttggtttgcagctgcaaataatggaaagaccaaatggatagatttccaaaagtctgtcaacatcagcatgaaaagagaaagattattatatctaaaataaaggaaaatataatttaaagggaagtgtattccctagttaatttttaaaactaagggaaatatgatcttatcaagagttaagtaatgaatgcatttcacataggtatttaacatatgagataatttttttttttttttttgagacggagtttagctcttgtagcccaggctggaatgcaatggcatgatctcggctcactgcaacctccgcctcctgggttcaagcaattctcctgcctcagcctcccgagtagctgggattaacaggcttgcaccaccatgcccagctaatttttgtatttttagtagagacggggtttcaccatgttggccaggctatcctctaactcctgacctcaggtgatccacccgcctcggcctcccgaagtgctgggattacaggcatgaaccacggcacccgactcgtatgagagaatttttattcaggcgtttgagatggatagtgaatgggacaacattcattccaacccttccagtctcagtgtctctgtcattccagtagtcctctttgtttttcccctttccccctacaatgatttatcatttgtttcagctctatcagtcttgctttttgttcccttcctctgttacccttcccccaaccttcaaatgttatattgaaagcattaaagcacttttatgcatatcatcttctttaatcctttgtaaccctgacagaaccctccagtatttggagattcatgtggggaaactgaggctcagagaaactatacgacttgtctaaagtgccaatctggagtcctgaccccaagtgcagtgcctttatttcagttaggccactgaggccctcttctcatccagctctatacatgatgatgttatatttaaaatgttatggtccacattatgagttgtgaaagtgtgccctaattgcttgctagattttaggagagacatcttcctagaagggttatgtgagttctatatatgaatataggatgtatgtgtataatttatgaaaatatatcacttcacatggacttgaaatcgatgatatattaagaagttttggctgggtgcagtggctggcacctgtaatgccagcacattgggaggtcaaggcgggtggatcacctgtggtcaggagttcaagaccagcctggccaacatggtgaaaccctgtctctactaaaaatacaaaaagaaaaaaaaaattagctgggtgtggtggcgggcacctgtaatcccatctactcgggaggctgaggcaggagagtcgcctgaacctggaaggcggaggttgcggtgagccgagatcacaccattgtactccagcctaggcgacaagagcaaaactccatctcaaaaaaaaaaagaaaaaagttttataattttttagtagtttttgaggtagttggagtcttcctgaaatatggcatatccaggctctctatcacaattgtctctaatttcatgtgtcttcttaattatttaaaatctggaagaagaaagatatgactttgatgcagataattaaagcaggtgtaatggcccaagatctcactaaaaatgaagaagtaaaccaaatgagtattcagggcttagtttatttcctactgtttgccttcttgcctctaactccctgtgtctctttaataccactgccaatgagtaaacattggagatcacttgtatttcattacttgctggtagttctgggggaattaggatattaagattgattaaaatgaagttcgtggatttattgctttgaaagttaagagatgagacatttttattaagggtgtacaaccagtctctgaaataacctggtaacatcacatctgttgaaacttttataatggttagtaaactgcaacagtgcaccatagaaaaaacgaatttaggctttttggaaatgaaaaaaagtctctagcggaattgaatcttaagaaggtaaatgagagtggctaggtcagcatttctagaagtggttatggttgttcataagagatagtgactattagtattgcctcaggaattcttcctaggatattctgccatctaaaatgtatggtataagaatgcttgtttggggtgggcaagagatgtagtaaagtagcagaccccactgttcaggcattcaacccccaatgtttcctctcttttttatttgccatagagtgattctcatcagttccgtgtaatggcagctgtccttcgtcattgtttactaatcgtaggtccaactgaagacaaaacagaagagctacacaggtgggtaagctctgtattgatatcccaatgaaggacatcatcagttgttcttggttttatgcatctaatttcaattgttataagcacaagaaagtgaaaatactacagtaaatcaggtaactggtaggtcagaaatcattatcatggaaatcattactatgccctgatgagaaatttttattctgccccctttcactttgttatattgaggctcaacaggagaagagaatttggcatttgttgcaaatgccacaaatagttactgttcttggttttatccagaacaacaataatagtacacagttattgaacacttaactctgtggcattgtgctaagtgctttataacgataacttctttaatcaccatgccaacattataaggtagattctgcaatttttcccttttactagttgaggaaactgatgcatagaaagatcaagcaatttctctgagattatacagccctaacaagtgaaagagctgggatttaaaccctgcttttaattactacacttaactagtactctcactaatttcatttgaagagtacttaccaaaaagtatatattttggcaatgatagttttattttttaaaaaaacttgtaagaattagggcatagtgtctagcattaaaatatataaaataggccgggtgtggtggctcatgcctgtaaacccaacactttgggagtccaaggccggtggatcacttgaggacaggagtttgagaccagcctggccaacatggtgaaaccccgtctccattaaaaatacaaaaaaagtagctgggcatggtggcacatgcctgtaatcctagctactcgggaagccgaggcaggagaaacactgaacctgggaggtggaggttgcagtgagccaaggtcgcaccgttgcactcctgcctaggcaacagagtgagactccatctcaaaaaattaattaattaattttaaaagtaaataaaatatataaaatagttcagctgggtgctgtggctcatgcctgtaatactagcactttgggaggctgaggcgggcagatcacttgagttgagcctgggcaacatggcaaaaccctatctctactaaaaatacaaaaattagctggatgtggtggcgcacgcctgtagacccagctacttgggaggctgaggtgggagaatctcttgaacctcaggaggtgaaggttgccatgagccgaaattccgccactgtactccagcctgggtgacaaagcgagaccctgtctcaaataaataaataaaatagttcaaattttgcgacttgtccgttagaactattaacggactgctgtaaaaatttattgtactctgagaacaactgaataagaattaatgcatttttccagttctctttccattctggatcagatttacaataacaagagttctgacttcatcatgatgctactcatgatgctttattctatatgaatacaaatggcattttaaacaattcaaataaactcatatctgcaaacaaattactttggcattaactctacaaagaatttaacatagggttgttcttaatagtagaaattcctttttgaacacttaaaatattcagttttccaaaatacggcttaaataaaactatagaaacacagccacagtataaagtgaaacatatgcttaattgttatttttcaattaaatccatattattttagttatgatcagcaacttattatttgatattgtactgaatttgctggtaggttatctcagtgtactccctgccctgcagcctgtcaaaagactgtttttcttgattaaaaaatgtaattgtttttctgtagctacaaatcaaacattcctttagttttcttaagacagtacctttaaaaaaagtcagattaactgcaataaatcatatcctaacaagattttattaaacattttgacccactgtaatttttttcgtaattaagagacactagaaatttagaccctaaaactaaaagaaaatgctcttataagcccaagagtaaattgattttttttaagaagtcagatatcacaagttaaataatcatacaaggatgtgaaaggaaggcactttgaccaaaattgctatactagtcacaaatacattgccaaagatttctccgaataatgaatttaatatcttgacgcagcacccagtatttgttgaaagagagcaaaactatgtaatagaggtttttaaaataaaatttttttaaagaagtcgtatttattttccttagtgatgctagcttttttccttaaatttgcttttgtcttaaaagttattttgataaaaacctatcggcttcactgtaaataaggagcatgcctagagccacagacaggatttatgagtatttctcagaggctttcctgggagattgaggttgctgctgacttaacagtttatctggaatggccttgcatgttcctttaatcagaattagagtgattagtatcattttgagcagtaatgactccaggctaatccatttaaattcaatgaaaatggcactaacctcaaagtgctattttaggaagcttctgtagtgatcctgaaaacaatttttctctgtgtgtgtgttttaagcataaaaatttttttaaaggatttcaaagtaacatctcaaattccatttttgaaagttattttctaagtttgtttttgcttttttttggacactttgatttgctttaaagaaaagtttaatgaaataggtaaccctgggtagcacagtgtatggttgtgcgttatcatcaaacccaaagagttgtgatggtgattaaatgagaggttcataaagcacctcttccctggcaatgagaaaatactcagtaaatggcacttgctgccgctgctgccaccactgccactgtgccactgatgtgctacttctattagtattatgataaacatactggattttagaatatttagttattttaaatctttttttaaaagttgtttgttgattttgatacgctgtttaggaacttatgcctatgttcatcctgtgatcatgtaaagacatcttttttcttttaatccaagtgtttctgaagccagataagttctatgatatatgcatgttaggagcctataaaggtgctttaggagaaaagtaggttaaaaaaaatagcctggcagctttttctgatacgttgtctttgtaagacagtgcagttttttcagagaagtcaagaggacatggacatagagatgaaatgagttagctcgtaaagacagcagaccttgaccttcatttccactaatcaacattttatatggcttttaaaatctattctttcatttccttttgtctgtacttaatggtaacaggtaggttgttggtatgatccaccttttttgctccactgaaggacatcctaattctgttcatttctatgtgcctgaaagtattttcagcactccagtccataatcaacaagcttatgcataaatacttagcccaaaaaagttggcatgtggttgtggttttattttattttggagagaagggaagaaatcaggatggcctatatgctgatgagaggaggggaggaccagatttgatttaatttattttaggctctcaatctcgttttcttttactcactgagtacattggtatttataaagctttttgttactgtttctttgtttagactaattcactttgtctcacatattgaaggggacaatatagtacataatacagtacctaataacaccttattacagtgctaaatacaatgccttaaacatggcagtctttttttctttcagttttttttatagtggtaaaatacagttataaaatttgctatcttttaagtgtacaatttggtggttctatttataatgtgcaaccatcaccaccatccttctccgtaactcttttcatttattcattaagatggctccatcttctccactgcacacagaggtgtttttcaaaaagcaaatgcctgctttaaatcttgtcatggctcctctttgtcttaaggaataagagaaaactttttggcagcaggattggtgggggatcattgtgcaagtatttatgatctgtagtctcatgtggaaaatctgtttctcctgattagttctctctttcatcctgtatatatgattctaccaaacctttgaatatatatatgtgagagtttatttctgagctctctattctatttcatttgtctgtatggcttcaggccagtaacacactgttttggttactgtagctttatagtaagttttgaaatgagtaagtgtgagttctccagctttgttctttttcaagattattttgactattcagagtcccttgagattccatatgaattttaaagtgggtttttctatttctaaaaaagagtgtcatggggattttcataaggattgcgttgaacctatagaatgctttgggttgtattaacattttaacaatactgtcttctaattacacaaggcagacttttaataaatgtttgaaaattgatttcatttgtttattaattaagcactactatgtgttaggcactatgttgagtaacaaaggtgaatacagcacagtctctgttctccatgactcgctaatcaatagataagacagatttgtaagtaaataggtagagttgttttgatgagtgcggtattagacatgaataagcttatatagttgtacagaaaaggataatttactttggagagattgagaaggggtttggattggttttgttgtaatcataaagctcttagctctttaagctgactctctgtaaatgacagtcatctaggtgaacagatgttttctgaactatagctgaacactggtcttagaggacttcacaatgcatacctggaggaacatggagactaaattcccagactgcccgatttaaattaagaccctccctccccctcatgcacatatcttgtcactgtcttatcatctgctttattttttttataaggagaaaagacataaatgttaggaaagctaaataacaattcgagacagggatagagagatatcacagatttttttttagtagtttcccagtaaattaattattcaaataataattgctaatagaattcaaagggcaatgtaagtatggtctgtcatgatgaagaaagtcttccttgctcaaatgatacctgtcctggccttttccagacttctagtcctctgatgattcctttttctcctatctctaagtcctcttatagatttcctttcttccatctctattctaaaacatttgttcatcatttcaacctgctccactccattaccatgtcctgccagtcttaaagcactcaaccctagatctgtcagcccaccttctttctccacaggctgctgagccctaagggaaagttttacctaacctgacagatggctccatcttctccactgcacacagaggtgtttttcaaaaagcggatttctactttaagtcctttcgtggctcttctctgtcttaaggattaagagaaaaaaaatttttttaatcactttgcatgtgtttatgatatgcagtcttatgtagaaaatctgtttcccctggtcagttcccactttcatcctatgtatatgattctaccaaacctttgcaactctctaaaggccttctgcacccccttgtcctcagaagataacatgtttttacttagtttttattatggatatttggggtggcctggcaacatggtgtaggggttgtgagattatgagagagcttaaagccttcaaatacatcttagcatggccattgaagcctgacatctggattaaatctaaaccctttcaacaagacttcagggcagaatatcatgctatcatgctaaagtgtcagagtctctgcctaataaattgggcaaaatgctgttatcatggcaatatgccagtaacttctgaatgagggaaaccatctctggttgcgttgtattggatgaatccatggaattggatctgaggcattggccttcaccttgggaactctctgccccgagagcatccgtctttctgttatcaagcaacacatttgcatggcatggagccacttcctccctttgcctccaggagcctaccattccacaatctgcatgactttgtattcaagctactctgctcttctttctcttccttagacatagattccttattagggcctttacacttgctctgtctactgcgtggaatccttttcccagatctttaagaggctgagtccttcttgacactgagaactcagctcaaatgtcacttcctcagttaggccttccctgactgcctaatttagattaagaactccctcccagccccctgccaccacacacacacatatcttgtcactatcttatcatctgctttatttttttcatggtacttatcactaactgaaataatcttcattttttatttttccacttgtttattgtttctctccttcattaaattgtatgtaatcccagcattttgggaggccaaggcgggtggatcgcctgaggtcatgagttcgaggccagcctggccaacatggtgaaaccacgtctctaccaaaaacacaaaaattagatgggcgggtggtgggcacctgtagtcccagttactcaggaggctgaggccggagaatcgcttgaacctggggggctgagattgcagtgagctgagatggggccactgcactccagcctgggagacagagcaagactctgtatgaaaaaaaaaaaaaaatttatgcttaaaaagagtgaagattgtgtctgtcttctctgccattatatacccaacacctagaacaggtatacttagtaaatgctcaataaatattagttggatgaagggatggatagatagatgatcttgctgacctcttaagaggctaattggaaactgtcaagcaggatcgttcttaaacccttaattccccatccctacctataagtgtactgtaaaatgtacctattctttcctgttttctgccaatctcaggaaattaagtggctctctcgctgcccaaggttaatgcccacacctttttcttctgcctcttgaggccttatttcagcattgaactcctcctctagttcttcagtctcttctttgggctttatcccttcaatatgtgacatgctgagatctatcccttttgtgaggaaaaaaaaatcttttatcggatctttgtcacctcagagatatgaccctgtttcttcccttccattcacagctaagttttttgacagtgttttgtgtgccattagcctctaaatattttgatcatattcctaatcaataaaaatttttgaatacaccctcaagtatatttatttacatataccttatatatatatgctgctaaactgacatacgaaataatgaaattatatacaaataataaaaagggataacatagagattaatattttaaaatagatttttaaaattaacctgccacaaactttcaaaattatcagctgggcgtggtggctcacgcctgtaatcccagcactttgggaggctgaggtgggcagatcacttgaggtcagaagttcgagaccagcctgaccaacatggagaaaccctgtctctattaaaaatacaaaattagcaaggcatgatgacgcatgcctgtaatcccagctacttgggaggctgaggcaggagaatcgtttgaacctgggaggcaaaagttgcggtgagcttagattgtgccactgcactccagcctgggtgacagagtgagactctgtctcaaaaaaagaaaaaaaaaattatcaaatagcagaagtttttctttatgttctgcacacttactatttaagtaccttgttaattgtggtggctttgaactatcattagctaatagctgtgggcacattatatacttgatatgtttggatattttgtccccaccaaatctcatgttgaaaggtgacctccaatgttggaggtgggcctagtgggaggtgtttgagtcatgggggtggatcctcatgaatgcttggtgctgtcctccccataacaagtgagttctcactctgtgatcactcgagatctagctgttaaaagaacctagcaccttctccccctctttcttgctgccgctcttgctgtgtgatactcctgctctcccttcgtcttccaccatgattgtaagcttcctgagaccctcaccagaagccagtaagatacaagtgctatgcttgtacatcctgcagaactgtgagccaaataaacctttctttataaattacccagtctcagctattcctttatgggactaatacagtacttaaggcaagactcctaagtattgtagtagttgtgaattcatgttacagataatttccagtttttctaaaactagtttcttgtcagatctgtttggattgtccttgttttgactcatgataatggcatacaaaaggctctgccattttcttatcctttgcttatactaattatcttcaatgttggtgtctttgtattataggaattatttaaaacagtttgttcattttacaagaattggtttagttaaaactggatataatatataaacccagttaactgggcatatgtaaattgtaatatgaccaatgaagaaagcaaatgagtgaccaggaaggaaggacatcactgctacccttctgtaacatggaattttaactcttctctcaattttaatacttctttcaaagtatctcaagatactttgcatttgtttgtgacatggggagcatttgatttatggttcaggtctgggtaccaatgtcaattcatttataaaatattagtaaagcttaatttcttttcaactttttagataaaaataataaaaataaaactatttcggccgggtgtagtggctcacgcctgtaatcccagcactttgggaggccgaggcaggcagatcacgaggtcaagagatcgagaccatcctggctaacacggtgaaaccccgtctctattaaaaatacaaaaaaatcagccaggtgtggtggcgggtgcctgtagtcccaggtacttgggaggctgaggcaggagaatggcgtgaacctgggaggcagagcttgcagtgagctgagattgcgccagtgcactccagcctgggcgacagagcgagactctgtctcaaaaaaaaaaaaaaaaaaaaaaaaaagtagaactcttttcttcccacacccagtagatcatcttatgtacctccagggttgtatctacctcactttgcagactactggtttgtacttaccgtttccatggctttaccctctattcattcttcagcccactgtaatcaggcttctgcatctattcctctgccagcacaactctggtttaaggtcattagtaagttaccttatcataacatacaagactttttataatgtccccaccccatttcatacatacataaatagacctttctggtcttattacctactaagacccctcctttagaggccttatcatttgctttaggtttaggaacctgttttcagttccccacaagtaccataatctctcattcctccaaatttttgctattccctcttatagtggaatatgtctgctgttcagaagctccttaattgttgacatttactatgtgccaggcagaatgctttgcatgcctttcttcatttaatacccacatcaacctggtaagtttaagctcctttattttagaggtaggacaaggcctagaagaggttgtataatttgcctaaggcatactagaattcaaacccagtgctttactaattatgttatgctgccttcccttacgaaaaggagtttattttcttttttatacctggcacctagcacaaggcatagcaaatattatatttgttgaatgaataaagtgaggtttgagctagtcttaaagaatgaaaatgttctaggcaggagaaaacatggacaaatacagaaaagagagtatgtctacagcacatttagagaacaatgacctggtcaccatgggttaaaaggtatttcactgagggtagcattcaggggtctttccattcaaagttttcttgaagcttccccacctgttgctgctgtagtcatctcttgttctttgtagcaaaactcctttaagtggtaactatctgattcctctactgttcttttgaatccagttcaccgaggcttttagcctcactactccacttagaatggctattgttagggtcactagtgacttctgtgttgctaaatccagtggacatttttcagtcatcttacttgatctgtcagcatcatttgacacagatcatcactccattcttagataccatgctgtcttggttttcctcttacctaactaattgtaaattctttgtctactcctcagcctctgaatgattgatcgagtgctccagtctcagctttcatagtcttttaatccacactcactcctttactgatctaatacagtcttctctttaaataccatctacatgctgatgacttttcagtttatatccctctgtaaccctgatctccctccctgaactccagactcacctagctaatttcctattaacatctccacttggatgtcaactagacaccccaaacttaacatccaaaattaaactctctatcatccccctaaaaagcttcttctcttgcagtgtttcccattttcagtttatggcacctccagcttttcacttgctaaggctagaactttagattctctcacactccacactagcctgtcaggaaatccttcattatgtatcgaatgaaccacttcactgttaataccttgtgcactcacctgaattattgcagtaacattctaactattctcccttacctttgatggcctactgactgtcctcaatgcagtagccagagtgacctttttaacctaagttaagaggatctcatcatgcaaaaccctgcaatgaatgattttccacttccatcagaataagatctaaagttataatatcctacaagaccaatctggtcttctctgttatctacctgatgtcatatcctactcctcttatgtatggtgggtcagccacaccaacttctttactgttcttcagacatgccactgctcctgccccagagcctttgcttttactcttcttcctctgatgctccttcctcagtcacattactctctctctaatcccttcaagtcatttaaataactcatctcagtgaagccttccctaaccatcctatttaaacgtataacccggccgggcgcagtggcgcacacctgtaatcccagcactttgggaggctgaggcaggcggatcacgaggtcaggagttcgagaccagcctgaccaacatggtgaaaccctgtctctactaaaaatacaaaaattagccaggcatggtggcacacatctgtaattccagctactcaggaggctgaggcaggagaatcgcttgaacccaggaggcggaggttgcagcgagccaagatggcgccattgtactccagcctgggcgacagagcaagactgtttctcaaaaaaaaaaaagtataacccatacatactagtttaccctcatgggttattcccccagagcacttatcaccttctagcatattatttaattaactttaaaaaaattttatttacttttctgtccatgccagagaataagttctgtgaggacaggaattttttctttattttctttgtgatacctgcctgaaatagtgcctggcataagtaaataataaataattactggattgagttagattaaataaaattatttatttacatctgaaaatcttttgttttttttttttttttttttgacagagagtctcactgtgttgcccaggctggagtgcagtagtgcagtcttggctcactgcatcctctgcctcctgggtgcaaccagttctcctgcttcatcctcccaagtagctgggattacaggcacgcgccagcatgcctggctaatttttgtatttttagtggagatggggttttagcacgttggccaggctgatctcgaactcctgacctcaggtgatccacccacctcagcctcctgaagtgctgagattacaggcgtgagcaccacacctggtcggggatcgttcttttcgttgcctgaatcatttcagatggttttattgtggtttggttgatacacaaaaagctgtacatagttaatgtatacaacttgatgagtttggaattctaagtaaatacctgagaggtattaccataatcaaggccataaactttgtcatcaaaacagtttttgtattggcataaaacagacatattgaccaaaagaacaaaagaaagagtccagaaataaactcatgcatatatagttatcttcaacaagggtgccaagaatacacaatggggaaaaaaatagtctcttcaataaatggttttgggaagactggatttcactaaaagaatgaaattgaatccttatctcacatcatacacaaaaatcaactcaaaatagattaaagacttaaatgtaaaacctaaaacaataaaactcttagaagaacacttaaattagccaggcatggtgacacacctgtagtctcagctactccggaggctcaggtgggaggatcacttgaacttgagaggttgaggctgtaatgagctgtgatcacactactgcattctaacctaagcaacagaacaataccctgtcaaaaaaaaaaaaaaaagagggaggaggagcaggaggagcaggagcaggagacgtgagagaaaaagcttacggacattggtcttggcaatgatttcttgggtatgacaccaaaagcacaggcaacaaaagcaaatatagacaagtagaattacatgaaactagaaaacttctgcacagcaaaggaaacagtcaacaaaatgaaaaggcagcttaagaaatgggagaaagtattttcaatccatatacctcaagaggttaatatctaaaacctattaaaaaactcttaatagccaaaaaaaaaacctgattttaaaatgggcaaagaacctgaatagacatttaaccaacgaagacatgcaaacagacaacaggtacatgaaaaggtacttaacatcactaatgcaaatcaaaacctcagtatcacctcataccttgttagaagggttattccaaaaaaaaaaaaaaaacctcaaaaaacaaaagataatcgatggtaaggatgtgaagaaaaggaaatctttttacactgttggtgggaatgtaaattagtatagccattatggaaaacagtgtggagttttctcaaaagatgaaaaatagaattatttgattcagcaatcacgcttctgggagtatatccaaaggaaataaaatcactgtttcacagagatatctgcattttcatcacatggtccttacagcactgttcacaatagccaagatactgaaacaacctaaatgtctatcagtcagatgaatggataaaatgtgcgtatatatgtatacacacacagagcagaatcagtagagtattattcagcctttaaaaaaagaaggaaatcccatcacttggaacaacatgggtggatctggagggcattatgataagtgaaataaaccaggcacaggacaaatactccatgatcccacttttatgaggagtttaaaatagtgaagcttgtagaactagatagtagaatagtggttatctggggctggggagaggagtaaatggggaggtgtcagtcaaaagatacaaagttttagttatgcaagataaggtctggagatctcctgtgtagcagagcctatagttagcaatactgtattgtatacttagaatgttgctaagggaataggtcttacgttaagtgctcttaccacaaaagaaaaaaatacttttcaaagattttgaggggtttgggtgcagtggctcacgcctgtaattccagcactttgggaagccatggcaggaagattgcttgagcccaggagtttgagaccagcttggggagcatagtgagaccttgtctctactaaaaattaaaaaattagcaaggggcatggtggcgtgtgcgtgtggtcccagctactcaggaggctgaggtgggaggatcatttgagcccgggaagtcaaggctgcagtgagccatgatcatgccactgcactctggcctgggcaagagactctatctcaaaaacaattttttttaatgaataaagagggcaaaaggaaaatcttttggagattttaagattcgtttacatagactttacagccttgaaaaaagatatgtaagccccaaatataaagaagatacatttgaccagcaagatttattaacagctatggatctacgtgtgccatatcatgttcttcagtgtaatttcatgtttttgtccagcgattcacagaggactagattttagattgcctttcctctcccacaactgacaaggctttaatcagggcattaaggagttctaaataggtcttgcttttgaatctgcatatcaggagggggctgggagcatgagcgggaggatgtcatgtctcagtgattaatgatctctaggaagctgaaaaggggagtgtaatatacacagtatttctaccccctggagtaggaatgcaaacactattgtgcagatctgtgcatagtcactgacttcctggtagctggagaatttcatacactcttctaccacaaataaaactgtcagagaagtgacagagctcaaaaagctggccttccttacttaaaaagaatagctcaaacacagtgagccagaaaaattaattttgtagttgtttggaaaccaagttgttaaataagaaataagaaaatgggaacttttcttgaaaagcctaaaacctccaaatatttgttgaatcaaactctacatttggtttcttaaatttactgaattcctggaaactgcttactttaaacgaatttaaaggggaaacattcctttgtaatgaaatgacccatctgaaacttttcaatctggtctctggtaggttcagagcatcatacggtcagtgtatttaagagcctattgcctgatgtttagggaaaaaatcataacatttcagaatggcttgtatacagtttttgaaaataattctaaggtagagttatttccccccttttattctcaatgaatctatggtattatttagtaacaatttctaagtgcttaagatagaagcaaaacgttctgaactatagataagataaactacagatatttgcaaaaaaaagttttaagagaaagttttggggaaagcttatatttcagccacctttgattatttaccaataaccaaatatagagattttgtgcataacaccagtagcagcagcagtatttggttttagtgagggcaatcaaataacttgtattttactaggaaccatttattcatatgacttgttaaattattttttgctcttgattcatttttttgatgccctatacattaccactttctgttctgcattgtctaacttttcaactgacttgttactggtttttatttttccataatataaaaagaaaggaaatattcattcttggggaagtggagcacaattcagggtagaggaaagaaaaatttttgtatttctatttctttgtttttctgtttgttttgctttattttttagggtgtcactataatctaaagtagaaggagctactggtctaaattaagatagtatcagatagattaagctctaaatttggtttccaagtggttggacttttaaattgcatttgcaggagtttatttttagtcaggatgtggttatttttagatctgcttctctgtcactaggaaataaaatgcctgtctttccattgttgatcaggaagttctaaggcacaggcatataagagccagttagcccagaacaccaccactccttttagatgaaagaatatgaaataactcatggaagaaaatatgtttgttgagaacatatctaattttgaaattgttagtgtcattttaatcttttgtacactgaacaacagaacaaggtttttagggaatgccaaaaatataaggtttgggttccccctactggtgtgcatcccagtctcgtgtattcattaatacacagctgaaaggcctaggggctagagattagaaatagctatattaacttcatttagagacctgatgataagaaagagagaaaaaactccatttccctttttctgcatatgtcttacaaaaattgggatgatttttaaattgtattttctacatttagaaagaataaaacttaattctaccatatttggtttattgttgttgctactgataagctgcttattttcagtgtttctcaaatgctttatgttgtaatctaaggaataataaaacaccagtggatccacaaaaggatttaaaatcccagggaagaaatgcaaagctagcattgttgccataataaaattaaggagctggcattaaagctcactaattcctattttagcatttcagaaagtgacatgacatcatgtgattgtgtctgtctattcaacatttgttttttttctaatttgtacaacatatatttgaaacagttttttatttcctatctcatagtaagtgtcaagtgtccataatggctcatttttggaaaagaaatattttaattgactcttaaaagtcacttttgaacttcttattatgtttgcattttaaaggactattcaatcaagttaaaatattgtatttttttaattgcttttcagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaaggtaaggctgataaaatggaagccctgggaagatgcttccaaagaatgtaaatgtgccatacatacagacacacatcacagagcatgatttttaaatctaagctttttttctgactgatgtgctgcataattgtttttactttggaaagcagtttattacaatatatgataaattgctgaagccatgttaatttatttgtttaatgctgaaaattatgttcatgcaacaccaaaattatgactagtgcttgaaaacaaaggaaaaagtaattactgttccattttgttactttgtgagtcctagaaataaaaaatatccccccaaaaacttgctaaatactcttcataatacctaaaagacatcttcccaaaaaaaagaaaaaagaagaccttgtcaatttcccatttgttgtgagctgtttatacattctctggtctatcactcactttgtcaggtatctgtattaaaaggcagcaaggtagcatagtccagtcaccaaaattttgcttcattcaagccctttggctaagcccatgggaatcctagaaaatgtaggaacatccaggaaggaccaaaaaaggcaatagtaaacatgaagatgataaaatggaaatgtttttaggaaaagaatttttaaaatagtttgtaagcttaggtaacataagatgtccccacctcgtggatcacgaggtcaggagatcgagaccatcctggctaacatggtgaaaccccatctctactaaaagtacaaaaaattagccaggtgtggtggtgggcacctgtagtcccagctactcaggaggctgaggcaggagaatggcgtgaacccgggaggtggagcttgcagtgagccgagattgcgccgctgcactccagcctgggcaacagagggagactccctctcccaaaaaaaaaaaaaaaaaaaaagtccccacctcaaaaacaaattgatatcctcagttacatgaaggaaagtaatactgttagaaacaaaactaacgtatttcaaaaacatatggtttttttttttatagggaagcagctatagagagggtctaactccagttctcagcttattaaccgaatgttcccgagcccatcgaaacatccgaaaatttctcaaagatcaggtaactgcttaatgcatattacattgcaaagttagtctttttatgtgcattttaaacatagaattaattgaattttctcacaatgattttgtttcagataatcagaaactcagtcttaatctttgaaatcttcttaatcaagaagtgtgtattttttgagtcattcattcagcaaatgctaccgagatctgctgtgtgtgctgtgttttgggcattgaacaacagatgaagtctttccccttgggaagtttattttgtagagagggggacaaaaagtaaacaaatttaaaatataatggcaggtggtgataagcattctgaagaaaggtaaagcattttaagagagaggagacactttaagggaacaagggaggacctctctgagatgacatttgaacagaaaggtggaaaagtaagagtatctctgagaatgattggaaaggaatgtccctgagagaacaagttcacaatccctgagacaagaggatgctttggtacacttaaggaaaagcaagaaggcctgtgtgactaggccacaatatgcaagggggagagtggtagataaagagaggtaacaagagccagatacagcaggcggtgtaggactttccattctcttctaagtgagatgagaagatattggagtgttttaagaggggaagtgatgtgaccttatttatgcttaaagatatcctggctactatttgtaagattgacatagtggagcacaaatggatgcaaggagacaagtccaaaagataactgatgttgcatgtttggagtaggatggtagtggttagagttcatacttggggatatgttttaaatattttaatatgtcttaaaagtagctcacagaacttgctgatagattggagtatgggttgaaaaagaaaaaataagggtgatttttaaactttcagattatatcttagactacaagtgtaagactttgattgtaacaatacctgaaactagcctcctctaaaatcccaatttcaagcaccttctcttatttagtaccctcaatccaacattctttcttcctcggaggattgtcagtctgtcattttttcccactgttcttcactcacttgtgccttctctccttacccaggctagattccacctgaggttcattactataatcactcctttccatacatctctaactagcaccttgtgcgctccctcagtcgtactcacctggcaaaacctaacaaactggctaactccagctttcttcctactctgggtctccaccaagcacttgaacatgataagagaaaatgacacaaccattttgacgagtctactttaaatttaagaccaccagccccaaccggttccttagcaaactccaagatgactatttcacagcttttcttcacacctccaatgcttactgccctctcctcactctcatttcttgactttgtttcctgtttcatcatgaaattaagaaaaaactttatctttccaccattgcatctgctatctgtctgcatctatactgccatatcccttgtattcccatctgtcacaatggatgaatcattgctacttctgtggccagcatttgtcctggatctctttctctctcattaactttgcacctgcatttatttcccctctctctcttcttatattaatcattttaaaaaatgtattggatcatttatcagcacccaaacacatctttcatcttaaaaacaaaaacaccttcccttatcccacttctcaagctgcctttctatttctatgctcctctttatgcagtgtcctcagaagagttctctgtactcactctctctattctttttactcgtttttgactcctaaaccctctgtaggctacatgccttccgccccactgcaaaggtgtttatcagagtcaccaactcaactttgccaaagctaatagttctcaagtctctttttttaaattctccaatagaatttgatgtaagtattccctcctccttgaaatactttcttcacttggtttctaggacacaatagagaacctctttgttgatcttcctcgttttcctaaccctaaatgtttgagtgccccgaggcaatactatcttgtctctatctctgctgccatggtgatctcattcaagagtcatggttttgaaaatcatccatatatgctgatgactctcaaatttatatctccagccctgacctgtcacctaagctctagacttatacagtgaactgccgactcatctcctcctcttggatgtatagtaggtatctcaagtttaacatacctcaaactaatatcttgattttcatccctccaacctatttcttccccttctttccacatttcaatacgtggtaccaccattcacccaattgttcatttatcactacatagaatctcccctaataaatgaaccagattcattttttccctctgtatttatggtcaagatttagtaagcaccttactgtatctagaaacactaataggtagtgctgataaggagagattagaaaatagagaccatctttgaggaatttacagtctgttgaaagaagagaaatacccagaaagcatgaataatgatttaggcaagattaattaattaattaaggtcatttccacatttgattattttaagacattctcccttgactaggaggagttggtgaagcacagtaaatgaaaatactttttttctgcattttcgcttttttccacaagggatccaggtacacctaaactgtttagattttgctatctctaaacagaacagccaaaaaaaaaaaaaaaacctattagttaaatacttcttaatatgaaggccttgggccacatattgtgtcattataaaagattatgtgacccactgtctgtcttcaagaaacattacagtagaggtatggagatgaaacatgacaggtaaaaagataactaaagatacaaggcataatacagaaatcaactttccttctgaagaggatgcactgtagactgttatgatcaagaaaggcagaacttaaagtacagatgattaactctgataataatgtaagtggaaccttgatttattattatgccctgtagtaaatacctggttaaatccaactcatgcctatccaaaggaaattggtctatattctgtgtttgggaggtagaaaagaaagcaagtggtagaaattactgacccaggttgtattattctggagaggcttatagaagcaatgagtatttgggggatttgaaaaagaaactggacaagatttgtcaaagaaaaaatttgttggaggtagtattctagggggaaatacataggcagtttgggagtggtatataacaataacaacaaaattttgttaaaaatttgttttaaggaaccaaaaatgtagctaacaaaatttttacatgataacctttgttcatagattctgtactcgaggtactatagacatatactacatgaaatcatttgttacatgtttcattcttctagaaatgggagacgtactaagtatggttcaataatggttcacagtagtaaggatttgttgtgcaattactttgtgcctagcattttgttctacccagccagagactgaaatatggattccataaacactttagataggttactcaattttgtgagatttagtttccatttttgtttatagctgtgtctcccctgcctctgatatctcctgatacatggtggatacttgacatagaaagagagagagagaagaaagtcatttgagtggatcaagtaaaattatatatacataaaggatctgggatataataggtgcacagtaagttcttatttgacttcgtgtctgccctcatttcttagcacagtgcctagcttatataatagaaggcacttaataaaagcttcttgaattaattcatttttccttcaaccagcaaatattcattaaacacctgtaatatgctagacactgggaagaaagcagtaaacaaaacaaagaaatctctgccccagtggaacttggtcttgtggaaggaggcagacaagtaaacagataattatatactacgtccggtggtgacaagtgctatgagagaggttctggcagagtaaggaggtggaggtgttgcaaaaagagagggctaaaggttagtgatatggagtggtcagggaatgtctcctgtaagtgacattttggcaaacatctgaagaaagtaaggagagagccatgcaagtttctagaaaaagagtttctgggcagaaggagaagcaaattcaaaagacctgaggcaggaaagtacttggcatgtttaagaaggtccatggaggtctgtgtgtctgtaacagcataggcagggagaatagtagaaatgaagtcagagaagtagcaggaagccagattatgtggaatcctgtacggaagttgtaaggaccttgccttttactgtgagatgagaagccatgggaactggagaactttgaggagtgacatgatctgactttcaaaggatcatcctagccactatgtagaaaatgaattagagagtgaccagcatggaagcagagaccacttacaaggctttggtattagtccagagaaatattggtaccttggacttggtaatactggaggaggtggggagaagtggttggattgtgggtatatttcagaggtggagctgacataatatgctgatggatagatattaaagagaggagtcaaggatatttccaaggtttttgtaccaagcaattgggagaatggacctaccatttaatgagatggaaaactgatgaggaacaggtttggtgggaacttcaagagtcctgcttaggacccgctaaatttaagaggtctataaaagcctggaggtcagaaacacggagtagaatagtggttaccaggggctgtggagaagatggggagttattattcaatagatataaaatttcaataatgtaaaattattaagttcaagagatctgctgtacaacattgtacctatagaatgatggttaccagaggctgggaaggataatgggggagtggcgggagaatgaggagtggggatggctaatgggtacaaaaatgtacttcaatagaatgaataagatgtagtatttgatagcacaacagggtgatgtcaacaataatttgttgtacagtttaaaaacagctaaaagagtgtaattggattgtttgtaacagaaagcataaatggtggataccccatttaccctgatgtgattattatgtatggtatacctgtatcaaaatatctcatataccccataaatatataacctactatgtacccacaacaattaaaaaaatttttttctttttaaatagtttatttatttatttatttatttatttatttatttatctattttttgtagagacagggtctcgctatgttgcccaggctggtctcgagctcctggtttcaagcgatcctcctgccttggtcttccaaagcgctgggattacaggtgtgagctaccatgcccggccaaaaattaaaaattaaaaaaaaaaactacaaaaaaaaatactgtatggtacacatacaaatttaagaaggttagaaaaaagaaacaaggaatcagttatgggtcccaccaagacttaactgaatcagaatctgcattttaacaagatccccaggtgtttggaatgcacattccagtctaaaatcactagcctgaaaagccctagttaacaggatgacttcaggacactttaatatgctctgtaatcagtctgtaagtgtaagtaaggtggtggcagtgtatttaatattgtgttagattgaatatcctctatatagatctatcatagatataattatcttaaaaaaatgaaagtgagtccattttaatatattttctgcccttatttaaatctattagtttctatagctctttgtaaaatcctataatttctgtgattaaagaaagaagtttggaggtcagggaagaaatcaacaatggagatataatttagggcaggggtccccaaccccagggcctgatccatggcctttaggaactgggctgcacagcaggaggggagcagcaggcgagcattactgcctgagcgccgcctactgtcgtatcagctggtgcattagattctcataggagcacaaacactattgcgaactgcacatgcaagggatctaggttgtgtgctccttatgagaatctaatgcctgatgatctgaggtggaacagtttcatcttgaaaccacccaccaagccccagtctgtggcaaaattatcttccatgaaactggccaagtccctggtgccaaaaggttggggactgctgatttagggagtcatcaggatgcagagactataaaaagccataaaactggattagatcacaaattgagtaaaaataatgaagttgcctacaaactcaacccttgaatattccaacattaacaaaacaggaatagaaaagacaattggcaaaagaggctgagacaaagcaaccaatgagataggaggaggaccaggagaaaggtatgtgggtggatgaatgggtgagtgagtgagcaaactaacagacaaactaagaaagtttcataagccctctggggatcagtctatttgccattacttttaaaagcaaaaaccacaattacttttgcaccaacctaatacaaaacagggatgagagtgatgttactatctcctttgcgggattactgtgaggattataaataatgtatatatatcatctattacagcaactaatgcatagaaagtactaaaaaattaatagccatttttattataaaattaaatagctagaaaacataagtacagtttttttaattaaataaaggttgagtgtccctatgtagaagtccagaatgctcccaaatctgcaactttttgagcaccaacatgatgctcaaaggaaatggtcattttggagcatttctgatttcagattctaggattaaggatgcttaatccagatgtatgtataacacgagatatttcaaaatccccccaaaatagaagtccgaagcacttctggtcccaagcattttggataaggtatactcaacctatactgaaaatgttggaggactcaagagaaggtaaaaatcagtatgactcggggtattagggaagtcttcatggaagaaagagaaacttgacctaaacttcaaaatggattttcatagaggcaagttgaggcattccaggtgttgagataaacaaaaactcggaaattctcttgaggatagtgtgatgatacagtgaagagatgtttctgttcaaatgaaacctcatcagaggcatgaaatcacttgaggtctggtttttgttgtttagttttacttggaagctaacctttttttttttttttttttttgctcctacaatacaaaccccagtagacattacaagactggccagttgcattgtaccatcctcactcactctagtagcctcgattgatgatggtttttgcatttgtgccatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagaggtaggttaaactctctttgcctctgccttttatctttcagagggactttgagaaatttaattgatagtgttagtactggtcgtctcattccattctttccaaagcttactgtctgttctattagagaggctgaggagttaataaaaattaatagccaaaaacatttgtatacgcttctgaattcattgagacatgcaaagacagatacattaccaaacacactcacatttaaactttgccttctgtatccttaacccagccttcatcttaatggggcaggacatagagccattatgaaaaattggttcagtaattcagcggctactattttaataagaggcacaggtctgggttaattcctctttttaattcctcttggaattaaagctataggagttttggtttctttactacgttttccaatcagtacttactgaatgtgagctatataatatactgaatagaaatttttaaaatgcataatacccttgagacaaagttaagatagtggtagagagaaattttaaaataactgtactacagtgtaataaatactactctataagtgtatataaagtgattgtctactgagatagatccaacaattaaagatattttctaaaattatatggattactctgcaaaaggcaagttttccaaacaagtaactttgattattcagttattcctacttattttttcttcttctactttgtaagtctgctagtataaaatcccatctaagcagatctatgttctacttttttaaagtaccccagttttataagatagataatttggagatggaaaagttcactcctcctaaaatcttaagtcaattgttattcttaaacttcatttctgatgtattgatccaaccacttaagttcacattaagatggtatgttagtaacctaatttgatcattattataatggtgattatgaattgagaggtatcatgtgcctgacattctatgtataatctcatttaattctcataatgactctctaaggtaaatattatattttgatttcataaatgaagcaacctgccacctgagagcctttcaataacatgtcacacagttgctgagggcatgagcccaaatttgggtcctgtcttttctttctgccatatttcctctcataataattatattaactattatcatagactgtttagcatctgttcttttagacaatttacttcttctttaatgactttgaaaaaagattgatttagcatcttggaattaagtggttagcatagtgccttgcacatagttatctgtaaatattggctgaattgaattgattcgagatcggaaatgatctgttttttaaagtgtaattatacatgcttatgcataaatccaaaatcacacatatgtgtatctattcattttaaaaagtttgtcaaaatatataccaaaatattatttattgttacctctgagtaataagagaactggtgatttttttagttgtctgtataatttttctataatgaacatgtatttttttgtatacctttaaaaagttttaaaatggggaaaataaagtttatttctcctgtaattacacacctaagtgtatatctaaatatataaatctaaataaataattacatatctaaataatttctaaatgtaatcacattaccgatgagtatcatagcaaatatggtaaattgcatttataagtgaattttgttaactttttaaatttaaaatggttggttttgctccctcttggacccagtatttagtttcatagtcctgtctttgagcccaaagctaacctccattagcagataatatatttttaatttgacctcaacaattctgctttatagtctttttttttttttttttttttttttttttttttgagacagagtctcactccgtcgcccaggctggagtgcagtggtgcaatctcggctcactgcaacctccgcctcccaggttgaagcgattctcctgcctcagccgtctgagtagctgggactacaggcacatgccaacatgcctggctaatttttgtatttttagtagagatggggtttcaccatattggccaggatggtctcgaactcctgtccttgtgatctgcccacctcggcctcccaaagtgctggtattacaggcatgagccaccgcacctgacctataatcatttttttccttccaatttgattataagtttagtaaatgtattcttccggaataaacagacatttgttcaacaaatgtttttgaactagaccctggaattacagagatatataagataaacagtgtttctgcccatgtattacttacttttttatttaagggtcacagactcaaatgcctacagcagccaggctggtaataaaagtaagtcaagtggactagatgtaagatgaacaaatgaaagctgacacttggctcactgttggggagacaattggctggtgtagggagacgaagggactatgggagattataaagagtatgttgctactatttagcagcgactgatggttaccatcaaggaacatgtggccagggttagcagatgttccatgttttcaagagaagctctctgtttttaaatgttgtcagctagttcaaatttaaaaccttctggccagaaaaaaagaaaatgtctgcagtttaccttcaacttaacagtaatcagattttggaatttgggtttggaggtagactattaaaataaaataaaataaaataaaataaatttcaaataatttttcagaatgtctgaactgtctcttaaggatatgccaagtaaatttgaaagtgaaggcaccttgatcaaggctcaaaggtcagaccactaagtagagacagacagtaagcagcagttataatgggttaggaacacagagactgcattaagaaagaggggccaggcgcggtggctcatgcctgtaatcccagcactttgggaggccgaggcgggcagatcatgaggtcaggagatcgagaccatcctggccaacatggtgaaaccccgtctctactaaaaatataaaaattagctggacgtggtggtgcatgcctgtaatcccagctgctcaggaggctgaggggagaatcacttgaacccgggaggtggaggttgcagtgagctgagatcacgccactgcactccagcctggtgacagagcaagactccgtctcaaaaaagaaaaaagaaagaggtaagagagaaaggacaaaattttatggaagactaggcacagaaagaaccatccaaaggtcttaaatacccatctgtgccaggcccaacggtatctccagcacataatggcccacaggttaacttgtactcatgccattaacttgttcaattgagcctgaacatgactatttttatctccctgcaaattgtgtaccttctactaggggcctaaaaataggccttacattgtttaattaaaagaagatgatttgtaaaataatctgccttggtaggggttccccccccaccttttatcgtattcattaaatctcagtatgtggtaggcattatgatgtaggggctgaattgcaaagaaaaattaggcttgaactcccttagcacatagccccacaccaataaatttactgtaatacccacttcagtctcagaggaataggttgtctctttagcttgaggttcactagtctccctttcctgttgatcatttctcttcctgtgtttgcagaagtgttgctccatcactcattaccctttattcttttgttctttgaactcgccctatgtgctttccccaatctctatgcatacttatatcactgtccttcactgcttaacatcttgaaaaactagtcctcaacttgctgcaagtcaggctttccataaccattcactacccaccaaataccactgaaaatgctctcaataaggtcacaaattacctgattttcaaaagcaatgggtattttttagtctttgtcttattacgtctctcataacagttaatgctgttgtccacttcctttgtttgtgtactaccacacactcctagatgtcctttgacctctcttctttctttgcagtctgatttgctagctcctgtccttgtccacatttaattgctggtgttccctaaagtaatcttttggtcccaatcctcacttcacattgctccctgagtaatcttatcctctcccttggcttctgtttgcgtagattcccaaatctatgtatctttagccccaacctttcttctgaacccggtcatatttatctacttgcttactggacctctctgcctgagtttctcactggtatctcaaactcatagctaaagttgaatttatgatcttcattcccatgcccttcgaccttttcattatccttctatcactttctctgcaaacagtaccactgtctgtttagttcctaaagccagaaacttaggagttaccctagattccttctttacctgtagaagtcataatcaccacatctgtagattttacctcctgttaaatatcttttatttatttcccccattctgttcccacaccaccatcttagtgcagacccttaaaattattttaactattaataagctattaaaatatctcatctctctgtttctagtcagattttcttcagtttctcttccacgtggttaacagagggattggtgtaaaacacaaatataatcttgtcattcccctcatataaaactttcagtgattctctgttgcctgcatggtaaaaaccaaattttacctccacagagtctctgtgtagtgtattttaaatctgttcccctgttacactgcatgcttaatcatactaaattctttattcttgcctgattatactgcaccatttcttggcatatctccatggcttggcagatgctgttccttttgtgaggaatgctcttcctcatctttgttaccatggcgagctttacttatccttgaagaccagcttaagcatcatctctgtgaagaccttccaggcagagttcgtcattttctcctttgtgccatttttccttctctgttgttaatacttttgacatttgctatgttgtaactctttatttgttgaacttacattctagacactgagtttcctttaggtcggagatcatgtcctactcatctttggatccccagtgcttaacagatagcaggtgccccataaatgtttaataaaagagcaaatgcttgtgctctctataaattcaggctggtgaatacagggtcccatttaaaggagtaatttcagtacactatgataagtgccctaagaagaaatgtgccggtgctatggcaacctggaagagggaatgcttgggcggtgtggaggagatcagagaaagtcttcacagaagaggacagagaaataggaagtagccttgaatgtatagaaaagagactggtttaatgtgtgaggaatctttaggagacaagtttggaaaagacagcagaggccagaaaacgagccctttaggcccctgttttggaatttgagcttagtttttaggggaagacgttagagattttatccaggaaggttgtaaaatcctatttttgctttacaaagatattttgggcagttgtgtggaataagaaatggaggagtgtgagactgtatggacaccaagacgaagccactagttgagtcttctaaaagttacagcatttgactagaaggaaaaggattttcacagagaagggggaatggtctctgggtagaatctggttcttgacattctttgttcttggtaaaagagcaaaaacgtattgcttttattttagagtgtggtagaacccacatttgtgtaactgtctatgttattaccagtgcagttctgactttgcacagtgctgctgtggttggtttcctctgttcatagtgccctctagcatcctgataaaatagtggtgaaatatttctcgcaactttttgactgaatgctgaattgtttcatttaggcagcattttcatataactgcatggataattactatgcaaggaacaaatatatttgtgtgtttcctttttattttagaaccacccagaaaatcttttgtttgcactagcagctcaccttaacatccaagtgcagtcagttttccgtttactactttcccagtatcaaataggatattttatggtgtatttgaaaacagacttaaaagtagctagaaacactgcttcaatgcttctcactgtgaggatttcgtatttcatttgtctcaccttctctacccctaatttttgggtattttatcctgttaacagaagttcatgtgattttaaaactcttggctataccctttatctactttgaaagcaaactatgtcttaagtcacctttgtaacccacactgcctgtcatagagttagcacataaggtttgttccagtgaaagaggagttgacacgattttcataaaattgccgggggcttttactgttaactggcttccagagagattttctacataagagaacagttatttagtattctgtttacttctgtttaacctattttggcttttcataacctttgcatttttaaactcttttaatttttcgccattttgtgtctttttaaattattgttattttgtctttaagtatattcatttaaacatttattcatatctcaatttagagtttcctaattgtaatgagtatttcttttctggatccactaaacctccttgtttgttaaaaataagctttatcagtaatgcttacaatgatagcatcacctactatctgtaagttactttgtgtgggtttagatctgtgatcctttgccttcagtcgctttgtgtctgaccatgtcattaagaaaatgtttgaccttcatgaatattaagaatacctatatacactgaacactcatttcttctgctcgtactttttaaggattccttcatttatctaaagcactacatcttggggaggcactgatgccaagagagagcatatcagacttattcagagggcttaccccaccctcattcaataattctaataggattctatccagcacccactgagaattattacagagagaccacagttaccaataggttttaagattgaaaatgactagtttcaacatcatttaatatactcattagcccatgtttccttttgcacaaatttcaccagtttgctatattatttgaaagtagggcttcctttcatttatccccataccacttattttcggtgtcgtgagaaggaccctctagttcaggtatttgaaaatgtaacagtaaactctatcctagaatatatttatcctgtccgtatcctccatgattttatactctgatcatatatacccacttttcttacctattttcctttccaccatccctttcagttccccagtcattttaattacctttttctgaatcttctccagctctattttgtcttttttgaggtaagtgatctgaattacagatgtagattttactatggctttatacgtggataagattgtatgttatgttgtgtttcctacagttgcctttcagatgacattttaacaacattctgttaaagaccttaagtaaattttctcaattcttatcttttgattaaatattctgtttaccttgaaattgtacctgaagaaaatgaaatactgctaaacaaagctgccagttattgcttagtatcttccttaaaggtgtttagaaatcactaaaaacattactgcagtgcaagtgtcccttgcaaaagttgtgtgtgtctgctcatcttaagagagacatcacctgaccctgttggcaggataatactttcagagagcctgaaccaaacttttcattaggcttccttttttttttaaactaagataattctaaaatgatcattttacccactcttctcagagaaaaagaatgattgtttacttcttggtagatacttttcatactttgcatatattaacttgtgaggtagatagttactattctgtttctacagattagaaaactaggataaagctgcaaaatatcttacccaaggtcaaccaattagtaattggtagagccagtattgaaatccagccagtctaactcctgggtctaccttcgtaatgggcttcatgtgcttatatatggttgccgactttttattttaaaaaagcagtaagttatcacctatgctatttgctaatattcttccttaagttttctttatttcttacttccttttcctccaattccaacaaagaatgagagagagattttacattatgtgccatattgctaaagtcccaatctgactttcactctctctagtttcttatcatttctccaaaactggatttttaaatagtaagatctgagatcagaaacttaaagcgtgacccttaccaaaggcctggcagtcacagaggccccacttttgccataaagtgtgttcagaacagctctgctttagtttctggtacctcaaaaaaggctcttagtccccagaacctatgggaaaatttgtaagtagttcagtataaccactaccacattttgaaattctctcagtttaaaggtttactgccatagtgtgtgtcttcaatcttcttgtgttggtgagtggttgatgatgatggtgaagacccaaggattcctatctaaaaccctattctgtttttgcagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaagtatagtatcaaatttcttttcacctaactatggctgtgcctttgagttggttatttcctttgtctttcattttccaagtgtttcttttctcttgtggatttggaaactttccatttaatggtgtttttagaggcagtttcatagctagtgctttagagagtgacttcaagtgatggaggaaggctaataatgcaagaaatgatattttcaacgtacttattatcttctcccaagtactaagagagctggtgtgtttaggttgtactgagaaagtgttattgcttactatttgctttcctttccataggttaagattttataaggtataaccaagaccacatatttaagttgattatttgatgctttagtctttctcagaaatctaaatgtaggttctgatcctcccccttgcataaaagcccttataagtcagtaaaataggcaacaagacacattaatatcaaaagagaagaagtctggcttcacagtgaattttaatcaaacaaacatataagactcatcttttaacagatacattagtgcaatgagtaggcaaaccagagactctgtgaagtcttctctgagtcagtgcttaacaaattaaagacactataattattctcttttatcccaagataaaccacctctcctttctcctattccctctctatcctttccatcccactcgtaaccctcaacccatgtaaattcttagtttccgcttattaggagttatttgagctatgttttttctgggttccatttgaagatttccatctgaaaattggaaaagcatgccctttccttgtgacatggtgacattgacatgctgtgttttctgcttggcatcttctggagtgtgatgtggatcatgcaataggtgttcgaggatagactatctttatctgcaaaattagatacttttaaaaaacatacattgtgccttgttgacatgcaagtaatgggttgtcagaaggtgaaagaaatgatcagttcccaattagacaggacatatatggcctgtttcttggcaaatcaggtctgagtaggtagtgttacttttagcatccccaatgccatcagccttagtaggatcttatagagtgtgtcctagaaataaagactttttgggggaaagctggcaatgactctaagcactattttcttaagactgccaccatttagatattatcaattggctatctctgacaagtatttgaagctaagatagaggaatcctgcttctttctttcccgaattatagaagtcatcattctaaattagtcttactagcttttttcattctataaactatatttccttatcagtttaatattgatatctcttgatttgagtcattaaaatacaccacttgagaaatttcatatttctaaattaaagtagcaattacattaggcatttcttacatcccagggtgtgtggacacattcaactatgatagaaaactcatgagtactcatacatggttgatatctttgtatctcaatatgtattgttagttttgtttagtagataacttctataatggtaatggtcatatatgtagcaagcgccagaatgctactataacaataggaaaatagaattatgttacattgtggaagtgatgttagatttcaggaagtaccttctgttgaaatcaacagccatgattagtattgttactgtcttggctctctgtcatggaaagtttctgtacttaagccttacatccctaattataatattcagcctttggactttgcttataatattcataggaatggtatgtttttgtagtcagaatagtcatcattgtgaaattttgttgtatttcttaaacactgctcattataagtataaatgtgtgtttttcaagtagcatcacatcttcccccttcggatagatttgcatctgtttttctcttaaattttccttttttaaagtgaaaaagtgtggtgagatatttaatgttactttaaaatatttgtgcaaatgatctctatggaagtggtggtaaataaagtactctgcaagcaggagtaccctttgtactctgtggagcgatccatagagctcaaagaacttgtttcctaaaaacagttgtaaaaaattttttaccaatcaagcttataaagtcagcatctgaaaggattgcttactcccctacacctgaataccattcaccagtcagagttcccaagatctcagtctgcttttcttgtgatgcatttattcacaacagttgctactattggcagaagcagagaacttactcttcatccagttggctctagtcccattgtcaaaactttaagtggattctgattaatgcaccaaggtaacctgtaatcctttactggaatctgaaaccaagaattgtatggagcttacattcaggctatgggagacagttaatatcacaacaaagctttttgtgtcaaaataaatgtatttaatggactggaaatggctttctgcaattagcacacttagagaaaatatactcatagaattgagttacatgccacataaatttttggtgtatgtctagccaggtttgttgaaagttttcagataaactttagtcctgtgtcaaagggaaaccaaatttctaaattctaacctttatacctgtttctttaatgcctctgagaatggaggtcccttgactgtaaaggtgatataactggctggtatggtttatacattattctagacatcaactgaaagatgtgtgtctaatgacatttggctccttttagatgagtggctttcacagggtgcataggcatctagaggcccaaagaggtatctttaaaaggctgctttgtggagggataggaggaacagatggtcaaaagtgagcagaaccctagggagcctccttgcacacttaacacaccacaccagttcataatcagatcgaaaagcttaaaaccattgtactaataaactcaggggtgtttccttcttgaccatatttttctcagctgtagctatgccaccagctgtataaacagtttcttcagcacaaggcaagatactttttcttttatttgtcaagattttgctatgctgcttcagtcaagtctttttatagttgtctcattatattgggctttataaatttatttatttttaatattaaatatttattgaagtaagtgacccagaaaccaggacatgaagatttttctctttgcccaatttgggctgtgatgatgtatttatgtaaaatagcatttctgggaactagaacctgttactgtaagcagtcataaaacgtatctaaattcagagttctaaaagaccagaggtaaaagaggccagtatattagcttaactacagtactgagttttgctccagtgtttatttgctatggattcacaatcgtcagttttctatatcctttatgtcaaggttattactcttaatcaaacggcctgacatgggaaacatttaaaaagcactataatttaaaaaggcattttgaggtcttttttgttttattgcctagatgcaatttggtattcctgtatgtatatatattcagtatgtataaatttatgtggctaatacatggtagatacatagtaaatatcagataagtaaatgaaagaatgacaccatattacactggttctttctattgcaaatgtaatgtgaaaacctgaattaggttgtgctttcataatttaccctatttcttttatggagaatcagtgtatcatttatatggtaattcttaaattacttgagacattttcagaaactggtatctcttcaaaatatatctgaatttaaagcacacgccacaaaaccacctatttgttgcatggtttttttagttaatgaagattacacatgcatctccatagtaaggatttgactgaatagagtaacttacctcctggatcatctgaggccttctgtgttgcctatttctccacaagtggctccctaacgctagtaataatagctggtatttattgagtgcttaatatgtgccaggcacttttctaagaactagacaaatattatataatcttcacaacaatcctttgaggtataattaatctcattttatagatgagaaaactaaaggcaatgaatcgagtaatttgtccagggcaaacagttcgttaagtggtcaggcagcctgactctagagcttgcggtttttgggaattttattgttgttttttgaggtaggcaaagcaagttttattgtgctcttcattctgcctttttactttggggataaaatatgtaacatcaaatttgccattttaatcagctttaagtgaacaaatttgtagcattaagtacatttacactgttatgcaaccatcaccactatctctcttcagaactttttccttgtccccaatgaaactctgtacacattcccctccttctagctcctggtaagcaccattttactttctgtctctatggaatctaagaatctctataaatggaatcatatacaatatttctccttttgttattggctagtgtcacttagaataatgtctttaagattcgttcatgttgtggcacatgtcaaagtttcagctgaataatattccatgtgtgtatatacattacatatacaccttttggttgttgtgaataatgctggtgaacatgtgtctaccgatatctgtcaagtccctgctttctgctctcttgcgtatatacccagaagtgttgtatcacatggtaggtagttcttgtgtttaattttgttgccagcctgccatattttacatagcagctgcaccattttatattcccaccagcagtgtacaagggttcccttttctccacatcctcacaacacttattattttctggggttgcttgtctttgggatttttagtaatagccatcctaatgggtgtgaagtcagagcttattttaacttctactatattctgtttcaaagccaatcaaagagagaaataagtttgcccttcagatagcttccctgttctcagagcatctattatttttctttgatataaccaaaacagaaaacaaaagaaagaaaatgtatctgtgtataccccgatattcctgaaaacagaaaaatccatttgattcattctaaattggtaaatattcacatacatctgtcaggtagttctggtcctatcttcataatacattctgaatctaattaccctttttatttgtcatcgctgctaccactctggtccaagctaaaatctctctctccaggatcattctcaaagccttctcactggtcttgttgcttctacctttgttcctcttcattttgttctcaaaacagctgttagtgggatccttttaatatgtaaatcagactagtcaactgttcagacgtcctcgcagtggtatacttgcaccctttcttgctatactattgccacactgacctctttactatgtgtcaggcactgcagacacactcctgcctgaggcctttctgttgactgctgttccttctgcctggaatgcctgtcctccagatagctgtcatatcgctctcattccctcaccaccttcaagtctttactcaggtatcacctgttctgtgcccttgttaacagttgctgcactcctgcctttaccactccatatcatacttcttacattgctctttttttctcacagtgctattcaccttctgacattccatataacttacttattaagtctgttttctcctccaaaaagtaagctccaagagggaagaggagtttttgtttttttgttttttggtctgtttttgttcatgtagatgtccccagaatagtgcccagcacacagtaggcagtcagtaaatttttgttgaatgaatgaattttttgagttagtcagcccctcctcagcattaggataccaagaaaattgagttccctttcctcgtcaagcttctacatctagttgaggaatgggagccagggaatagaattcaagaaaattcagatatggtaaatttccattttgttctttatattgttttttgggggagcagtgtattctgggtttttccccctggaaagttgttttagtttcattcacatataacatctcctttcccacccgcctgtccccttctttcctggtcttggcttacaaaatgccctttcctaaaaaccctgatccctttcgtaggggttgcaaattgtctagatttagcccacaagtatgttttgtttggcttgctccatgtcctattggttatttggtttgtggttttgcttgttttacacagtgttcttaaaataatttaattacttagcaacatttagaattcagatattttagatgaaaatcttgatttctaacttcttttgaaaaaatggaagttctgttaacatatcccatagatatttagatgaaaatcttgatttctaacttcttttgaaaaactggaagttctggttacatagggcctgcattctacgtgacaaccagttgatggaattgagtagctgtggtttccttcctacgaggtataagctcctttggtttgacagattatcctattcacttatgttacctgtccaactcctgtaggttgactttagagttccttttttaaccacaatgctttgaatgaatttaagccacacattgtagattgaagttaattttcatatagccgaattaagttttaatggatcttttttgttaaatgacctagtactgttgatgttggccaaaggtagcaaaaatttgaagaaagagcaaaagacttgaaatacagttcaggttttatacctgtgttcatttgtccatacctttttagtgtgtcttaatccttttgtctccaggcccatagctgttgtcagttcatataatagtcttatacaaaatttatgatgaaataccacagataagaatttagacacttcttgtcacctaattggaagtcacaagattggagtgctacaaaatgggacagaggagcagagacaaggtggaggagatcatgataaatataattacccaataaaatgtccaccacaattagtgttcttaaagcatcttaagactccaagttttggaatgaaataaaactaactccagaatttcatagcgttaagattgaaacctggactgtggcgtctcagactgtactatttgaggttgaaaggtgtcaggtatttgttccaccaaaagtaatctattttatgaaatctcacgtctttgttgtcacaatggctattatttgttttctcttcctttctgggtagggaaactacatgagactctggtttgaagtggggagcgggagaagagacagtgttcatctgccttctgccacagcacactggcatttttcccataagagagtgctacgctatacttcagtgccctaacttgtgttttctgtggcttttgtttacattcttccgaatatccaggggaaaaatgtctttttaaaggaaaaaatgaaacccaaatccctagactgactttggagggttggaatgttttactctatggcaaaaaatgagttcttactctgtaagaatgaatttctgccttctgcttttatactcagatagcaagaattgtgttactttagtagctaatttcagagcaaaccattatatcattttagcagccaggggacttgaggttaccttatgtaaaacagacttaatttccaccaagctcttaagagaaccaagaaaaccatcaaactgtgtcctaatctgggaattcatatagtgactttgtatgctgtggtgcccacaataagcccacagcttaccagtgtgtcctcctgatttcatttttttccctgaagcatgtgatcatgtgtgcaaatgtcattatatcctaaaagtgcctacaggcctgatttttcaaattacagctccattgaatttgaggagagaagccatctctcaagaggcaaataagcatgatctacatagttaatacatctaccttcccttatactttcttctaaggcctgattttctttgcttgggaagtggtatgtatctataataagcacctttattcatttataagactagttgtttttctaatttaacaggtggcagaagagaaaccagtgaaaagagatgtcttgttatatgcctgagcaaataatggatgggtggtggaattgtattttcagtgtggcatctggatacgtctccatagttctcagaagccttgtctgggtcttctttgttcttgacttttaggaaatacgatgacccattcagcatttttgttgatggcctctaactggaggcctttttctcttcttttaggagcacctgataaaagaggaaatagcacacaatgagtgtctaaagcaggcactctagacacacacacacacacacacacacacacacacacacacacacacacacagatttattagttggtctaaggtgaggcccaagcttttttttttttttttttttttttgagacggagtctcgctctgtcacccaagcttttttcaaagtttctcaagtgattctaatgtacagccaaggctagaaataaatgacaaggctatgggttttcaggttgccccagaacctttgaaagtaccttaagagaaaacaagtgggtaggggacaaataaagggactctacgcccctatctacttggctattcccatccccttcttgcctgagcagttcacttttgtctattttatatattgggtttctaatgggggaaaagttttaaacatgactctagatgtaggtcttacgcaagaatggcaagataggttttgaatcaggttttcgaggatggtgagcactgagtccttccataagaattggtatgtcatgcagcctctgaggaaggtagaaaagaaaagtaaatctaatagtaatagataacagtacgtagtaagcaagcctttaccccagatgagaaaagccctagtcagtaaagaacttgcccaaccgaaagtctcaaagacgggttgcaagctggctaccagaagatttaattaatcactgtgtctttgtcttggccagtatctttttttttttttaatttaaactgggcaccgttttccagttgatctcaatctcccaacactccacattgtgtatatttgaccctctcactcacttgcttatcttaaaggcgtggcttctgaaagcgtttatgttcatagaccctagaaagcaatttattagcaattgctatttgcagggatatttaatttgatcattaaaaacaaactatctgctaggcgccatggcttatggctctaatcccagcacttcaggagctgaggcaggaggaacacttgagctcaggagtttgagaccagccaggccaacatggtgaaaccccgtctctactaaaaatacaaaaattagccaggcgtggtgacacgtgcctgtaatcccagccaccctggaggttgaggcaggagaatcacttgaacccaggaagcagaggttgcagtgagccgagattgtgcgactgcactccaacgtgggtgacagagcgagactccgtcaaaacaaacaaacaaaaacaaaaaaacagtatgtacttggctggtacaagatactgtgatctcttgtctgcttctccagaaaaatgtttgttgtggatatttaggagccattgaaagagttatcttttatttcctgtcctcaaaaaaaaaaaaaaaagtatggcttttctctaagagaatagtttgtttggtattataacctcatacaaagtttatgcaaagtattcattttaagtactgtattaaatctatttccagatagccaggatgatatacctgtctcttggtaggctagatttcatccctttttttgtctaggccagatcaaacctaattaaaattgttcttctgctttatcttttattatttaaacactcattgccctctgtggtctcactaatggactaatttcctgagattataaattggcatgctttcatttccagattgtagcctctctgtcatcatttttccaattttttttgatgtttgttttatgctgtatcacaaaatggatttcctcatttcttcttccctgaaatcatgtgtccccttagaattaatggataagctgtgcatccacggatatcctaacggcactaatcaaattttgtatttttaaaaagcaaccatgcctctaaaaaaaaaaaaagttggcaagacagttttcgttttttaaaaaaagtatagcccatttcccaaagcaaattagtggaaaagtccagttttaaaaattcctatatcagttctataccataaaattgaaattattgccaattttttggctattatactctttcttattatcacttaaaagttggaccagaaaagtatagaaagagcataattttaaaacatacagcataacttttttttctttttgtagcattaatcttatcactggtcatttagaggaaccaatgccaaaccccatagatgaaatgacagaagaacaaaaagaatatgaagccatgaaacttgtcaacatgcttgataaactttccaggtattgtattcccatccattttttgcttggtttctaaaaatggtctatttctttgtctctctcactgagagttaccatagaacagcaactctggaaatccatgttgattggaatagggtggcccaggcagcagtagttcagatagctcttggctaccatggtttttctacatgtgccgcttctggatgtgcattcctaaacatttaaactctcaaagctaagatagtaactaccagagcactgtaataattaaccaactaacctccctgtcttcaaaaagatgctgtgagttagattcagtgattttgctgctgcttgtatttttgttttagcctgttttagtttttgtttcaaatcatgatgcttttattttttcatttttgatgtgtaagtttgcaattacgcctttttgggttgctgctgaaaccaagaattctaaaatgtcatgcacccaataagaaaaagtgaaaagaaatagctcacatgaaggattttctgaaaacagggacttgtattaattaggagttctaaaaaaaaaaaaaaaaaaaaaaaaaaaccaaaaaactccccttcccctcttgcttctcacctccttccccttcaaaaataaccagttttgaaataattaaatcaagtatatactaatcagcaactagtcatcttggaggagttattagaaaataattcctttcatacttggctgagtcactctattttctagtcatacattgagtcactatcttctttaagccatcttgaatgaatgcttctgtgtgttggtggcagctgccacttaaagatgcatttcttctggccatcccctttttcacagtaactgtgtaaaggctagtatccctcagtcaaaagaaggagccattggaatggaaaagccagagagccaaccatgaaagggaaaggtggaacacagaaacgagcagagattaagggcacagcagaggcttaggggtagaaatggacaagaacaagagactgacatggggagtgtgacaagtatggatatttatccacgctgcagagtatgatgctggtagtgtggtagaagttgtttaggagtaaatagcttaattatctacaaagctaataagactagaactcagtaacttccagctagcccttttaaattttcatcctttctcaaggttagaatttacagctaactgactatattcacaatcttcaaaagacattgttgcctctttgcaaattacattctccatacctttgtatagaacagaaatgttccctcccagaagggattaatagtcacagagaagataccgatagggcaaacctataggaggcagaataagatcaaaatgaatatataaagataagatgtgtgcttggccacttccaggaggagctgatgtagctaatgaaacacaggggtataaaaacaacaggataagaaccaacagagtcaggccgggcacagtggcttatgcctgtaatcccagcacattgggaggctgaggcaggtggatcacctgaggtcgggagtttgagaccagcctgaccaacatggagaaaccctgtctctactgaaaatacaaatttagccgggtgtggtggcacatgcctgtaatcccagctactcaggaggctgaggcaggagaatcgcttgaacctgggaggcggaggttgcggtgaaccaaggtcgcaccattgcactccagcctggtcaaacaagagcaaaactctgtctcaaaaaaaaaaaaaaaaacaaacccgacagagtccatctggtagaaactggagaggaaaggttagcaaggacctgagtagaacacattagtgtgttaggacagtaaaccagttgcataaatttcatattctgaccaacaacatgagtttttaaagtttaacacaaatgccatttaactgggccatctaccctggatgagtaaactccaggtagggaaatggaagacaggggaaataactgcctaagactacacagtataatccagatacttggcttactaatagaggaactaccatttcataaggcatctctatcacaggcacagaaaacaaaggtgctaggtccttctccttttaatctcaggggaatccacatattctagaagctgccaacaaataaatatacaaacgtcaagtctgaaataccccagcttccacctgatttaaactatgcctcaaagaagatgcctacttatccggaagtacccagcagatgcccaactgaaggtgacactgatttttgcatgtttaaagcagagcaaatatgtcttatgttggctttgatggtatcaattttgccattaaagttgaagcaaaaggcaaccttgagaatagttcaaatcatacagaatttttgcatgacgtgtgttgggcgttttacattgtctgcctttgtgtgctttctaacatttgctctcactaaatacaatcaatgacaaaactgtataaagatcagcagtgggcattccaaagcagtaatgcaaagaatgaagtcattctttatgcgtcttacatgtcttttgtgctgtgttcctcattagtcttaagtttcttctctctttccacttttttttgaggtaaaaaaagatgccataaagccaaaatagactaaactcagtacaattcagggaacatttactaagcagctactctgtgcaaggcatcgtgctaggaacctgaggaagattcagaggagaatgtgacagtctctgcctttggaaaactcacattctagtggaagaaatgactgtaatctagtctagaatacaaggtagaaggaaataatgacaaaatgagttctatgttgaaatgtaagcatgcaggaaaaggagtagttcattctgtctggatgattcagggactgtttcacaggaaagctagcatttgtgctgatcctagaattttgatgtatttaatagaaaaatggaaaaatgaccattcattccaggtggagagaaatttaatcttgttaataagtcttggatagtcacatactacttatttcttctaaagagctcaggttgttttatcattatttgattagtacgttatcagatttatcattgggggaagcaagtaccaaagaattgcccaaagcatttccaagctaatgactgatgataattcatttccttttaacagtttataaaacactttcacatacatcctctttctagtttcattttaaaaagtgagactagaccttcattttccagaactcaagacgtttgctctgtccactgtactacggtgtctgtctgttatagtaagtgtttgccagaacacttcctcatcaccctgtcagcattgtactattggttagttccctccctttcactctaggacgttctgcattcaaccaagtcgttattgtgctaagagtgtaccatagctttgtctgattaactttccttctcaaaaatgaaatggttttctcctgcacctgaattgaaaggcatgtgagtaaaggatagggttggaggtgatgtggccaatgaatggacactagacacttccttttttccatccataggagagcagatgtgaaggacctgcaccaggatggtggttagcaacagtggcccgtgccaaagcacttaccaaagtgatgatgactaaggttggtcatgccaagtactgttactgagcctggtgtagggtatagatgttattcactaccaaaattgtaaaaccaccaatgtaaaagttaaaattacatttctattttgcctccatgctggacatagccgctgcctcaaggagctcatcaccttagcagctttctctcaactagatttccaaagatattggagagattagtgctcagatattttcttcccattgaataccagctgacttaagagtattccaagtgattttttttttttagtataaggattatatttgtgatagatgtagataaggtgattggcagtgcacctggaggtctaaagagttggaaaagaatctgaaccctataaatcccatcatgtctagctagtacagtgccttgtaccctgtggtttccacagtatgtgatgatgaaataatgaaaatagctgatccccaaatttgaagggcagttttttgctttaaaatacctacatggcttaagactttaaagtacactctgtcagttccattttttggccagatgtcataaaattcagggccagaaaggaattccataaagtactttgagccatgactggcttatttaaatattggggtccataattcctttaatatagaatgataactgtaatatttatcaaatataaacatttaaggcctgaggcatgaaattatagaaagcctcatttgacattttttaatgtgagggcagagatggaaaagcggatgaaatttgcctgcctcttcacctcctctttccttccctgacttcggaaaaaataagcccctgcaactcaagcaggagatctgaatgggaattgtgtagtaaaagcaagcccactgtgcctaatacaatttcatttgccttagctattgcacacaacttgtatataatagtggtgcctcctctagaaaaggggagagagcattgactggcttaagcttaaactaaccaagggaaataatatttcaagttacagttttgttttgacttctctaatcccctttagtttctacattggaaccagagctaattaatcctctactcacccttaccccatcactgtctaacaagatacattgcctttttacttatatattctgccatcaaaatctatgttttaaaatttatatttatataaattaaagataattgttctaccatttcttccttttcttactccttagccaataagtgttttgttttttttgttgttgccagtcattgtgtactatttggaacatgacttttataataaatgcaggcaccagatataggattagttccctttaatcaaaagattaattttaaactgactaaggctgagataggtagtttataactgaaaaataacaaatacatagttttttcttaaaaataagttattttactctccttacaaaaatatcaacgactgtgattatacctacctttgtgataagttagttaaggaaatgcttttcaggtacatttcataaacatgatctaatttttagagcattgtaagatctattatagatatgaaaatataaagatcttgttttcatcagaatattctttagactaccctgtccagagtatggtaaccacagctatatatgactgttgagcacttgaaatgtggttagtccaaattgggatgtcctatcagtgtaaaatactcactagatttcagagacttggcacaaaaaaagtaaaatatctcattatttgtttaatataggttacatatggaaatgataatatttttgatacactgggttaaaatattaaaattaattttacctattctttttcaatgtggctactagaacatttaagagtacatacacttggcttacattgtggcttacattatatttttattagacagtgctgttctacctcattaaaatatactgtaaggttgcttggaaattgaattaagaggacttggatccagctaaattaaacaccttaaggtgtcaggggaggattaacttgagaagcttgatattatctatccttaggttatataggacctttccagtagctagacacctttaagtaggacgtcatgctacctttgtattgcctatctgtagtcattgttctttagatctgtagtgggactaactactttgagctcttggttaaagtactctctgaaatggtttttgactagtagaggaacatcaaataagaatcatctccactggctgtttgttctcttagttctcctcattctttaacttttaatccttccttattgggaagagcgttaagaacttctgtttctactactttattctacagtgtcagttggcatgctgacctattaatatttattttgttaatttggacaacagataagaaaaattctgtaaataaattaccaagaaataatttttaaaaccacttaaagataaaactgcactttattcttctagtactatacctgatctctttttctctatattttcttaaccatgctgtttactgtgggtaaattaggtgggtagcagatttttagaagctttgcatgtgatctaacagaaatgtgaacagtgatttaaaaaaaactaatatttatatagtgctttaaggtataaaaaatgcttccatatacgttatctccattgattattaaaacagccctgtgaattaaatagcgtcaggtatttttttaaggattaaatgcaccaaagattaagtaactaacccaagtccagttttcagtcttgagactccagattgtgtgctattgtgagaaattaccaacagctctcaaaagttgtctgattatttttaaataagacattctaaattttaaataaatgaaaagcacgaaagacagataataagcatatttactttagaagagaactaagatttagaggacatgcattactgctttttcattccacagttgagctcttcgtaggtatcaggtcaaatactaaataaatagcttatattttaaaacacaaaacaaagcaaagctttttgaagggaacaagtaaaatttctatgattctatgttaatacaaggtttttaaattgttttaaaaagagaatgattatggctcttctgacaaattttcatacatgtgatcacattaataaaacctaacttaaaaaaggcttccctatgggactatttaccaaagttgctcaacccgcagcccaggacgcttttgaatgcggcccaacacaagttaataaactttcttgaaacattatgagatgtttttgcaattttttttaagctcaccagccatcattagtgttaagtgtattttatgtgacgcaagacaattcttcttccagtgtggcccaggaaagccaaacaattggacatccctggtttagacaattcccaattacctttataaagtggaaagacatggtgatgtggggactgtacaccatatcaatttgtcttgggtaacaatatttttatgttgcatattttactttcccaattgtacccaatcccaaagcacaatgatgagggctgagggaaggatctcagaatcctttcaaagatgtagcctagacctcaaatttgctatggaaaagctaccataccactcattcctaccaagttagtggcttaatgaaagatcggtgtaaccagtcagctctaggaagtcattagatgaaagatgaaggatcagggttcaagcctaaaggacactttcacagtatctaactgaacatgtttaccagtccaaaggttataatattattgctgtgagaaaaaaagaggtgaaaacatttataagaatatcacaagttattgggaaacccgttatacttcagtggattatgaactatccatgatactgaaatcttgatataagatgcacgcccagactttaaaagaactacagagcttccttctcagggctatcacaggctccatccattttaacaggcattttttgaaaagctctatgttaattaaaatgctttatttatatactaatttctcatcccatctttcaaatgtgaaaaggaattaaatatgaaatggctaatttaaactgtcaggattcttttttccaagtcaaccttacattaagagcaggaatcctgtgcttaagaaatggttcccaattatcctgtcttgggttttgttatacattgtacagaagtcaacaaaacaagtatgtaacagaacctgcctaaatagcagccgccctcattaaaaacagagaattaatcagggggtgattgaaggaagcaatgcctcatgttcccccccccttttcttcttttctaatcatagaacaaaatatgttacataaaaggatcggaactattatgcagtactcaattagagggaggtgaataggtctctaacatgctgttttatcaaaagagcagactggtgtttgcatgactgttgtttcattacagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtataggtaaattcgaagggactcttgggagatctgcaagtgggaaacaagaatgcattttaccaactgcttaattatgtcctgtttttcaacaagtacacttgaattgaatgttttgtttgtattgcacaaaaacatgtgctgtgggcaagagtattctcttgctttcaggtcaagtaaagtgttttatacacatacacgtctgacctattctatattgtgcgattgggtatgttagtatctgaaccccaattttgcactgtcatttttgggggaaagagtcatataggaaccagaagccctaaaaagcagaaccttctctaaggtgctgagaagtcatataagcccaggcatcctagagtataccatacttacaggcaaacggtggctcaggaaaatgttaaaatatatctggaaaaaaaaaacagaccagaatattttaaatatggtgtaaattccgtatctcccatccctagctctttaagaaattatttttttggtttccattagcagtcccaagggttaggctggggcaaaatagggtttcctttcttggacgtgctttatctgtgtcctcttgcctggccaagcccttgtagattatggttccttatcgtttagtaagatcaaatttctaaatgatgtttcgttccagttgaacattcttggaggcttatctcttccctggccagatgcctgatcagatgagaagcccgccatgatactgtcacagtgcctagaatgggctctttatccagtagacaccactgtactttttgatacgagggcagtcttaacttgtgttaaggcctgtgtgtagcattgaaggtaagtatgaaggagttgttgctatgtgaatatcttaatcctgatacacatttcaatatacagtatctccgttttaccatgatatacatgtatctgacacatagccatcctttttagataggaccttcataatttaggatcagtaactctttatgaaatggcctgtttattgagggccatgattgaatttggatccttttttgtagcacttgccattgctttggttttcctttgtaatcattttaatcatatgctggtagtcttgcagaaagggcttgtggtcttggtgtatgtctgtgacaatttggtaggatgctgtgtttgactcttaggtttagaatatctgcattagaaacaaaggcttagtaataatgagtttgagtatctttaaaaacctagcagctttttaaatagatcaaaattatttcatagcccaacacttagcctcttgaaattagtatagaatattggggatcatcttgtccaaccactcactttatagatggggagactcaagcccagagaggcaagtgacctgcccaaggacacctagcaagttagtggaacatctgagactagaatctaggtcttctgatgccccatatggaagaagctcagtctataccagttagttaatggttgggaattccaggctgtctggtgaaaagggggcttgacttctgctgaactgtcagaatgtctgatgatattaattcatcaggaaaataattacagttaaaataacatgagaatgattcctgacaaatggtctcccatttatgccacgtttactgagcacctgctgtgtgctgtgttctatactagatactggcaaatcacagcctgagaagacatggactctgccctcaagttgctcacagtctagtacagaacaagaaatctctggaaagcattatacagaatttcctgtggaatgttaatcctgtttctaaccctgtaaatcttcgtgatgaaagtgaatgtgtacccagagatttagcttttctcttcatggtttagtcattaggagtcccattagacaccataccttttctcttcaggaaaatgaaagataatatcaagtacaactaaatttaattcacaaacacttattgaggatctgctatctgcaaggcactgtgctagacacatagggatatgaaaattgagtaaagcatagacattctctttttaaaatatcagagcagtagtatttcatagctctcaaactttgtaatgacagttatttttaatatccttagaagttgggggtggggggtatgctcctgaaatagaaaacaagaatacctttgtactcaagtccagacttgtcagcctaggattcaaggtctccattcaaatcctcttttataccgcatctcttttgagttgtttttttttttttcctttatctcagccgagccagcctgcttgccagtccctgcacacaactaactcttgcttctgtgcctctgcttgactaattcttctgcttctgggatgcctttctccctgtgaatccatgtccatcactgccattacagtctggcccctgagtccacctactgcaaggagcctgtggtcagcatccctgtctcctcctgtgtccctctcacatgtgcatagccatacgactggtgaaggaatatttctgtggtgttcattaaagcttcccattctctgtccacatcttgctgatctagatacaacagattgcaaatgaaatagtcccagattataaatgagacagtccaatataaccaggtcatttaccaagccttttaggagtgagtctctgtaccaaatatttcattttgatatttgtgggccactagttgaaggatagaggaagaagatgagaaaagttaggatgggggtatgagaaataagcctggggtcaattagaacaaacagtcacacatctgtaaatgatcctctccttctactcccagacaggacaagaaatctcctttaaaccaacttcaaatacagtaagggtgtattgacaaattttaaagcttaaagaaagcagggctctctgcctgttaatcatctcaagcttgttgatctgctgttctgtaactctttcaatattgtttaatgtgtgtgtgttttctgaactgactaaaagcttcttgaggacagggaccatgtcttttatttgcctctgcatattcttcccccacttaatccctaactagcatgggaaaaccttctgtaagcacttaagggacaggaacgacaatttgtgggttctaactacattccagcctaatgttatactatacactttgtatgtatagtagccttttgccctcatcacaacttagtgtgaggtatgtgttcctgtcctaattctacagagaaggaaattggaattcagtgagttcatgttcttacagctagtgactggtcgatccagaattagagcacaggtccgtctgactccaaaacctatatgtgcttttcactataccacaataacaacgaatatttgttctgtacaattcacaactctttggtctaccttattattattattattattactaccactacttacatcttcactagtcagtaggtacagccaagattatcacgacccccatttcactggtagggaaactgagactcggaagcttgcccaagatcacacagctggtaagtggaggagaaccaggacttcagacagacttcctgactccagatcttttttttctttccatgacatcacattgctgccttaattcatttgcacaatgcatgattgtatggccagtgttcactgacacctttcctacagaagtatcaatgagcccaggcattacgtagagccatgtggagaagaaaataattcataccttcagaggagcttccattttagtgggggttgatacaaagcacccagaaagtaaatgcttgagaatagttcacaagtaagaattaaaatataggcccgttgttccataatgaaatcctataatttggccataaaactaatatttttaattatttgcataattggattagggagcaagggtaaagctgatagacttatttgaaaatattacttctgggtttagatgagaaagtgctagatacttcacacaagttagtagctagccccagaatcatctttttatcaaagagatgcagtagttttagtctcaggagtgatggtatatccacccagcagtttatcactcagtcccatctgccaatcctacttttacctatccctacccttcagtccccaccccacacctgagtttaccaaccccttcagaccctcagtgtttcattcccagcaggttctccctcttctccttttgcttcagttgttaatatgtagtgtccaacatcacaaagtcctttagcacaatcagaactaggaatttatttaaaatataggtatgtaatttacgtcagtgctagagagaagttttaatggaaacgttgtttctagctctccactgaacatttctacatggttgtcatgtaggcacctcaagcccttcaagtcctaaaatatatcagaatctccccaccaaatctccatctcctatgtcctggccccattgaatagagtcaccatccacttggtcatctgagctgaaacaacaggaactctctacttactactctcattctccaaccccttttcctcccagtgagtcatgagatctacctcagaaatgttgccttttcttcccacaacctcagacttaatccagctgtctgtctcctcccccacacactattatgatgacccccctaatgacttgtctatctgccaccaattccaatgtgtctatcatgctgctgccagaggtactttcttataaaacaaacgtaatcaaacactctttatagggtaaaatctaaactccttattttggcatttaagacatttttgactattgcatcccaaactacccttgcagccttacctcctgcccctccttcattgaacctcaccattccccaaacactgggccctttcccggcttcatgagagcacagagatagaaaagatgagctgacacaatccaaaaaggtttaaaaagatagagaatcacacacgtcagtgggaccattcagagctctttacagtctcttttatctgaaatgctctgtgcccatctgcctagtgcagggccactcactgacacctcacttgacagtgccctccccaggcagcctggtcagtgcttcatctcaggagctgcctcacttctttgttcataattctcttacagcatttacctcattctgctcaaaatgacttttgcatatatttgttttccgtgctcctcaaaggcagcagctgtacccagtcttccttacctcccagtatatgacatagttcctgtcacatagtcattgaacagatgttgaagacatgaactcagtgtgctcctccaatgcagttagggcaattaatccagatgtggtgggctgcaaagatcactggactaggattcaggagacccatgtcccaggtccagctctgccactagataagtgaccttggatgagtcattcagtctcctttattaaagaagggggttggactaaatgatctctcagaccccttccaactttaagttctatgattctgaccccatttcttggattgggaaacacatttcctccctcatagtattcaggagcctcaatttagcctgtcagacgttcacatttcccaagcaaagctttcaaacacttcgaagttgtctactgagctagccagagctcttcattaggctcctgttggcttatccattgaccactgagctgttctcactcctccccaggagatttcactgtgtctgtaacaccattacactactgtgtggctgccccttcccaggagggagcccttctttctgttggcctaagggacaactgtgaggagggagtcatttcccctccatccaaatcccaccaacattatagctgctgccatgtgggtttttgcttatggacatgtttttggggggtgatgcccatttctgtgataaataagttttaagcagttcatggggctcttcaaggccactcttaagtacactgctgacctttctagggatgggaggactggagttagcaactcaacaggtacattcaccataatctccatgtaataaataagagcctatgaaaagattaaataaatctttcctaatgctttttgactggcttaatcaataattaatcatctttagatgaggctgtaacttgtggagtagatataattggattagctgaaaagcggcagttgcggagctttgaagagattaaaatggctgtcaatcccataattaaactgccacaaacaaaagcaatggtgttttttagaaaggaggaggaggaggaaagaaagagtgaaagagagagagagaaggaaagaaaagtcggggagagagttggggaaggccaactaatttgaaatgaatcaacatgtacttacatatcactagagactgaggcaaaatcaaaaccgacagatttattccattgaatgaagtgtatgcatatcaaatcagccatttaattgtatgctccaaccactggggcaggtgaaattttggcagcttcaacttgtctaaaacaaaaccaatccaccaaaaaaaaaaaaaaaggttaattattcaaaacagaagagacctgctccttgtcctgagcccatttagaccttgacttttcatacttttaattggcttagtaggtttggcctgtgtgaatgaagtcttttatctccctcttccctctttttctttccatgcccctttcatctttcctattacaaacacacagagaaagctcaagggaaaatactttggtttttaaagacttttctttttaaaaggttgtggatttgggtgggggggaggggtgtgtgtgtgatgctggtgaatacttttttttctctctcttttatctctttttctagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggc

SEQ ID NO: 38536 - DNA, 35049 bp, Homo sapiens
agccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcagcctgtgtgggtgggagtcagccttgaggagaggcgatccctagacactgccttctcctgtaagtgctcccccaaaacgtggcaaggcaggcgtcttcctatccgtgtgtgtctgagttgtgtggtgggcagatggggctcacccccaaaaaaggacccttatctgtgaatcaagaggcaaaagacacatcacaaatgtgccaaagaatcgtgccttacttttgccttgttacaaaagtatgcttgctcctgaaagacagcatctcatttcggaaccccaggatttaaacggagcattccgtctccctgatcagtaccaaatgtttgtgaaatacacttatgcattcatgtggttgtttattcattcagcaaacagaatgaatacactctgttaaacagaatttagcagaaaccgctctggggaaggcactctgtggggtcctgtggatacaagataaaggaggtaccagcccccatcctcaagggtggcgtggccgaggtgcagaggcagttgggtgacaaacgatggcagtacaaagagaaggcatgaggcagtgagtggcaagaaacacatgccctggggccagatgtctgggtgtgaatcgggctctgctgctcattagctgcgtggcttctctcaggcaagctgcttgacgtctctgaaccccagcaatctcatctgcaaaagacagagggatgcatttcttcacacaactatgtctgggtcgccactgtttaccaggtactgtcctaggctgtggggatacaggcctcacatctctgcctggggaactcaatggggggctgggggcagcaaagaataaatgagagagatctcatttattagtatgtgcagattgcaagtgctgaggaagcaataaagcaggaagggaactaggagagagaatggggtggaggaggctatcatttttggttcctcccaccccccagagatcacagatccgcagggacggagtgagccaggacgatatcagcacacagagggctcaagaaggtaatgctggcacccacagcacctgtgtgaggattgaatgtctcagtatgtagaacgtctttgcaacatagcaagctggcagtgcatcttggcagctttcaatcaaataattgtgactttgtttggtgttgcctaacagggtagcatgtaggttccttggggtagggcagggttctgtttcactaatgtgtgcccctggtgcctgccattaagttgacgcctggtacattcttgtgggtgaattatgagcggctgcagtggtagcacgggatgcgtgtgcagctcttccccaggagagtcagacagggtttttagggttggggacagtggacctgtggctttaaaggataaataggagtttgccagctggagaagagggaagggagaatgattaatgaccccaggcatagtggggtgcctgaaactgtattgagacaaatctgggcctccagggctcatattctccatgttcggcacatgctcgtggcgggagacaggaggacttcgagaagtggaaagagtagtagagtgacatgatgaggcgcttggagaagggaaagctcatgtgagatggtgtagtcacctaaggcttcctggaggaggtggagaccttgactggatcttggggaaggattaggaattaggaggaggaaggaaattcctggaagaaggctcagcatgagccgaggctcacaggcagaagtggtgcatctaagagctgcttgggagaccagacctggccagaggggaggcattgaggaggggtgagagactcttctcagattttattgactcctccatgctcttctctggtgcaacaggatgatttaaccctcaactgtagttagtagcactttggttctacaaccatagagagattgccaatatgtcatctgattttatctccaccatgtcccaagatgtcataggagccagcactgtgacatccacataggagggtcagggttgatatgcgcgggggatttgggggagtctctaaaacacaggcctgggtgggctgcaggagctgattcacttgtagccaccactggtcaggatgcaagtgctttgaattggctcctcgctgaattgaaactttccctggttatcaacagatattggcctccttcctcagcgcctagacataggtgaggtttatgcagaacaactgtgccagccaggcacggtggctcatgcctgtaatcccagcactttgggaggccgaggcgggtggatcacctgaggtcaggagttcaagaccagcctgaccaacatggtgaaaccccatctctactaaaaatacaaaattagctgggtgtggcggcaaatgcctgtaatcccagctactcagaaggctgaggtggaagaattgcttgaacccgggaggtggaggttatagtgagccgagattgtgccattgcactccagcctgggcaacaagagtgaaactctgtctcaaaaaaaaaaaaaaaaaaaaaaaaaaaaaactgtgcctcagagaaagccctgggcgaagacaggctgttcgcctgtggctcagaggacagggagggctgggaagagcacctggcctggaacttatcacagtgaaatctctaatgtgctgtgcaatcttggaccactcgctgcccttctctggtcctcagtcctcacctgggaaatgaagatggagaacctatgactttcatggccctttcgttcgacagggacttacggatgataggaagcagcccccacatgcacaaagtcgagacttccccgtgaggcaccactccctcaccctacgctgagtgagaccttcagccttggccctgaccctcaagggctatgggctcgtcagagtgaggagatgctggctgtgtgctgaactggcttgcaccccctctggagagccagttttgttccacacagccatgatcacaaactaagttatataaacttacagttaaatcatttgtattaaaaagaaaggaaagaattttttttttttaagacagagtcccgtggtgtgatcttggttcactacaacctccacctccccggctcaagtgattcttgtgcctaggcctcctgagtagttgggattacaggcatgtaccaccacgcctggctaattttttgtatttttagtagagatggggttttgctggtctcaaactcctgagctcaggtgatccgcccgcctcggcctcccaaagtgctgggattataggtgtgagccaccgcacccagccaggaaatacttcttgttagaaatgcatcactttccaattgtattgctccgttttgctattctcttggctcctggggttttatgtcttttgcatccgtgtggtatgaccaggagagaagctactccacatctcttcccactcccattcagtggcctcacgtgggttgcctgaaatcaaccatgctgggagtatttacaccttggaaattggccagggctacatgaggagagctggtggttcagtcctgaccaagcgcagggctgcctgtagcctgctctagtctctcaaagcctcgtcccccggcagagtgagttttgtgtagcggactggtctcttagagtggggccggttaatgtcctgagtgctgtttatgcttcttggtctaagcatgcagagacagtgccagagatgagcacgcttgccttccattcccgtgggaggcccttaggagaagcttctaatgagaagtgccgggtctcccgccttctatctctaagaccttcaggagtttccttctcctatctgagcctcggtttcctcatctgcagcacgggacacagtagtgcctgctttgcagggctcagtaaaaagaccatagagcccacagttccctgactggcacagaactgcattccctacatgtgcactacggacagatttaaaaacccattccaggccgggcacagtggctcacagtggctcatgcctgtaatcccagcactttgggaggccaaggcaggcagatctcctgaggtcgggagttcaaaaccagcctgaccaacatggagaaaccccgtctgtactaaaaatacaaaaaaaattagccgggcatggtggcgcatgcctgtaatcccagctactcgggaggctgaggtaggagaattgcttgaaccctgggaggcggaggttgcggtgagccgagatcgtgccattggattccagcctgggcaagaagagcgcaactccatctcaaaaaacaaaaaacaaaaagcaaaaaaaaaaaaccaaaaaccccattccagaaccaaatatttatgagaatgaataaaacagaagcagaacgtttgtaaatagtccaataacctttccatggagctcagtcggttctgtggacttggtgtttttggtttttctttcctggcattagatgaaactcctgagaacaatgatttactgagcgcttacactgtgtcagggcaagagtttgccacgtattcgctcttgggagcctctcgacaaatccaccgggtggggcccatggcagccaccatgcgggcctcggtgctatgcagcccctggcctgggcaggctggcccctactgtcagtgtgactgtgggtctgttttcccctctaagcacccctccagggcagctggaaatggtggttcagtttgcaccctgcccagagatgcctgtcctgctgaggggggctgggaggggctagagcagccaggagctggtgccactttctctttcaaatgcatcctgccagacggggggagggaggggagcattgcattgtctatctggaggcaccccctgtgctaatagcagtaggggactgtaggagccagcagtggcccacaacttgcattcctcagttccccatctcctttcccccattatttctgtgagctcttgagagccttccaaacatccttttattttttgctgagatagcaagagtgggagaagcagatggcctggagctgtgctttcaccattccatgagttctgaccttcaccttcatctttgtaccgtaagcatctgtgtctgctggcctgaaggctttctctggctgcaggagcctgctcagcccacacacagtcaggccaaggtgccggggaggtaacacctgtaggagcaaatggagctggagcccgatggcccagctggcttctcaactttggtgggacacgagtgaggagtgttccacacggtttctccaaggtccactgggtttgagctctagtgcccaggcagccacctgctcattaacactccctgaagggcgccttccctttcctgcccagcttcccactccccagctggggcttcctgggatcccctcccaaatgtactccctgcactcgaatcctgtcggatccatgctgtgggttgaactgtgtccccccaaagatatatccaacccctaacttctgatccttgtgaatgtgaccttttttggaaacaggttcattacaggtgtaattagtcaaaataagatgaagtcatgctggaggtgggtggttccttaatatgaaccccgttccttataagaaaaggagaaggggccaggcatggtggcccacgcctgtaattccagcactttgggaggccgaggtgggcggatcacccgaggtcaggagttcgagaccagcctggccaacatgctgaaaccctgtctctactaaaaatacaaacattagttgggcatggtggtgcatgcctgtaatcacagctactcaggaggctgaggcagtagaatcacttgaacctgggaggcgaggtggacgttgcagtgagccaagatcatgccattgcactccagcctgggcgacagagtgagacttcatctcaaaaaaaaaaaggaaaaggagaagagacatagaatcagagacacatggagagaaggccatgcaaagacagagggttgcagaggtcagagtgatgtatctacaagagacacatgagggaccagagaacatgagggactgccagccaccactggaagctgggagagacattgaaaggttttctccttagagcctccacaaaggaaccaaccctgccagacacctggatctcagccttctggcttccagaactgtgaaagaatccacttgtgttgttttaagcccccagcgtgtggcattttgttgcagcaccctcggacacgaatacagtctgctctgggcatcaagggagtcagcttctgttggttgcaaccggcaacgagacatttcacagataaggaaactgaggccattgcagagaatgacttatctgtgctgttttggctggggacaagtggggctatcactatatccccagagtctgggagctttgtctgctccttgaaccaggtgagctcacaccctgcgggacttcatcatcaagactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggaggggggactggaaggaatgaaaagtccatgaatagctgacttttgagggggaccttaggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaaggccacgggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggcacctctcgggaattctgcgatggcacatagagtccttgtgagtcctctgtgtccccagcaccgagaggcagcctctcagcaagtgtccgctcacggtgcccactccggctcgtgggtcatcgtagcttcacgcccatctcctccgaggcctctccctgaatgccccattatgatttcccttaaatgtttacataagagcccagctcttccttcttagcatttagctctgttgttgttattggcatgatttgtttaggtttctctctaactgcttttgcagatgaccacaaaaagcaattcgttcgccttatctgtgtgctgttgtgtgtggtgtctctgacttgtcctgaaacagccacgtgaagtcagggccaacgtcttctggttcaactcggaactccccatttccagcccagcgcccgaaacccagtgggcctgggaattatgaatttactgttgaatgaatgaatcaattatgttaaaaccttccggaacagaatagaagggatggaaagttctagaggactctcgggtgcactgactgacaatgacattgttgggaagacttggtcgactttgccgtctcgtgaatttctttctttcttttttttttttttttggcctccctctgaggaagtcccattaaccttgtgccaaattctgtccccagagcccagtgttaagggccccgggcaccaggaaatggcattcatctacgcacgctgaactctaagcccactgttccggggagcgacatatttttagatgtttgacgtccaaattccagaggaagagcaagtaatgcttagaggaaaactggctttcttcctccaccacgcaaaccagtgctggggtgcatttttattggtctggccgctaagctgctggaactttccaaagaagggtaaaagctcctgcatgtggaaggaagggggtggtgagcactgagggaggcatgtgggtagctttggtggcagctctggagattggattctttttccctaaatggaagtggtttataaattcttctactgattattaaaagaatgatgtttactgtaaaaaaaaaaaaaagtcaggcaacacagaaagttataaattagtagaaatgatctgaattcttcctccaagatgtaaactctggtgacattctggggtgtctgtctagattgtttcatgaagcagttacacacagcacacgtgttttctcttagtggtattttattcgtactgattcagatttcttttattgaaatgaaattcacatgacagacaattcaccctttcaaaggtacaattcagtggtgtttagtatactcagagtcatgcaaccgtcctaactgcctagttttggaacgttcccatcaaccctacaggaaaccctgcagccattagccgtcagtcctccttccctcttcccgcagcctctggcaactaccaatccactttctgtctttatggatctgcctgttgtagacgtttcatggaaatggaatcatccagtatgtgctatttggtgtctggcttattcacactgttttatatgttgcattttcacttaataatctgtgggaagtatgttaacatggtggatcgacatcttcctttctaaggcctgcctggtgttctctgtgccttcacttatgtatccagcctcttttggttgcacatccagcttgtttgctttaattgaatctggacttggacttgctgaattggggttcccactgctgcagcccaaaatgggcatttccccacctgcttcctagggatatcagtggcagaatggctttgcaaatctatttttgttcatctatatgaacaaaaggtcatatagtttcactcttgtcacccaggctggattgcagtggtgccgtctggctcactgcaacttctgcctgcgtggttcaaatgattctcctgcctcagcctcctgaatagctgggattataggcacccgccaccacgcctggctagtttttgtatttttagtagagacgggtttcaccatattggccaggctggtctcgaactcctgacctcaggtgatccacctgccttggcctcccaaagtgctgggattataggtgtgagccaccgcgcccggccaggaatcatttttatccaggtaaggcatacagaaccggagggttcttgtctaagttgtaccatgaatgtgtgctcagtggctactttgaaatagacttactgtacaatccctgagcaggaatgaaaataaaagctggaaatcacgggttgctctggggttttcaggaaggtgtcgtccgtctggggtgagtgtcctcctttctcagggatttcatgtggcattattttgttttcatctgagaggcaacataagctgggagggaagggctgcaaagagggggccaggacaaatgtgtacctgggggcccccattttgactccaccctgagctggggctgggccacaggagggcagagggaacactttgggagggggagagagcccctggactgaaagaatgggaagaaattgacaggcaccattgggaagcaactcccagttccaggctcctgggtcaggaacgcccatggagtaggacagacccaggttcgagtcctgcctctgactcttctcagctgcttgctcttgggcaaatgcttttagtttttttgtgcctcagtttcctcatcagtaaagtgggtttagaatagcagcagccccagagggtgatactgaagattcagtatgtgaggacccagcacagcattggcacacagtaagagcttactaaatgctgcctcccttgccataagcatgaatcacacagcccaggctctaagcctggtgtctgtgtatggtgactgtgtgcctccgtttcctcacctatgcaatggggacagcagtggtacctactggggagggctggaggcgacttcaggtggtcctccgagggcagtgctcttgcacatgctgggtggctgtttccgcatggccccttctcttaggaactctgcgagttgtttgccctggtcttatccagaaatgatgaggttatatccaatcccacttttcactgttgctggtgggtttctcgtacgtgtatctgcagcctcagctggactggagctccttaggtttcttctgcatctgctgagcatctaacctaacgctatggagatggtgggcgttcactaaatcatctgggagtgaattgagggaggatacagcggaaatgaagaaagactggaagatatgaagaatgaagttactatgggacgagaggcttctgagtccattgattaaaaataaaaggagccaggcgtggtggctgacgcttgtaatcccagcactttgggaggctgaagcaggcagatcacctgagctcaggagttcaagaccatcctgggcaacaaggcaaaaccccatctctactaaaaatacaaaatattagccaggcgtggtggcgggcacctgtagtcccagctacttgggaggctgaagcatgagaactggttgagtctgggaggcggaggttgcagtgagctgagatcgtgcccttgcactccagcctgggtgacagagtgagaccttttctcaaaataataataataataataataataataataataataataataaaaggaataaaaatcaggtgaactatggattagcattgcccgtgctgagccgagcacacgcaggtgtggtctcttttgatcttcaccacagacatcggcagcaggtattacttttgtgtccattttgcagatgacgctcagatacgttagtgattttcctgtatgatcgcacagccatggggttcaaacccagacgcgtcagactcctacacctgagcccttaatccctgtgcaaagcagcctttgatgtataagagatcatgagcttcggtcccttccatcttgggatatggctcctaagttcttgccccaaaggatgtggaggttcagctgtgaaaaagagttaggaagcgttccgagtagaaggaacagtgtgcggaagcctccaaggccaggaggagcagcgaatcctcagaaactgaggatggccgagtccagctttacattttgaaagcatccttcctcatctctggagtgtgggatatcaagacccactcccctaattcacatccgcattaagtgagcataggagtgtgatgatgcttgcccatagcacagccttacacaaacaaaagggctgcccccacacctgtgcaggacccctgctctgcagaacccactgcacagggcccatgtgcagatcagcgagttaatgcatgttaagcacttagaagggtgcccagcaaactgccagggtgtgttgaccaccatcatcctcatcttcatcatcatcatcatcatcacagcttttgttccacccgaagaatatttactgagtacttgctatgtgccaggcactgttctacgagccagggacacaggtaagaacaaaaccaagttcctgtccctaggagggagaaaaacagcaaacaaatgagttcataatacacagtccacccaagggtgatgaggtgtgtgaagctccacaaagcagggagagggggaagggaaggctgtatgagcagatcccaggtaggtgagagccgggcagatatggtgggtgggcggggaaagagccagtgcaaaggcccagaggtgggactgggtggctggagagaatgagtaaggaggggagtgctggaagagaggtcagagacgtggagggggtcaggggagtcaattccagtccgacctctaggccaagaaccttggctgttaactcctttaacccatggggccagggataaattggagggtaagctgttcatgtctctgagtaaaagctatttcccagaactccagaaaacgccctgtgtttagaaccctctttgagtgtcaccttgcgtgacatgaaatatttttcaaaacatgtaatcctttaatctgggcctctcagtgaaatcagtgctttatcactcacgaccatctgttgtttcagtcacgcagtaaataactcgggagatgtggcttctaaggcgcttatctctttgttctctccaaattctgagaaatgacatttgaattttcctctgagacggcggcacagctcaaattgatctctgcgtaccctcccatctgggactgccattaaggaagtcccaggactgggaggcatttgtggtgggtgaaaagtgttttgcttctgatcaccaggttccattaaatttcataaatgaggcttcatcgaaaaataagctgggcggaaaaataagccgccccctcccgacgacgtacggtgtattcttaaccaccctccgaaggaggctggggcgcctgtcatgttagattaggattaaaaattgcggaccccaacatgggtccaatgtagttaattctgcagcaagtgaactgagagctaatggcgtgggattatgcacctgctgcggctggaaagttattggtggtggttacaggggtgagggagattgggcggagaaaggggtgataaaaggtgataaaaggtccacgctctggtctcccctctgtctttggggaaaaccattcacctccttaaggcctcgtctccatatccaccaaatgccagcttagtggtcattttcacttttcgtgaatttaacagccaatgtttacaagagtaaaaagaagggttctctgggtgaagcagggatgggggccaggggcccccctcccaggctttcctgccgcaccaccccccgctcctgcttggccattcctgctctctgcccctcatgccctcagtctcaggccctgaggctccctgggggcagctgaaaacctctggccttggtgattccaccaattcccaggggcacccggcccggacctgttcccagggacctggtgccccctgcagggcactggtgacaccgtgtgcaatttgcagctacccagataggcacgcaggaaggactgcgctcggtcccagccaggcagggacagacacagcctctgctctcagtgtggggtggcgagggcctaaaaatgaagaatcatactagaaacatcccgacgagtctggggaaagctgccctcagaaggctgtttaagctgaggactaaagggtgatttggccaattgaagctgatgggaggccttccaggcagaggaccagcacgtgccaatgatgatcggtggcactgtgctagatgccagcctgagtgtagatgcccgcctgggtgtacactccatcctgagtgtagacaccagcctgggtgtagacgccatccttggtgtagatgccatcctgagtgtagatgccagcctgggtgtagacgccatcctgagtgtagatgccagcctgggtgtagacgccatgctgagtgtagacgccagcctgggtgtagatgccatcctcagtgtagatgccagcctgggtgtagatgccagcctgggtgtagacgccagcctgggcatagatgccatcctgggtgtagacaccagcctgggcatagatgccatcctgggtgtagacaccatcctgggtgcagactcaggataccccaggagggaagttctgtagggagaaactgatgcttgcccaaggtcacacagcaagtgagtggcagagaggatttaagccctagagccgggatttgaaccaaggccgttagctgtggagcccgctctggttgcccgtctgctctgccggatgagacaagctcagctggaggaaacggtttgaagagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgaccaaatccacaggtgcctttcataaagcctctttgggctgcagtttggagaatggatggatttggaggcatcgaggccagggacgaggccactgtggaggcactgatggggacttgggcctggggtggggttcatttatagaatgtgcctggcagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctgttccggtggctgctggcaatcatggtcactccttggtctgtagacgccatctctgcctccctcttcacatgactttcttgtgtgcatgtgtgtgtgcgtgcgtgtgtacatgtgtgtgtggggggggcgtgcttgtgtgtgtgtgtgtgtgtgatctccctctgctcccctcttctcagacacttgtgactggatttagggcccactggaaaatgcagaatcatctccccatgtcaagatccttaacctaattgcgtctgcaaagaccctttttcctttgcatttaggattccagggagtagggcctggtgtctttggggacctttattcagccaactgtatgtgcaggaggagacacaggaggctcgaggccctcccttgaaggggtcgctcactggttaaatgcgatggcggatttctattaagacaccgagaaagagtgacaagggagggtgggtgtgggacatagaagcgggggtggtgtggccctaaccctggcctgggagggctggtgtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacatggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagagcctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatcttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgctttttttttttttttttttttagtggagaaggggtttcgctatgttggccagcctggtctcaaaacttctgagctcaagtgattcacccaccttgacttctggaaatgctgggattatacgcttgtgtgccacagcacctggcccctatatcttatttttgaactttttattaaaacataatacttcgggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaacaaacaaacaaaaaatacttcaaagcgtataaatcctacgtgttcagctccatgaattcccacaaaataaacacaccatgtaaccagcccccagaccaagaaacagaacagagccagtcccaagaccacgtgttcccagccagtcactgcccaccagattcctgacttctcatgccagacatcagcttggcctgtttttgagctgcaaatataagtggaatcccactgtggtgttctcttttgatctggcttttttcctttctttattttctgagatgtagcgatgttgttgcatggatttaatgattctgtgtataatttgtaaattctcaaagctctatataaacatggattctaagaaatccacacatatgtacatatacatatgtacatatagacatatgtgtgtacgtatatgtatacatgcagacatatatgtatatacacatatataccacatatattatgtattatgtatcatctctctctcacaccgggtagatacttaagtaattgtccttcagcaaacacaccaagatttgcttatccttttgctctgggctttcagttatttcgtgccgactgttataaaaagatacatggtatcttctgaccttctgagccgccctccgaggctggctctgcctgcttgctgtttctcacaagaggaaacgcaggctcagagaggcccggcgcactgcccacccccttgcaagctccgggtggcgccgggactcgaacgcgcgccccagagctgctgacaccgccctctccccgcaggccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccaggtaggtcctgggcccgagggagggggctgagggaggaggacaggtgaacagagctgtcccgggggaggggaagaaaggagctgggcttaaagctgggccacctgggcgggtctcgggcgcctccactgcgcacctgtgaactgggacgggcgctccttgagcaggcgtggcgctgctgtgcagctgctgtgtgtcccactgcccctggggacttgcgttgtaggagatgcccttccagagaaaatgccacttcctatgaaaatgggatgggggcagggaccctagatgcctccagggagccacagtccagcagacacccattcccgggaaaatgcccgctgataggatgcgggtgcagtgggatttctcatttaaaagatcaagattcgaggcttttctttaaaataccggaccatgttccctgggctgccaccagctggaacctcaggtgcccctggatgaggaggtgtcctctagcttcccactcaccccatcaacccaccaggcccgccacacttctcatgcctggccctggggtatttgaggtggagaccaggagcttagcaatccagatggggcgtgccccagagaggagcgggtgcgtggcttcagatccaccggccagctgtcactttcttgagtctcctctcctgtgaaatgggtggatcacctgaggtcaggagttcaagaccagtctgggcaacatgctgaaaccccgtctctactaaaaatacaaaaattagccaggcgtggtggcaggagcctcaaatcccagctacttgggagactgaggcaggagaatcacttgaacccaggaggtggagcttgcagtgagccaaggttgtgccattgcactccagcgtgggtgacaaagtgagactctgtctcaaaaaaaaaaagaaagaaaaagaaaagaaaagacaacgtgcagctcacggtggacctgccactccaaagtgctcagcactgcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccgtcggggacagtaagtggggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagcgatgacaggggactcagcacacttaatcatgctcataattacagtcttataatgctcatcaagacagacagggactatttcagtactgcctctgggcaggaactggccgctgctccaggccaggcagcctcctactcagccttcataagaaaacctaaatgttgcccctcatggtggacaagcacataaaggcactcccctctgggtggacttatcaaaaatggtgccccttcctctggaatgtgacctgacatagggattctagccttgcctcctgcctatagcaggtgcttttgagcagtgcacagatgatacaactgtacatggcattcccaatagccttttcatacatcatctcgtttcacgctcacacagcttgatgagatgactgttatcagccctgtgtcacaactgaagctcagagaagctgaatcatttgcccaaggtcacacagcaggcagacctgcagtttccatccagttgtctgactgtagagaagtgttcattgccttaggccgtgagtgtgggaatgtggagcccctgccctggcacctgtacccacgtgtggggtccttcattgccaggaatatcctcccccagacatcccatggctcacttccttgcctcctttagacctatttccaaaggccacttttcaggaaagatttccctctctcaatgacagcccctccttggccatttttaaaccctccatccctgtttaatttttctctgtagcgtaatctggaagactgtgttttacttgtttgttcattgactgttctctccccacttgaaggtcagccccacagggcagggagtttgtctttcattcactgctgtaaccccagcatctaaaacggtctctgggcatataatactcaataaatattcactcattcattcattcactagccagcaggaagagcaatcatactactagtgagtaataacaacaatgctgtctaacaccagatttcacaatcttggcatattgacatttgggattggttgattctacttgctgggcaggggggcgctctcccgtgcactgtaggatggtcagcggcttccttggcccttccccaccagatgccagtagcaacctctaccccaagttgtgacaaccaaaaatgtctctaatctttcctaaatgctctctggggaacaaaatcgctctgcattgagaaacactggtctaactcaggccctgttccaggcaccttacttcttcattgccatctggatttgggtctgtccaaagcagacccagagacaaggacttgggcccaggttgtttatttgggaggtgatcccaggtagttccagtgaggtcatgaagagctgagaccccagggccaccaggcctttaagggtcttcaactagagtaatggggagcccggaccaagtttcactactccaaacatttgcttatttccctgctgctcagaagcctttgatcaaggcaaaagagaatacaaacagcacatattactacgtttcccacctgaaaatgtttcctaacacgtggtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttactttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattagtaaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactcgcttgaacccggaaggcagaggttgcaatgagccaagattgcgccattgcactccagcctgggcgacaagagtgaaactttgtctcaaaaaaaaaaaagaaaaaaatacagacttacagtccgggtgcagtggctcactcctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataaataaataagaagtaaataaataaatagaataagaacttacagtaagaaaaaaaataaaacagtctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtacccccgaacctaaaaattaaaaaaataaagtattagttagagaacaggctatgctgctgcaacaaaaagacccataaatacagggacccaacctgtgaggcattttcttctctctcagctattagtgcagagacagacatttgtggtaggcaggtagctctgctcgcaaagccatctagggacccagcttccttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccagcccacagtgaaaggttctatcactaaaagcaaagggtgaaggtgtgccaggaaccatagttatttctcccatggggagcctctgtgctgtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgaagaagggctgatggctgggggcttggccagaatcaaagcccagtacagaataagggcttcgactctccccaagaatggagcctcctcctggatggagaattgaaggggagggggcttagggttggttttcaaattcctagaattctagggggttcaccgctctctaatgatgaagcctccctgggggtgggggaggtaccaggaggcagagggcaatttctggaaggaacagcatgcaggtcgggggcctggaggcctaggaggtgcgagcgggcacccttgcacacctgcggctgtgcttctgactccacgtccatctgtgtgttgtgtgactgtgtccgctagagtgtgcggccgtatatgcaactgtgtggctgtccttgtgcctgtggctgaatatttgtgtgtgtgtgtgtgtgtgtgtgtgtgtgtgcatgcaaaagtgtgtgactgtattgtgagtgtacatgtgtgggtaagcgtgtgtgtatgtgggtgtggatatgtgtgtgcaggatttgtgtgtggggatgcgtgcgtatatgtctgtgtgtatttgtgcgtctgacttgcttgtgtaaatgtctgtgtccccatgcgactgtagggctgagtgtgtgtttcagggtgtatccgtgaacatgtctatatggatgttgctgagcctgtgagagtatgtttgggatcaggtgagcttggactgcctgtgtttgtgtgcgtgtttgtgggtgtgcacgtgtgccacatgccgctgagtgagacccagggcctagcctggaacctggggtacagaggcgaggccgcctctctgggtgaggtgcgttccctgcacccgtcccgggagtctgccttctagaccctagcatgtgcacctgtcctgggagtcggccttctagaccccagcgtgtgtccctcctgcagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcaggtgagtgtggcaccccagccctgatcctggctcctgccccagtccccttctccctgtaagcgcctctcacccgcatggacgacctgccccaggaagcagccccagcacctgggcctgactgagagctcctcacatcttccccctgcccggctccttctttcatggcccctaccctttccctgtcacactagcatgtgaccgaagctcttgagccagcagactggctgcaaaccccagctctgcacctcccagctgggcgacactggggttaatttcttcctatctctgagcctcagtttcctcatctgtaaaatggggctactacatgctgttgtggggcgtgactgaaatcataagtgcagagcagtcggagcagccctaaggaatagtaggtggtcagtaagcactggatgttttatatccacgtatgtgtagatggaccccgacttacgatggtcaacttaagattgttagactttacgctggtgcagaagcaacatgcattctgtagaaactgtacttcaagttcccatccaaccattctgtttttcactttcagtatggtaatcaaattacacgacacattcaatattttattataaaataggctttgtgttagatgactttgcccaactctaggctaatgtaagtgttctgagcacagttaaggtaggctcggctaaggtatggtgttcagtaggttaactgtgttcagtgcattttgacttaagatattctcagcttgtagggggtatatcagtacataactccattgtaagtcaagaagcatctgtatctgttttcaaactgcattgaattagaattgtctgagaatccttaacttccagaacttctgccaggactgttcagtttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatcaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccctgtccccgcttcggcatctcatagccctaatagctaaggacaggaccctcagacaagattggtgataattacagtgaccctatttgccgaaagtatactggggagtgcatgatctgccaaaacctctttttttttctgatttgagaatgtttttctctgaagtgtttcaagaaaggcatagacgtaaaatcagtcatgcatttaatgtcattatcattgcagataaagtgatgcaaatcccggaatcctgaactttgaagaaattatctacaaaaggctttgaaacaaagagatgcctttttggtttcctctacattccacttgctatttgcagggctttgtttggggttatagggtggcttctccagccagatagcctgggctgccacagctactcagccccttactgctgtgggcagcaaataacataaccttttcaggcctcatttgccttttctgtaaaatgggttcataatacttgaggtacttcacagggctctttgaggagtgagttaatctgtgtagagtgtccatcaattcacaagcacagtaaacaaccttcactgttttatcactgcttgtctctagacactcaatcctgccgtgggtgggtggggtgtatggtcctttggaggtaaaaccgcaagggcctgccagccactgtgaggctgctggagtgtggaagggatagccttttccaaaagagagctgtggggcgagttgtgagttcgttgggctatgccaccatttataataatgacggcataataggaatgccttgggcacttgtctttttcatcccctgatcttttcattcagccctatgatgtctaagaccaaggtcaaaccaagtcaaactagttcttaagggttcaaaccagttaaaaaaattcccatttcaagacagagctaagcaaagagggtcagtcattcagtggtgaccacaccagtgatgcctactgttaacatgcacctttggagtgctctctttaaattaagctttgctgcaagcctgcaaaaggagaagtagaaccaggaggcagtgctgcataggtttcagagtgcaggctcagaaccacagaaagaagtccaaagcctgtaactttcttcctccgtggccttgagcaggtcacccaacctctcttagcctcagttccttgatctgtaaaatagagatggcgatggtaaccatagtgactacttcatggggtagttatggggcttgagtgagagaaacacgtatgaagtgcttagaatagcacctggcccactgtaggtcctcagtgaatgtgtgccaccatcatccctgtcttcgtaaagggaggatatgagttcaggaatttacccaaaagatgcagagctggaagagctggaattccaagactgtccaccagcctcagagcctgtgtgtgtgtgtgcgtgtgtgtgtgtgtgtgtgtgtgtgtgtgtgagcttcccctcccaaatgaacgatttgaggcttccaaatggaactgtaagtggaattccccctagccttgttctcagggggctgacacttagcaataattactggtaatttactggtaattatatataggtttgaaaacattttgaattccagcaacttcccttggagcaaaaatctcaggggaagggtggcccccttgtcccagccttaccaaggaagaagctttttatttaagtttttaaaaactgcatatttgaaataatttcagacttataaaaatgttgcaaaagtagtaccttgaatcccccacccagattcaccagttgttaaaaaactaccgttacattttcctttatgctctctccccacttataaatctacgtgtgtatttttctggaccatttgagagtaagcgacaggccctgtgccgacacctaagatgccatcctcccgtaagagaggcttctagcgggtaccaatagtccttcaagtttgaccatccagcacctggaaccaggcatttgaggggttcacattttatgcaagaggaaaatgaacactgacatgtatagtaaatctggtttttcagagagtgggttcagggaaaatcggtgcatttttctgagtaggtttgaggtcacacagaagctgagctgcgggggctggcccctccttgtcctgcccaagacactgcttgagaagaatgaagtggggcttgtctagccttgagtgggaggcaatttgagaaaagtgacgagtaatcatttttggtaataaattataagtgattatatttggcctgaggagggggtccggggtccacatttacctctgtctccttgtggtgttatgggccagaattcacccccaggtaaagggggagcaggaaagttttggggagctcccccagcctacaaaaaccttagccatttgctttggaaaatagttattgctgcagttgctgatcagcaggcgctgacccaccggagggcctggagcggttccatggagcgttagcaccttgaccgataaatgtccgtgctggtcccaaacagcctgatgatttttagtatggccacaaaacaaaagaaaaagaaaatgtctggctaccgcgcatatgtgcttgattaaccttatagcagaaaaggcagcgctgatcaccaggatggagaagtgagctaaatttgagagagattgccacattcaagcatccacatgtcctggtcacattcctgtcagcaaatgctttcctgctaccatggggtgggtagcacggctagtcatgggacatgcatgaaattgccagcagttgaccactttttacacacaaagatagaattttcatacggctcatcctaatactgcatagatatgttttaaatgaaattgtttcttttaatcctcacaataactttaagaggtactaattttatgcctatttttaggagaggaaactgaggctcaaagaggacgagtgaggattcatactcaagttactttgtcatttgcagtaatgacatcagagtgtctcttgggcagactcaaaagagtgtcatctcttccccctgtgaacatattttgtaatgacatttactcaacagtgtgttgaaatttggcttccagttcatctgttaagacaatggttttggccgggcatggcggctcacgcctgtaatcccagcactttggcaggctgaggtgggtgaatcacctgaggtcaggagttcgaggccagcctgaccaacatggcgataccccatctctactcaaaatacaaaattgactgggtgtggtggcgcatgcctgtaatcccagctactcgggaggctgaggcaggagaatcacttgaacccaggaggcagaggttacagtgagctgagatcatgccactgcactccagcctgggcaacagagtgagacttcgtctaaaagaaaaaaaaaaaagacagtggttctgaaactttttgctctcaagaccgctgtaccctgaaagatgttaaggagatctcacagggctttcctttatgggttgatggctctggatattatcatattagaaactagagctgagacattacaaatgctcatgtagcctctgaacaattccattgtacactagtgagatggggagactgaaaaacacaagtaattcctcagtgttattatgacaacagttttggccttctaaactcctaaaagaagttttttcctctcacttgttttccagatgggcgaatcctacgacacaaactttacaaagaatatccaggtaaaagaagaaactgttctttctttccagagggcacaaaaaaaaggcagtgaaagtttcttatgtgaagaaaaaaataaaagcccagggctgagatatagggaacaaaatgggacctgggattaagaaacaaaatagaagacctgtggtctgatggtgggcagggagttgtgagtcacagaggagctcatggcaaacatgacctcatgctgaagagcagagcctggaactgctcatatttaagcctctgctactttcattcagagaattggaaaacacgcctgataccactcttccattcatccatctaatcatccattgatccatccatctctccatctattatttcatccatccattcatccctccatccatctacccacccatccatctacccaccatccatccatccatccaccgattcatccatccatcctctcattcatccattcatatatccatctattctttcattcatcttcctgttttttcatccattcattcctctatcaatctattcatccatctattcattcttccatccatccacccattcatccatccatccacatattcatctatcttttcacccacccatctatccttttatccacccctttattccttcatccctccatccatccatcctttcatttacttacctattcaccaatcatccattcatctatccatccatccattcatacatacatcctttcacttatccatctatccacccatctaccttttttttttttttgagatggagtctcactctgttgcctaggctggggtgcactggagtaatcttggctcactgcaaactctgcctcctgggttcaagcagttctcctgcgtcagcctcccaaatagctgggattacaggtgtccgccaccatacctggataatttttgtatttttagtagagacgaggtttcaccttgttggccaggctggtcttaaactcctgacctcaggtgatctgcccgcctcggcctcccaaagtgctagatttacaggcatgagccactgtgcctggccccatccacccatctgtctatccatttatccatccatccactcatccatccacccacccatctatgcatccacccaccatccatccacccacccattcatctatccattcactcattcatccattcatatattcatctaatctttcatccatccattttttcaagcatgcatccatccatccattcctccatcgatctattcatccatctgttcattcttccatctatccatctatatattcatctatcttttcatctacccatctattattttatccacccttctattcctttatccctccatccaaccatccttatatccactcatctatttgcccgtacatccattcacccaaccatccatccatctgcccattcatccattcatgcacatatccttgcattcattcatctatctcttctttcatccattcatacatccatccatccacccatccacccatctacccatccatccattcacctatgtatccattcatccatccacccatatatccatctatctattcagccatccagccagccactatccatccatctatccatccatccatatatccatccgtccatccacccacccatctatccatccatccatccatccatccattcatctacccatctatccatctatccacccacccatatatccatgcatccatccatccatcatttatccattcacccattcacccatccatccatccatcatttatccattcacccatccatccatccattctcccatccatctgatatgtctttatcaataatttacagcacatattttctaagtattactcatcagtctgtgctgggggttggagctacatttgtgaacatgacagacccagtcgctgctgtcatgcagctaatatcaagcagaaaattcagacatgaatatagcccaagtggttattttatgagaatagtgacaagccttcctgacatcacatgctggatactatgaggacaccttagtccaggttgtgagaaaaggcttcctaaggaggagacatgaaagctcagcctaaagaataagaaatagtgggcagcagaatggcatgtgtgaagctcttgaggtcggaagcaatttggccatccccaaagctggagtgtgtggtgagctgtggaggtggtgggaggtaagaccagaaacatagacagagctggtgacaccagctggggggcctggggagggagaggaggcactgcaggtggggactgagtgacctcagctgggggagggaggagagggccaggtcaccaggcttcatttggcagttcctggtgagccacggggggcattagagcaggaatagatacatctaccccaacagagctgtgttcttttcacagaaggtgactcaaagaatgtggcagaacctggaaggggacaacagaagcactttcagtaaagcaacggcaagcaggtgagtgggcagagagcaagagtcatggccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctaggctcaagccatcctcctgcctcagctttagtctcagtagctgggactacagacatacaccacctcacctggctaattttttttttgtattttttgtagagatgagttctcactatgttactcaggctggtcttgaactcctggcctcaagcagtcctcccactttggcctcccaaagtgctgggattgcaggcatgagtcactgtgcctggccttaactcttgtttatatccattagcctatggtaaaattgtttttgttatatagtaggtcattttgcttaaagttgcagtttccaataagctatccatgatgttaaatgaggacctactgcaatttcaaggcaggaacgtaggagaactttgtgtgtgatcagaagcagaagcaattctgtatccctctgaatcaaaaatccaagaccagactaggtcgcaactttccttttcattcctttgccttgatgtctccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttcgtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcgtaggtgcatgcaaagggctgtggagttgcagccctaaacctgaaaatctacccagcccctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatctcaacattttgggagaccgaagcaggcatatggtataatcccaggagttcaagcccagcctggcctggccaacatggtgaaaccctatctctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaagtacagcctttggagcaagctaggtctgggtttaaattcttgttccagcactgtggatttagtaaataatttcggctctccaagcctcagcctcctcatctataaaatggaactgatggtaggggaggagttaggaactaaataagatgatgccgtgaagacgtcacagtgagttcagaattgggtcttctcagaaaggggcatcttcctggtgtttctgatggtggcggtggcggcggggagacgaaagatttgtgactctgtggtctgccctgcagtggttcaccctgacccttctttgtctctggtctgccctgcagcggttcaccctgatccttctttgcttgctttccagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataag

SEQ ID NO: 38537 - DNA, 8130 bp, Homo sapiens
acagcaatagtgcagaatccagaatggatgtcctctttgtagccatctttgctgtgccacttatcctgggtaagtccactcctctctctgagcttttgtgccaggtcttctaccataaatggggtgggagaaaaaaaatgaggagtgggtgagaggtacatttcagtggggagcgatagagttttctcatcgtgctggggtccggtgttgagggcagaatggagatctggaaggcagagccaggaaagggggaaaaaagcagagtcctgtcaaacaaggaggatggagctccagacacaaggaggccctagcaacactgagctcagttctccatcaccacggaagttgaacaagatgacaggggctaaagtaagggtgaaggagggattattggaaggtgtcacagtctgaaactagtagttagggtatctcctttcccagagaattggagaaaaaaacctgctattagtaaagacacagaagtggggtgacctttagggtagtggaaaactggctgtcttcagggacagggtcccaagagtagcttggctccttccctcctttgttccccagtctaccaggtgtgtctcattgtttccttttcctctagattcttgtgtcattagcttggagttgaagggaaagcattcaaggagctcagggaagtgtttagcaggaggcctggagttcttgatccagtcatatcaaagccacatatttttagttctgaaagggaagaaaaactaacagagatgggtcattttagtccagctgactcattttaagaaagcggatgttaagtggattgttcagggttattctgttagcagtgaaggtggaactaaagctcaaatccaaagcctaagggtgtatgttagttatttgtaagagatactgataagaaaagatgtctcacaaatacagtaagatctggagcatactaaatagaagacttggcgtttttaattcctggtctctacttttcctaccttttttaggtctggttctccctttgggtttatagtatgtgaaggggactgttttctgttttaggagttcctggattgaaagggcacggagtaacaggcctcattacagatatggatcccagaagactgagaggggtgtagaggtgcacaggcaagaaaggagtatgactattggaggagagagagagagagagaaaagaaagaaagagcaagaaagctgggagcgctgaggtcatctccaggtgtccttttgttagtaaggtgttccagatgtcccttgacctctagtccttgtccccataggacaagaatatgaggatgaagaaagactgggagaggatgaatattatcaggtggtctattattatacagtcacccccagttatggtgagtacatgaaaggctcttgcccttagccaactggagagaggcttcaggatatttagttctgagactttgctcttcactttgaagcagagcaatggggtcagagaaaaatctggctatgaacaaaacctatcaagactcatgatggggccgggcgtggtggctcacacctgtaatcccagcactttgggaggctgaggcgggcggatcacgaggtcaggagatcgagaccatcctggctaacacagtgaaaccctgtctctactaaaaatacaaaaaattagccgggtgtggtggcgggtgcctgcagtcccagctacttgggaggctgaggcaggagaatggcatgaacccgggaggcagaggttgcagtgagctgagatcgtgccactgcactccagcctgggtgacagagcaagactccatctcaaaaaaaaaaaaaatgaaaaaagatttatgatgggctgggcgcagtgactcatgcctgtaatcccagcactttgggaggctgaggtgggtggatcacctgcggtcaggagtttgagaccagcctggccaacatggtgaaaccctgtctctactaaaaatacaaaaattagctgggcatggtggcacctgcctgtagtcccagttattcaggaggctgaggcaggagaatcgcttgaacctgggaggcagaggttgtggtgaactgagatcacaccactgcactccagcctgggcgacagaatgagactacgtcacaaaaaaaaaaaaaaagactcatgatgatgttatttttccagatagtgatttttagatgggaggattgcttgagcccaggagttcaagaccaccctggacatcatagcaagaccttgtctctatagaaaaaaaaatttttttttttttgagaccaaatctcatgctgtcacccaggctagagtgcagtggcacaatctcagctcactgcaacctctgcctctcggcttccagctattctcttgcctcagcctcctaggtagctgggactacaggcgtgtgctaccatgcccggctaattttgtatctttagtagagacaaggtgtcaccatgttggccacgctggtcttgaactcctgatctcgtgatctgcccacctcagcctcccaaagtgctgggattacaggcttgagccatcgtgcccggccaaaatttttttttttttaattagctgggcatggtggcacatggctgtagtcccagctactcaggaggctgaggcaggaggatcacttgagctcaggagctggaggtggcagtgagctatgattgaaccaactgtactccagcctgttaacacagtgagaccctgactctaaaaaaagaagaacttgaaaatttttcaaatttgtaaattattttagatacctacattgaaaatataaatgcatacacattcacagtcatttttaacattagttaaataaaattggattataccaataaatgttacaacttaagttaaactattctgagtaatttcttcccttttcatttccagatctagagttacatttttctttaattattactgattttctttctcctctgcagatgactttagtgcagatttcaccattgattactccatatttgagtcagaggacaggctggtgagtgaactctacatctaaaagggttaggataagtaacaattaaaaagaaactggccgggcgcagtggctcatgcctataatcccagcactttgggaggccaaggcgagtggatcatttgaggtcaagagtttgagaccagcctggccaaaatggtgaaaccccgtctctactaaaaatacaaaaacattagttggacatggtagcatatgcctataatcccagctactcagaaggctgaggtaggagaatcacttgaatccgggagatggaggacgcagtgagccaagatcgttccactgcactccagcctgggtgacagatccagacttcatctcaaaaaaaaaagaaaaaagaaaagaaaagaaactgggcaatgttgaaatgtatctgattaacaagaataaaaatgagtttgatgaggagaaactaagtagtaggcccaaaacagatttgttaacctatctggggaggagaaaaaagccagaactttataaattgtcctcagtaagtttgctaagacactgaggaggggcatcaagggacttttgaatgagatgggtacaaatctatgcaagcatagggtaggggggaatccctgagcttaagtctttgggctgggtggaggtggtgaaggggagaactttaagtagagaatctatgaagatgttggatggaaaaactgataactctgtgtttcccaaatcctactgagggtagaacaggttggataaggacataacagaagcaatagagactaccattagtcttgaaacagcacgtgcagaccatccgaagcctgtaactgtgaaaccagtaacaacggaacctgtgagttgattggggattgggggctggggggagacaggacatccctagtgacgtggaatacatagagggctggaataccaggctttggtggatgggagaaccaaataattagtacttcattgcaggtattcatctcaacttggccatgtttcactaagatttaatactaaccctgtttacagaacactgggaagatatggtacagttaaatttcagttcagtagtattcaataggtatgtaatctatgcctaaggctgctaaggtaactgatgctgataaaaaagaaatctatgttactgtcctcaaggatttataaaattcaagtttacgaaacacttagaacaaaatgaaaaggtatgttatgatgttaaattatatataaatttgaaagcagaagatactggcagtgctttagccaatgtaagaagagagattagtacaggctagagttgtctgaaaagctttcaagaggcatttgtgcttgagatacaccctgaagaatagatgagcttttgattggtgggtagttatggaaggacagaagcaattaggaggaagaatagttattccaagagtgaaagaggccaggtatggcggcttatgcctgtaatcccagcactttggggaggccaaggtggtcggatcacttgaggtcagcagttcaaggctagttcaatggccaacatggtggaaaccccatctctactaaaaatacaaaagttagccaggcgtggtggtgcgtgcctgtaatcccagctacttgggaagctgaggcatgagaatcacttgaacccgggaggcagaggttgcagtgagccgagatcacgccactctactccagcctgggcgacagagtgagactctatctaaaaaaaaaaaaaaaaaaaaaaaaaaaagagtgaaagagctgcacaggaggggggaatagaacaagcataatatgtttagcaaatagggtatgattgaaggagagggtatatggaagggaacagtgggaattaagaaaaatataaaatttacaaggctcctaatacttgcttagtaatttcacatgtggcaacataggggcaaatttcagagagtctcaggtgtcaggctgaagtctggactcataatcaacaaggagcctagtaagttcttcattatggtaaaaacacgatgaaaagtgatattttagaaaaaccggccaggtgtggtggctcacgactgtaatctcagcactttgggaggctgaagtgagctgatcacctgaagtcgggagttcgagaccagcctgaccaacatggagaaaccctgtctatagtaaaaatacagaattagctgggtgtggtggcacatgcctgtaatcccagctacctgggaggctgaggcaggagaatcgcttgaacctgggaggcggaggttgcagtgagccgaaatcgcgctattgcactccagcctgggaaacaagagtgaaactccatctcaaaaaaagaaaaaagaaaaaccactcttcaggttgtatgcaggatgtaaataatttagtggaaagcaactcatgagatttgcgttgttccagaaacaatctgtactctggcattatgaatggagaggagaaaaataaatattatgaagaaaataccttgcttgagtgataattttatatgaagtataaatgaggagtgagttaaaataactcatgggttttaaacatggatgtctgggaaaatggttgaccaaagtgggaactatgggaggccagagtggtttaggacagaagttattaatttggtaatggccaagctgagtttatggtgacagccctatgagggtgtcctaaaggtcactgaactagatcagggctagagttctaagtgcaaagtcacagatatgaaagtaaatgagctcaacagagccagtacacacaagctcagaaggccagtgactgtgcctgtagtgagtgggaggaagagaaattaatgaatggaatggagaaggatttgactggagaagtaggcagatagccaagtttgtattatagagtctagaagagaaagtttaatataatccatcaaaagctaccaagaggccaaggaggaggaggtcacttgtaactctcaagaaagtagttttaactgagtgcttggagaaaagctagatttttgtggagttaaagagtgagtacattatgaggaaagggaggtgagtacagaccaaccatctaaaaaatctggtaatgaaaaagagaagcaacggctggaaaggggaataggaccaaagagcagcctgcatatagttgagcacagatgaaagaagccagtaagaatggaagtgaaagattgacaataagggcagttaattctttttgaagtatacagtaggctgggcgcagtggctcacgcctgtaatcccagcactttgggagctgaggtgggcggatcacctgaggtcaggagtttgagaccagcctggccaacatggcaaaactgtgtctctactaaaaatacaaaaattagccaggcatggtggcgggtgcctgtaatctcagctacttgggaggcaggcaggagaactgtttgaaccctggaggtagaggttacagcgagctgagattgcaccactgcattccagcctggtggatataaaaataataataaataaacaaacaaataaataaaatatagagtagactctctttagattgtaaattccttgaggacaggaatcttgtcttattcatatttatgtccctttctatagcacctagcacagtgactagtatagtataatgcacataatagataaaaaatagaaacaattgaattgaattggcctccctggtatggtcagggatagctgaaaggcacagaaggactccttacagtgatggggaaggatggatctttctctaagcccaaaggaaaggaagacagaggttgttgtaaagaggtggcagtctttctggagggggacagagaagtggtaggaggaatgacaccagcctactgtgtggggatgtcggtattttagcagagtccagatctgaacgatgccgtgtccagtttgcgaagtcctattcccctcctcctgtcgtgtgcctttgttcaggtggggatgtatttcatgtagaaggtaagagtgcagccactggctttgggggagtctgtgaaataatattttttaacttcccacactaaaccgaagtaattcttaccagtatctctagttagtgtttccagcctggtcaattatcagccactgaaggaagagatttaggctcatccctataatcccagcactttgggatggtgacgtgggaggatcgcttgagcccaggagttccagaccaggctgagcaacatagtttaagtccaggctgagcaacagaccttgtctctacaaaaaaattaaaaataaataaataagaactcctctacaagacgttaaaaaaattaaaaataaaaattagttgggtgtggtagcacaggcctgcagtcccagctattgggggggatggggtggaaggatcccttaagcccaagaattggaggctgcagtgagccatgatctggccactgtactgttgccactgggcaacacagtgagactgtctcaaaaaataacaagtaaaatgaaagaagagggatcacatttagaaaaatcttcttattcagtcttaaagaagtttaggagatgctgaggcagacttttgtgatgagtcattactttttctgaactaagaggacttcaggatctcctagagcagatagatgatggggttgggggaatacttctccaagcttccaaaatgtctgaacaatcaaagctagttccagcctggccacgtttcaagtcatggcgaatgccagagggcaaagtgggtgggtcttacaacctggtagagtcaagaggcaaagttcagaggcagaacggatggcggttctctgatgtatggcagggcggtgggagagaagggaagagaaagccgtattataggaaaagaatttttaaattgggatgctaaataaccattgatcatagagagattcagcaggaggtgaaaggactgtggaggagaggggtacacacacatctttcccaggagctatcacagagcaatcccagctcagaatatctggggagtttccatagagtgtggggggcatgaaggggtttctcgggtctcctgactccttttattttctttctttctctgcttttttaggtggaagaaggctgctatgactctttggatgggagtctggcaagaggaaattggaagataaaataaataataagtgaaataa

SEQ ID NO: 38538 - DNA, 151848 bp, Homo sapiens
gctcctgccgctgcggtccgtcggtcggtcagtcagtcccttcgcgctcctgagccgccggcgcgccgggcgccccgggtgagtccaggtcccaagcggacgccgcggggaggcgggaggcgggcagccagcggctcagcctttccaagtttgcaccaggcgaccccggcgggtgtcgccccgtgctccccaagccccgggacccctttgtgccgcgagtctcggctgctccgggcagcagaggcgcctctgcagaaagggtttgagggggaggtctctatagtaacagtaacagtggtggcggcagcggctgctttactggggaaagggggaaacaacccccgcctcggtttccaaaggattgttcttttcatttgcccgcctcatgtggttcttattcttgctgtcacccgggatcttatcgcaggcagggatgggcagttccgcggctcggaaaagctgagataaggaggggcgaagtaatagtaatagcgacagtactaacaacggtaataatagctgtagaaaagggacgtctggtgttgctgccgcccctcgctcatcagcaccagctccccgactgccctgtccagcccgggctccgccagcctccctctagtgctgttctgcgtcccaggctggtccgcgtggatttcagaggggaatgtttctctcttggccttgtctcttggcgatgactttcatctgcaggtggtaagtggggtgaacccaattttagctaattgtcaaaggccacattttgtttatttcatttttacgaagagaaaagagggaaaattatgagccattactggcagccatacagtttccacaggaaatactagcattctttgaggaacacgctactgcttgcagcgaagaaagtcttaggaaacaaaaaggcaacagcattgttgctcattttcaatggacggctaggaggggggaaacgtgttgttttttcctgtgggaacgttgctttccttgggaaagttaattaaggaagcattactgtcggtgccccttttcacttgctggaggcaggatcggattcctcttggctgttactgacaagtgcccatcaaagagcccggaggacgggagaactgctgcaggacagtctcgccacacaccacgtgccgtggagcctggccagggtgcagtttgcaaaatgaaataagggctgtctggggaagtttatgaggattacatgtgtgcacagtatgtcagttctccaaggtgtcactctaaacacgtaattttcaagcactactttcgttgctgaatctgtaggaagggaaaaacctatttttcttttatggagcagacatcccaattgggaatgggttgaaatctgtatttcatttgtacatattgaaaatttaaaaggcaaagaacaaggtgtaggaaagcagtatgctaatgtgtacacatctgggagagaaagtctattgactgtttctgatgcatctcaatgttaaattacattcagcatggttagagtacaaggagacacctttaagcagtcctcaagactttttggaaggtgcaatatttcggtactgatcgcggaagtctctctggaaagggagtattaactgaggattacccataactaaatatgtatgcattaacaggtctggaatcagaaagtaaaagatagtgcttctcttaaggatcttttggacacctcagttagaaataaaatatagcatgggattttgaaaagaaggggtataattttgaatgtaaatttcattttctccgtagcaagcatttcatgaagaaaagttacagatagtagatttgaaatgatgctgcattcatgaatttgacggttaccatttgttgatatccaaaaggaagtgactaaagcaaatgcatttctctgtctactctgtcacaactttcctaattccagacagttgttctggtgcaggtgtacagtggaaatgcaagccaagaaactttgtgcgtgctattgttttggaagaaattgtagcagtactttactgctcttaagggaaacccacacaaacatctaatacaaacaaatgatctttgatattagcagaaaaagcctggagctgtttttcttgccagatttaaggcatttcttgtcaaaagaggaaatctcccaaggagcaggtgcatcattataggaaacacaagggaatttctcttttaaatgcaaaatctaattgaatagcaacaagagaatcagtaacactcttagaatagaagctttgtttttggcagtttgtcaggttacagttgcaaaccacataggagaaatatgtgtcttgggagaaaaatgatatcctggtgaaaatcaaatagttgcttctgtgaaacttttacccttatatacttattttcttgtgcccatttgatttatatgcagattcacttgcaggaagttatttatggaaaatgaatcaaaaacttgtttgctagtatcatatgtactatgcatgatttttcactttatagattaggtaactagatttatattttatggtttgcatcttagcggttttttacgtttttgaaattaatgatcaaaatatgtgttaaaataatttttaattgataagactgatagctaggccctgggaaagtactaattgattcctaaatagttatcgtgcatttactttgtgcttatttgtaatacagcaatttaaaatccatagtcttttcgtaaggaacattttcataggaaataggacccatggaaaattaaatgatactaaacatcgaagaacacatttcataattgagtgcctaagatgctaaatagtaattgaaaaggaattctgaggagagagtgatcaaggtagcttaaatgttatatcagttattcattgctggataacaaatccccacaaaatgcatttacttaaaattgccactatagcttatgattctggtggtcagcaatttgagctgggctcagtgagatggttcttctgctattcttagttaggttccctcagacgttttcagtctgctggtggtataattgtgaatggctttacttatatgtctggcagttatcagactgttggccagggtaacataacgagtggctgggatgtacctcccattctccagcacactccccttggcttctttacatggcaaatcaaatagtgttgtaagagcagtaaaagaacaacctgcaatgcaaaagcaactttaaaacctcaccttgaatcacattagctactctcccattagccatgtcaagtcagaaggttaccccagattcaaggggtatagaaagagtccacttatgatgagaaggagctgcaaaaaattagagccagtttttgtgatctactacatttttgaggatacttgtgtctagcagatgttttctgctgaaaataatatgttaggagagcatattggagcctgcttagcaatagcccaggatttaggttaagtaattgtccagtaaatcattgtcctgcaattttttttctataaaccccaggtagaggaagtatgacacaatgataataaaattttagtcatatccttctgacagtggtgttgggatggtttggagacaggaggctggtggcagggtgagctgagcattgttgaaagttgatgtttttgagaaaaatggaggcaggaaaattggaaaggggtcgatctgggagatcccatatttaggatgaggtgactgattatagggggttagtaaaagtaaaaagtcgaaagcattctgagatttaaaaatacttaagtgactaaaagaatgattgtgcttttgtaagaaatagaaaaatcaataagggatttatttgggggaggagaaaaattcagttccagaaatgttgattaaaagagataaattgaatgtcaaagtactttataagctgcagagtaggctatgaatgttagctattgtttagtgtttaaatcacagtgcactattgtatatagttaagtttctttatgtgtatatcaacagaaaacaaaatacaacctcagggattccctaagatgtcaaagggaagtcagaaccactactctcaggatggaaggtctactcttagaatgctcttcccttaaactaagcataccaggcaagagaacacctttgacttaatttgagtggcatccacactcctgagccagtagcactgactgacagccacaccaggtcagcacacaatgcaaagtgggtgggttcacccttaaaggacactggagcactgctgtcagaagtggagatggaaatagggtgacaagaccaacaaatgctcaccacagatgaacacttgaagatttatttcggcctagacgtggggaagcaagaggtaagaaggcaggaggtgacaacttaggcatatgtccatagagtgtagatgcatgaataatagttgaacccatgcttgtggtggagttttctcgtggaaaataaagaaaagacggtctggcacaatgcctcatccagactccttcattaacgttaatggatgtttaatagaagggagaagaattctaaacatgttctgttctgcctttcacctaaaagctcatgcaaggtgctgtttcttcagcctcattttatggccagactgaaattcaggtggtgcccttaccgcaaagtgcagctgctgggccagacagaaacacctggcctctccagcttcacacaattagtctgaacagcatacacagctgctctttatggaacgaccttggatggaccagctcaaaccaaagaatacgtttttatcatttttattgcacaagtctaaaacccctgaagacactcaataaatgttaattgaacgagtggatgtgccattatctcgtgcagtaacgtttttttaaaatgatctggtctggcttttcattataagtgtagagtttgctataaagtccctaagtgccttttgtagacttaaatgttttaaggtactcttgtcacagtaatgtaggttttttaaatccaccactcataaaaataaactatttttcctttattgagacacagttgtctttcatccttgtgtttgtcaggacacttggttgcaaatcacagaaacccagtttatacttgctcaagtaggaaagggcatatactggctactgtaaaggaaaagttcagaaagaatccaattctgatttcttcttttcttcatggtggcaaaattttcatctgcagctttaggcttaactcctgagaaaaagagaattcaggattaactttaattagaccactttgatcacatgcatatgcttgaaccagaccctatggccggagatttggaccatgccacttgactcagctttgattatgagcccagtcctggaggcttttggaaggggagagtggtatgtgtgacggcaggtgggaaggagtgtatgggagtgaaggaagtacatgggagactagtcagcaaaactcttctaaaccatataacctgagagcagggaaggggtagtttttaaaaggaaatattgaaaagaagagataggagatgctgtgcgtgcagaaacagcagatatctattaaatactataacacctgttttccctgacaggcatatcatcctctcactacacctccaagccagagacctgggaatgatctcgatctgaccttctccctttcttcctccacctaatcagtcaccaagacctcctgctccacttcctttcatgtttcactcttcccaagtcacctctacaaatgctgccttcagtctctcagctttcaatccatcctcctcaccgctgcctgcttgctctttctaaagaatagataaaattgaattatataactccctgctaagaaccattccaaaccttgtcatagtcctggagaaaagtacaggctcctaccatgaattccaagattctctctgaggtgagtcctgcctcctcctgtgggtgcaggggatgggtaggtgctggtatgttcagcaacgccttcttctagctgcccatattatccccatgcttaaatgcttcattgcatgtgcttttacatgggctgttgtctctgtggaatattgtttcttctttctcaaactatgaactattaaacatttacttatccttccaaactcatctcaagtgttgctttttcaagaagcccctgctgaacatcccctcccagcctctccccacatcacactttatcctgtggtacgtatggcgttggatatacatgtgtgtctccctctgtagactaaatgtcttgagagctggacttacttccttatctttgcacatcctgtgctcagtacagtgccttgcccaccatgtatctcaaaaatttttaaataaatgagagaaaaatgtgtgttgaatcattcatctttcattttttcaggtgactttctttaggtatattctatttcctttaaattgattttcacatttgcctcttaggatactgggacatgaagacagattctctttgaagctgctgctcagacactttttcaacagttttctcaatggtttatatacttacttattacttggtcactaataacaaccttaaggaggaggctggaaaatatcagtgacccagagtaaatctccaggctaaaatctatgggtcagagaccagataaggaatccttttccccctatcatcagagaggatatttaataattaatatttatgaggcactctgttttgagtacttaaaagatgccttacaattactttcttatttagttctcacagcagccctaggtaggaggcgtcactgttatcatcttttttttttttttttttttttaacagatgaggaaacaaagatttagagatttgaagcagtttgtctgccactaagctccttcctcctggcgactgccaagtggccagacactcacctgagttgttgaggagtagaataaagctttgattgggctcttcccattcatctgttattttttgttgttgttgtttttattctaagatgagtaaccatcatcttgagaataaaacattatagctgccttctttggtcatcaatcctataaaaaaaaaaactatggaaaaaggtgtatttaaagaggtaagggctccagtactattgttgaaattaagatcagtttcttacttataaattccagtcatcttcctgtgatactgctgctgccagaaaataaaagcgtcttatggaaggaagttgtactgctgcatataaaatgcaggcctcttgaggaggcacagaaaagcttggttttgagagtcattcacagagctattccatagataaatagaaggagctaaacactttggaagccacagaaactcaatagttcttaaactgttttcagtctgagagtcttaagagcatcatatgaaagctatggattctttccttgaagagaaaagatgtccacacataccccgctttgtatttaattttagggatttcaaggatccattgaatctcgtctgtggatttcctgggactccttggactccaggttaaaaaatctgttttaaaagctgatgcagaaggaagatattagccattgttgaatgtttactgtgtttgacatgtaaccatttattcagtgtttaccggatgccagccctttttgaaaggtacattatagctaagccatgcattatgagtccagttttaagccatggaggagaacgaggttcagagagggaactcacagtctcccactgggaaagtactgagaatagaattaaacacagaacccaggtttgtatcaccactacttcatgctgcttccgcactcattcatgcaaccaaatgaagcttaagacttgtgccactgaaatttggatcctctgttggtcctgacttccctcagccttcagcttctcttgttaaaagtaagttaagtggctgcttctgccacaagagcttcctggaatgtgtccagtgcaagagcagtcaagggctgggaaggtctcacctcactctcctccttcacctgtgacaatgttttcacagtgggacagataacatcattagagtgacagcactactggtttgatcatctctaggtaagtttctacttcttactcatttccgagtacagtttgcacacttggaaactttaacttaacagatgctcaacagcaaaaatgactgcaaattctccatgtgacccctcttccacagtatttattgaggcctgtattctgggctctgtcctctaagttgcggtcacagcagtgagcagacagatgtgggtcctgagctcatggtatttatagctagcttatatctagctaggaagggggctaataaataatcgaaataaagcgtggtaagtgttatgaaaaaggaagtatcaagaatttattctattcaagtttcttcattcttttcagcttaaaaactctgatcacaaaacattgtatgtttctccagccctttcttcccccaggatgtttagagtgcttcaggtttccgaaaacttagttgacagagtcagggggatatgcaggccaagcagttaatctcagtccccgctttgcagatgagaaggcaacagtgaccaaatgacttaaccacagatggagtgaagacaggggtaactgcttggtctggtccccagtagagcattgctcactataaaccacaagctgcttctaatttatttgagatgttattatcgtggcctttatattctggtctctcttgctgcaaatgagtccggcaggcaagcacaactcagaaagcaaattcaccttctttgtagcccttgatgggtcggtccccctgttgtctctttctcattccataggcatttcccccactcaccctcttgccctgagaccgcctccccagattttctcctgaagcattgtcttgtgactgcaccaacctacactggcagatagaaatgtaataggatccatgaatgggagccatgcaggcaatttcatattttatagcaggcgcgcttaaaaaagtaaaagggaacaggtgacatcaattttaataatatatcttacccaatatagccaaaatggtagcatttccatatgtaatccatataaaaaatcattaaccaagtaccttacattctttttttcccatattacatctttgaaatttggtgtatgttttttacttacctcaattcagaatggccacattccaatgtggccacaggtggctggtgacccctgcagtggacttcaggcttggactctgaggagaccctgggatgcctaagacagacttagtgaccacctcctcagcctccctcgacacttagctcagatctttattgctgctccaatagaaggttcacaaggttgttttctcaaacctgggttcttgagggaagggaatatgtctttgtcatctttctatctctcatgtagagtgcagtgtttagaaagcccaccattggcagtgggtacatggtgaatcattaatgaacaaaggagggataactgtaactccaggagttgaagggcttggtatatggaggcttacctgtccaacccctgctccctggctctgttcccccatcgcaggggctcctgtttcaatctcccatctttgtccagtgctgcagaaccacattggagtcagattgaatggacaggaggcatctccagtcacacatctaggcttctaacctagaattgtattgagactgtatacaccttgtttagtttttgtttcacctcttttaataccaaatactagaagaacttataagcagtctagtatgtgaaatcataagtcttattcaacaacatggaaaaaaaaaacaaaaaaacaggacagaccaaacacaaaaacaaaaactcgtccagtgaacaagcctcctgttgagattgcaaacaaggccaactgacatatatagaacattaaatatacaagagaagagtagcctgcatcagggagctgttagagtcatcacgatgaactttctgtttccagtggttttagagtcatcactactccctctgagagaactggagatttatatcctatgtcaatttgcctttgcacatgcagtatttaaattttgcaagtgcttctaaccaactaatgtgcatgttagcttatctactttacccccaaagataagtgtcacttcaaataattcatataacccaacctaaaagattggtacttccataaaaccatactaaccacatattcaaataaattcaaagtttgaaaatggagggaaatatgtttgatctgttaagtcatataaacatttttaaaagggatttttatctcagaaaacagcacggttacctcaggcccacttaaagagtacattggactggaaagttgaataaggtctaacctcagttttaccattgattaccagtttcaacctggagagctcattgacctgctttgagtttttgtttctgagtgcatacaggaaaaataaatcctgctgtcacacactatgttttaggaggatgaatgaagtctagaaaatgttttaaacaattcctcaaaaaagatatttggaacagtttgagggtgaggtagcttgccaataattccacaaagtaaaatcttaaaaataatagcatacattctatagcagataactaaacattagccatgtttaagtaatttgatgatcttgtctttactaagacaaggacacttcaaaatagaattttgcatctgttggctacagttttgggaatgctgctttcatttgggattcttaaaaaagaattcgtgcctctttgcaactaaaatatatttcttcaaagatgacagctctggtgttctgtgttggtgtaattgaaaacctataaaaaggctgagagctacttttgaattggctcagtgaacttggactggatttgtcgaagtggtgaaaggtttaaaagaattttcataaatgaggtctccaagctgtgttttaaccatagaattccaatgaactccaaggcccatgaactcgggcaacagcgcctcagagaagagcagtcatatcaagatgaaaataagtgattcattttcattccccacgttctgcagacataagcacacttagccactgataatcataatttagcagtactgttgtgcactaaaaatacaatttaaaagtctaatctttaattaagttgagtactcacagattaacgtggttacaaatcttgggcactggatgtagtacagtgtttactcctgttgctaggaaatacagcagagctatttgaaagttacagattgatttggtgagaaggatgtgagcctctcccagcaacagacttgctcattgcttctctcttatgtaatgtatgtaaatgcatttcatgccgtggaagtcctgtgcattcaaagcttttgttgccaatggaagcacaggtgtgtgcacctaagtcaacgttcagaggatatttgaaaaagtggtcttacctagaactcctggataaaataagcatcacgatgtgtgagtatttgagttttcagtgaaatgaagttttctatttgttagagttaccacgaaaatagagtgttctttaaaatctaattatcgtgaggctaattgatggctttgcattcctgccattagtgggaagctgtcaaattagtacagaaattcgatccaggttgatggttttccaaaattattaaaatgtgcatgtaggaaaccaactctgctttacttttctttctcctcccccctccaatcccctccctgctttggcaaaccttgttgcgtgacacatcgtacaaccgtttttaaaaatgcaaagatgattcttacacagcatgaaagggagtagctacatgtcagttcacttgccttgtccctgaataagatgaaagattgctatgtgctattttagtcaggaccaggtgtgaaagagtggcctccccaagctcaaaaacaggactaagaaaaaacccacagggaaaaatttctatttgatctatttgaggcaggcccttccacaaagggactggtatttcaaagcagggtccttcctaagagatgaaaaaaatagcagaatacttaattgtctcaaggaacaaaatcaggagtaggatgacttgtgctgattgtgaaattatatcctacatccaagcttagaacaacctggatagaattagggaagggtcctgctggggaccaggatcaccactctactccagcatgcgtgctcatgacctctcagtaattaacacacttttacttgccctgtggataattattgactaattcctatagaaagccagttgttgattttggtatgaattgttttctcaatgtatacgagtatctttcacagtgtctggtatgtattgtatgatcagtatatgtctgtggaataaatgaatccttcaacatgtctaacaagtaaatgtgttcctaatataagttttaaggcttattccattgcagctaatagaggttaggggcttgtttcacaaaagatatcttgttacctgttatttacactcagaacatccatctgaggcaaggtgctgtcaaacaagtaggcaaaatgccatgtgatggaaggtttcactgctcagccactagtagtaattggtgatggaattataagatgtttaagacccaccattacagaacatttgattctagaagggaatttggagctttgacaataatgagatggaaaagtaagataaaactggcacatggattacaagtttcttaagggtattctagtcattccccctatctcccaaaacacctgacagcatagaaataacatgggatcgaggtggtggaaaggaggcagaataacataataactgattatgagcatgggcttgaacctcagaacaaggcctggctcagcggcttactgtgtgtgatttggaacagcgtattgaacccctcagtattttgatatggtttcttcccttttttttatcaacaaatatctattgattatctcatttcttcaaggcaagtttgggacacttgggataaaataagactagtggattatcagatccattctccctttctccacctgctctgtgtgataagatggctggccagccttatggaatccaatcagcaggctcccttgttctctggcttccggttgggtttggccaatggggtggatcagcaaaagattaacaaacaggtagggagggagaggtttgggtattttattccctgggctcccatcttaccagatcacctctccctactacaaggcacatgtgcttacaggcagctgtctccctatggctgttctctgggtcctagtaactgtgccctccccaagcaactttaagctgataactgctcccttttagtcttactagctcagagtactacatcattgcttgcagtttctctaaaccttggccacagctttgcaaatgccctttttactaaacaactctcaaattgcatttgagtatgccatctattttctttggggaacctgactgacacagtgattacctgtctcagaggacactgtaagaatggcaggatttatcaggaatttagtataactattagctcttactatgcattcaacaaaggattattgtcatcattagcttttttatttttttacaaagtattcgcaatatttttgcattcttcaattttttttgagtgagaagaaatctattaccttgcaagtgttaaagatggggaaaaatgaaacagaggtcaagggctaaggtcacacagtgcttcagtggcagaactaaaaagtgaagtgagggtttcctatcttgtttctgtgcacgtcgtacacagttacaatatgtctggaagagaaagttgcagcttcaaagttaagtaaattaaaacataacctaattgggataattgggtatgcttaaactaataaactctatttgtgaccactgaataataattggggtgaaatattgacagctcagcatcttcaacttaattactgtaagggctgaggctaagcattttcacatttatatcctcctggtagtttcaagacagatgatccttaggaatgaatttcttgtaggctcttgagggtagatctgtttataagcaacactgaataggagaccagcattctaatgcttgtgtagtaggtttttctactcatacacatttgtctgacttctctcttagagctctcattcataagccacataaagtaggtcactctgtgatatttagagtcatctcatctgtaacttatagtacactcattaacctgtttttcaagaatgaaaactaacaaattccctaaagaagtagtggtcatcttgaaaaacaaaacatactactacaacttctttccatttgataataaatttgtcatagttattgaaatttcaaacctcatgagtgtatctttcactgccttggaaaaattgtccaagtattctcttatagaatagagagaaagggaacttcagaaatgtctcctttttttttttttttttttttttttttttttttacaattaagtagagtcaagggaggaatagcaatttgcaaggtcttttgatgtcagcccaaataaggatttatagattgtcccttctgtgtaaggagctgagtagacaaaaacaaatatcttgttgccagaagagctcatgcttctagaaggaattattttcatttaaacatttgggtctccctctcacttttataaacatcttatttaaggccagctccaggtggaagtcctgccttctgtctttataaagaaaatgctttcatagagtggacacttaacatatataaactttctcaactatgtatgtatgtatgtatgtatgtatgtatgtattgcctttgaattatcctttctggaggagatactagatcaaagtaccgtaatgatctcccagttgatccaagtgaaatctccttttgtttgttccagacctctacttctgtttagatttcatttctttttattttttgcctcaagtgaaataaagtccaatttttattgagaggaactagtgtattcctagtcattactattctaaatgatttcactgttttcaccacatcagttgtgttgacatgagtaccagtaatgtggtaataaagttcctaatggatcatactggaaatatcacgttatacccaagaaccttccttggctgcttgccaaacagaagtaggcataggttctttagagtaattgatgatgtttgcagatggaggacacattatttcgggcagtcattctataaatatgctctggtactgtatggtttggctctgtgtcccctcccaaatctcatcttgaattataatccctacatgtcaatggagggacctggtaggaggtgactggatcacaggggcagtatcccccatgttgttctcataatagtgagggagtccacacgaaatctggtggtttaaaagtggcagttgcccctgagctctttctctctcctgtcaccttgtgaagaaggtacttgcttcccctttgccttccaccatgattataagtttcctgaggccttcccagtcatgtggaactgtgagtcaattaaacctcttccctttataaagtacccagtctcagatagttcttacagcagtgtgaaaacggacttatataggtacatttctttgtgtgtatgcagtctttttcttctagctaatttctgtctggtggagaagaaacatttgtatgtcagtagtggagtcatgtgccaagtgctatagtcagaaggagagagggaactatgatctccatgtgaaatggggaggaagatggttagattttcaaaggcatcacaggaaaagtctcatgtgatttagggttaaaggccaagtgggtattcactaggcagaaaatttaggggacagtgttgggattagacagaacttgggaaactagatataagtattttgatgtgacttcacagtaaaatgtatagtacagagtatcagaagataatgttaaaaggatagtttgagccaagtcttgatctgtttcccattgcagtaagagaaagcttatatatctttttcaatgaatgtgattaataaataatcctacatagattatgtcactcattctcaaggtttatactatcacctgtgttggtgacttccaaatttgtatttctagtcctgggctagagatcctctttgtcttctggccatcagcattttgatgtttatcagctcttgcaaagtctgcacccgcaaagtaaactcattaccttcccttcaaaatcttggctctgtccaaatttcctagtttggtgaatagccccagctttcaaaaaattatccataaatactcccttctcttgaaccctctcaatattttccaatatctaaacactcaacaattcttggcttacttatttgttaaattgttctgaatattattgtctcctttccatccccatttcttgtagtatcttttttttggattgtcattattttctctttcaattactgcagcaacatcttaactgaattctacacctttctgatcagttcttgctccgttaacacattgatctttctcaaattgatcacatcagtgattttgctagtaaatttttcgtaagtccttgcttgctttagtataaaatcctaaaacacttagcatgacatttaagcccttatgatttgagccttgcccacttgtccagcttcatgggacccatggccagtcccttacccttttctagccttattgaataacttgaagattcctaaaatttccaaagtttgttagtcttctgggtattttcctgttcctgttcctgtttccatgcttcttaccctgtcaactcatttctcttaacctctgccgttactcaagttggggtaaagtgtttccacaattgtatggtgataaattatttactcttctctgtctcaactagactgcaggctcctcaatgccaggcaccatgtttcattcatgtctgccacattttcaatgcttagcttcatgtctggcacagaattatagcaaaaataatagtgtttactgagcacttattgtataccagacaaggtgctaatttgtttacatacattatttcctttaaaggagaagaaatcaatctatgctttggaaaggtaatgtggcaaaaaaaaaaaaaaaaagatttgagtacaagatttattacagggagttcaatcaggattatttcaggaaaacaaatgagaattaaaaagaggttaattattcataatactccctctcttgaacctcccggtgtctcccaatatcgaaacactcaaaaagccttgccttatttagttgttaaattgttctcaatttatggtctcctttctatccccatttccagtagggtaggggaaatagaaatcaagtgaagaaaatttatgatagtaattcataaaggtattgaatggacagatagataaatgaaaagacagcccagcatatgtttgttagaactcactgaggagcttactttaacttacaaatctgaataactttggtgcaaaaagcttattaagattagaggagcagaaacagcttatgtgtccaaaagcagatatatcatgagagagtaaaataacatggcttttaaaaatagatatttaaaattataaaggtacatacaaattattaagttagattcaaaagcagttttcaagtaaatatggaaatatgtatcttagaattactctcatcaaaatggaacttcaagtggagccatcataagcttaggagttgtcaatggagactaacggttaaaagtgtggaccctgggattagagcacctgatttgaagtctagctcactcatttgctagctataagatgggggcaaattgcttgacctccaaaatggaaatgccttctttgttttaaggattaaatgaaaaaacagaagcatgtgccactataacagtgtgggatatagcaagcacttgatgaagtatgggcttacctccgtgtacaacttcatttcttttttttttttttttttttttgagacggagtctcactctgtcgcccaggctggagtgcagtggcgggatctcggctcactgcaagctccgcctcccgggttcacgccattgtcctgcctcagcctcccaagtagctgggactacaggcgcccgccactacgcccggctaattttttgtatttttagtagagacggggtttcaccgttttagccgggatggtctcgagctcctgacctcgtgatccgcctgcctcggcctcccaaagtgctgggattacaggcgtgagccaccgcgcccggcctcatttcttaacaatagtgagaaagtgagcagttacagcatttgtatttcaacttatattttcacctggctttcatatcttgtagatgtgttataacagaaaatttgcctagttttatatgaaaaatacaatttgcatactaaaatttacttaaaggaactttgcattgtgagggtacagtctaagtgcctttggttttcccatatgattcatgaaaaaatttactgagatgaacaaatgttagtagtaagccatcatttaattcagcagtccctaacctttttggcaccagggactggtctcatggaagacaatttttccatagttgggggaggggatagtttcaggatgattcaagcgcattacgtttattgtacactttatttctattattattacattgtaatatatgatgaaataattgtacaactcatcataatgtagagtcagtggaagccctgagattgttttcctgcaactagatggtcccattggtgatggttgtggaggggttgatgggagacagtgagagatcatcagacattagattctcacaaggagcgcacaacctagatccctcacatgtgcagttcgcaataggattcatgctcctatgagaatctaatgccactgctgatctgacgggaggtggcgcttgggaagtaatgccagcagtggggaacaggtgtaaacacagaggaagctttgcttgctcactgctgttcaccttctcctgtgtagcctggttcctaacaggactcgaactgatatcagtccatggcccagggattggggacccctgatttaatgcacacaatttattaaaaatatggtccctagttaattcctgtgtgacgtgaaatctcaagttcattgggttttaaatgttcattaagcagtcccttttactattcactattttagctacttagtcaaacaccttaacagaaaggctccttaaaaatacactgtttcccagaagttcagaagatataattagtctctacatattttcaatgtacaaatattgtgtccttatggagaattacttaagaaataaaaaaatacatattcactgatttaatgaccttcctagttttttcaggccactgtgacaaaataccataatctgggtagcttgtaaataacagaaaattatttctcacatttgttagaggctgggaagtccaagatcaaggcaccagcagatctcatgtcaggtgagggcccactttctagttcgtagctgctgccttcttctgtgtcctcacatggtggaaggggcaagccagactcagcacatttaatgtctccacttaatcccgtatcgttctctgtaacttcactttgcattattttttcatcatagcacttaccctaacttaacatgtcatgtttatttgtttgcctgttgtctatctcccccaccaaaatattagacgatacatgaaagactttctttttgcttactgatatattcatcaaacctagcacagtgcctggcccatagcagaaattcagtaaatatttgttgaatgagtaagtgtacagatacaagcctgcacttaataaacaatcctaaatagggagtgctgccacgtgaatgtgtttttttgtaaacagtgttggctgattagaatgtgatacttgttgactgaaaacacataaaaaacttgcaagatgcaaagatgcatcaataggaaaattttaaatcattctccaactccagacaatgatttaacatgttgatgtgttttctttctttatgtatttgatatcataatgatgtgtcatcctggatatattattttgtatcttgcgttttcccacttaacagtcgaccatcagcatctttttatatttttacaaaaatttttataaagacttctatttacacatggtggagtaaaggtacatttctccttatctcactaaataacagaaatgagggggaaagaggagaaaatccatgtgtaatgaaacaagtcactggcaacagccccagagcatataccttgaagcatacctgccaaatctgtaatgtttggatacaggtgaaggcgggcataagattatacttatttccatggacttagagcaaaatataatttcccttgaattaagagtactgccatgaaagacatctccagtgttccctgaattatatgacaagacctagagctgtagctaagctgcgggagaagttgagagtgactctgcaaacatccaagtatcaccactgaaaggcagacagtggcactggaaggaaaaccattctgatgccattttaattttcctttccctagcctgctggctgagggatcttggtaaaagtgaagtggggaatggagggagagcaggcagcagttgtgcttaagggctttgctgtgaggcccattagaacaagcaatgggagaagcagggggcagaaaagaaaggctttctgaaagagctggccaggcttttaggaaaatgcattacttatttcagactctgagaacacactaagatgctaaatagtatttggtgaactgaaagggtaaatactttcttccaaagctatttggttgagagacatggccactatggagaaaataagccattaaaatcagaaataagaatgaaatagctgagcttgtacaaactttgtgtagtttacagaaagaggttagcacaaagatagaagccataaatcaaagattaagcaatgtggcacaaaagggcatgtgtttctgtaattgtaaaatgagcttcccagcaaaaggtgaagctgagcttttcaaattgctggaatgtcactgcttatttatgagcaaagataaaactcatttttagataaatgactaaattgaaataccataatgcgtaccattcaagtgctgttatggttaaaaaatgtgactataaaaatgtcacattattacggaacctatttgttggttaggtattttccaagtcctgtctcagtttattgacttccgctaggttttactaccgcctgccttgcatagccaatgcacagtagctattgcaaaagcaagatctagtcctttgtacctcacacagctctgaagaatctcaggaattctttaaaccagagctgatattgttgctaatgccattagatgaaataagaatgaaggcactttgttggcggagaccgtatctcatttacagaaaagcagtggtctctttcaaattcaagttcatatctaatttgaaactacatcttatattctgattgttctaccatttcccttgagtgcttaagcaatcatggtatctctctgccaaattaagtcaagacagagcttactatatgacttattaaagaatcagcaccaggctgtgaacagcagtagtcctgagcagggggtggttgtgtgccttaaagattattaattgcaatagactacccatgctagtaaattaccttttacgtgttaacatggtaaggccacagtgggctgaattgtttgcagatagacgacaataagaagccagaaattgtggggaaatggaatgtatactgtggtaaagatgggggagatggaggctacaagaaagaagagatcagcatagaagactgagttttgtgaagaagagagaggtgaatcaaatcatgagtcaaacaacaacatgagaggatggtatggcaggcttcagttctccaaagaggttataagaagaggaactcaaagaaatgaaaatggaatggcaaactaataaaaactagcacttacgtagcatataccaggtgcgggcactgttctaaatgctttatttatgttaattaatgtaaacaatgaccctgtgaggtcagaatgatttcacatctctaccatacagataaagaaaaaaaaaaaaatgaagcaagttttcaaatgacttgcccaagtcacacagccagcaagaggcctggctgagatctgaaccctgggaacctcagattcaagttcgtacttggaggcttataccatattgcctctctcagatgtgagtgacaataaaatagatgttttttcagagtttaacttttcattatatgaaaaaataagctggaagtccagctgacctatgtttaaggtcaactgttgactaattcatactcaagagagttacagcagagaggtgacatgccgtgcgactagcacaggttcttgtcagtggacgtcaggtggtaacgttgagggaaggaaaacagggtggattagagaaagcattttaacagcaaagcctagactgggaactgtggatttatattaggagaaatttttttttaaagaccattctacaattgaaaaatatcttattagaaaatgtgctaattttttgcaactttgcagtagacctaagctaaatagaatgtaaatatttcattgtcaccattatacatataaataaaccactgattttggataagtgtccagtaatttgtgtattattccttcaatctaggcctcttgggcaaaagttatattgaccctataggtgtggatttggggactacaggtttcaggaaatgttactgcattgccagagatattactaaatctgtagatttagccgggagatattctaaaatgcaagtgacaaatcacctttactttcaataactaacatagttgaaagggtgggaggaaggcttataggcaacttaaatacacatttttaaggatttttttcctctttcttttgatgactaaaatatcttattttaaagaaaaataaaatctgacattttagcgtttatctttggtggaaattgttgttaggaggaaaaacagttttatagagaagtttgagatgaacaattgccaaggactcgaaagataggctttttgtgtgtgtgacatatctaaggatttgtcttgacagtgtcaaaataacagttcaattctgttaaccacttgattcacaaataagtcaaaacaatcattgggctaaattaaactgcttttattttttctcaactttcttaatcaaaagtatatatttgtagttgtacagcaagcagatacaccagctcttttgaaaagtgaaaggtgttccagttatgacagtaaagggagcctgactgccataacttttaaagcacaccaaagtttggcagagggtttctctgcactttaactgttgtacatcaggttctccaggaaacagaatctgtgcaggaagcttagtagggactgctgttggattcaacacctgtggaaggaagggaaggagtcagagcaggcaaaaggagaagttgagctctgacatagtctcacttaaagcctcagccaacccatggagagctctgaagctaggagggctcttcggcattgtactgagttggagcaagggcacctggcctgtataactccatgccatccagttattgaatgaatacaggctgccccaggaaggtggctctttctagcccagggcaattcgtatagaaagctgaaagccaagggccatcaggcaacatctttcccaggagctgggcgaatatgtccttaagtcctgtaaaagaacctggcgattcatgacaatgccctttctagtagctgactgaaatattttgaaattttaagacagaaaaggaaataatcaagaataatatctgcattttattattaagacttaacttatatagtgttattacagagggaggccttcttctacagacaaaataagaccaaaagaaattatttaaataagcctattttgcatagaagtaatatatttagccaatactggttatcaagagagagagagagagaaagagagagagagtgtgtaacagatacacagaatgagacactttcagtcttatgtactgtattacgaccataaaatatttctgtcatttaatgtttgtggctctcttgtatggaaggtactattgtccaattctgctaataaatagaatcagaggggctaggggacttgtccaagatcatacagctggttactggtgtagtcatgactctaacctacatctgcccatattaaagctcttcttcttgttcctgtccttcattgttctagtccctggaccatagaggttttctatttcagtagataactttttgtcctcccagacctcagaaatttgtcctttaagctaagtgtttatctcctttggcccttgtcacagccttggctggtaaaaaggcaaggtgttttcttttcattgttgttgtttctgagacagggtcttgctctgtcacccagactggagtgcaatggtgcaattatggctctctacagcctcaaacttctagacttcagtgatccttccacctcagcctcccaagcaactaggaccccaggtgcatgccacaacacccagatgatttttttgtattttttgcagagacagggtttcaccatgttgcccaggctggtctcgaactcctggactcaagcagtctgtccatctcagcctcccaaagtgctgggattacaggtgtgagccaccacactggccaaggcaagtatttttatctgcactttagcgggaatgtagtgctgatgacagtggcctagcatcttatgaaaacaggactattccaggatggtttctgccctgtacttctgcctccatttagtcgatgaattaacaggtaaaagaaatgatgcaaaatgtggcaggagtcagaggtgaacttgggtctactgattcctaatcccatgcttgattccccctccaatgggattaacatgggaaaagggaaaatatggatatattgtaggtatactgcacatatattgtgggtgcagaacaatgtcaacctttcaatgatcctacgtaataatcattttatttatgatgaggagattgtggaaccagtagaaagaaatgatttgagtggccattaggaaaaatgtaagcatatacacttctaagaatgtgacttaaacaaattttgaaatgattttaaacttcctttaaatgagaataacttccaaggccttcttgattagaatgcctgaatgatgtgtctcttttaccgagagaaatagttacctgattccccacagttgaatcacatgacaagtgatgcaacttcattgctctgagacaatctgtttcctctgttttttaggattttgtttgtttgtttgtttgtttgtttgtttttgaggtggagtctcgccctgtcacccaggctggagtgcagtggtgcaatctcagctcactgcaacctctgcctcctgggttcaagtgattttcctgcctcagcctcccaagaagctgggactgcaggcatgccgccaccatgccctgctaatttttgcatttttagtagaggcagggcttcgccatgttggccaggctggtctcaaactcctgacctcaggtgatgcgcccacctcggccttccaaagtgctaagattaccagcatgagcccctgcgccctgcctcctctggtttatttttgacagcacaactgaaatagaaaaggttctcttgttacctggtttattttaatagggtactgcttgtgtcagaaaattcgagaggactttaagacatttatcagatatttatataatatttcatcttccataatataaaaaggaataaggagagtcattgtaatattttgagtcacatatattctttgatacattgaagtaaatgacaatctcaaccggaagtattttaagtcttttctcaagcaactattactttattcatgtcttcagtttcagctcaaatcttaatttaatggaagatttcaccaacggttaaatagaacggatacttctgcatgattaatgcagtgtcccctatatattgtattactctgaattataaattatttagcattttagtactaaaaacagatgatatgtttgccttttgaaatgcagatagagggatgtagatatatgtagataaaggattttaatccatcatgaacactttacacttgcatgtgtgttcattaacaaccacaagtcagtcagcttaaaaattcatgctcacaatttgtcagtattaatctaaaggtccctaaattggattatcactgttagtgctacagtaaaaaccaactaataatttaataatttattacttttttattgtcctgggtattaaaatggtcacagaactacagttataccatttcgtatgcacacatatataaagttatgctgatattgacaatttataaaggttgtgaatgaaatccaaattaaggatgcctttaagttctcttttattgactatatgaaatcaaaacttaaatatgattataatatctagagaattcacatataatgtacagtgattattaaactttcaagtttcattgttttggaagaagttttgtgtcattcatgtctgtttgcccaaatctttaaaagaatgctcatttcctaaaattctttgtgatctaaacatgagagttgagtatgtagagggagtatagggctgtaattaatatattaagtcctctaaatagaatggtgacatttgaccaagagaatgaggctattagtacaaggagctctcctagtagattaataatggggggtagggcaagattcacatgcacctctgcttctaggccagggattccaaagttacgtgtacaaaggcaggaaggaggggcacttgagtattatacagtgaggagtagtggatactgacaaattgaatggtgtaggtctggagaaagttgagtttgtgatcatttgggaatgcaatgccagtttctccacagcttctgactttcaagataagataaaaatatggatgttttggtgaaattttctgatttttaggacactgagtgggccatatcaatcccttatgtgggctgcatgtagcctgtaaacctccggtgttcacattcccatctaagtcaaagagagaccgaagtcttgggttgtcttccattttacacacatggaatgccaatcaattttgagtaggcaactaattatcttaacagaatcttcaaaatagaatcaaaaccatctttagatacatttaagttttcttctacaagtgtcaaaaatatagtaaccctccagttttttggtttaagccatgggtgtgtactttttagccaaagggggagaggcagttggaattctgtttcatttggcatattgtcttttattattgattggtccaaaattggacaccaccttccttattcacacttacctatctcagtaggagatttccggtcttgattcaaatctttgtggtcagtttttatctgatcatttgtctgtctgatattcttgatatgcttttataacatttttaacagaaaatgtaaatgctatttatggaacgcaagctgctcggctatgaagggtctcttgtgatttctcaagttgttttcatgtttggctaatactgtctgctagaacagaagtctgggaactaacgtggaatattaaacgactgaatacaagtttccttcccttccaagtctgtcttcaggggcatagagaaaagatgaatgagaatggaaaatagaggagtgtcactgagcagggggttaattatattaatttcaggctcaactcagcttgaaaacaatataatctataaaaaaatggaatttcaacaagaagccaatctcctattacctttttctttttaagaccacaatatgttatagtcatcaggcactcataaattgccgttacaagctgtttagaataagacattatacaaaaccgacttagaattggaaactctagggagatttttttttccctgttgcacctgaagtattttttccatgtgttgagtttccttttgtttgttcactggagaacatgggaattctgctgtgcttcttttacatgtgatggatgaggagggtcaagatgcaattgaattattttaaatactgaggagccaaatgtaaatagtactatgtagtactgtcccctcattgtatatgtgaacacagagagccatcatgttttccccttcatttatgctaagttgcctggcaagaattattaagtggtagttgggaatgggaataagtagaagagagtgaaaaaatagtccaatttcttccaatacaaacttctctgttcctccaccaggaaagcttcagtacctgtttcattaacaatagtaagaatctctaggtaaaaaaccattgagtagtgtcaataccttgaagcaaacgaatatttttcaaaatatttacagcagccatgaaaataacttagaacattgaactgaagtaatcagcattgacattgcatactatcctatttctcattactttgtcctatgtgcataagtaatcatttcaatgatgcttttgttaaaatatgtgaacatttatactcaattattcaaaagcacataatcatatgtcaattccttggaaattttagagtaaattttactacttcatcacctgtatctagataaatttattaggcacttgccgatggtcagtaatacctgtttattaagttgattttcaggctactttcatgagagatttcataaattagcattagtaccttaacatttaagcttaaacaggggttaggcattcataaattgaatcaagtgatcatggactaagagggaaggaaaatgttttttaatgcatttctggcccaccacccttccccttctattcaaccccaagagcctactttgccgtgaggaaggacatatttaaagttagaatctctagtgccagaaatttctactttatgtcttggctaaccagcgaggataatcagcaccttgtctttcttaaaattgacagggcacgtttttaaagtgttgaaagagaagtatacagagcttacaggttgaacagtctcaattccctggcttcagcaaagattttgaaacttaagttgttttcagatgtcagggtaaagccctgtggtcagttaaatgaatcagctactttagtcattggtattttctaacaaatacataaaaatcggaagtgcacactctgaaatataaaaatcaacattattcatgtcaatattcattttctatagttttgtgttacattcaccaaagggaacaatatatttcccagtttggtaagcctttcatctgttttagcgtattaaaaaggcaaacccgcttaaagattcaggtttaatccttcgaaaattaacccaatcccaggctttaaatgaactttgcctaaattcagacaagtacagagaacctccagtttattttgcccttttatttggaaaacagtatgattttccatgccgcccttcactggccccttcagtgcctcctcaaaagagcagtagagccttcatctcttggggatctgtaggaaacgccgttgttttgagcaggctccaaccatgtaaaatccacccctagtaccctgcaaatgttggataggaggagattcttgggatgtggtgggagcagctagtacttaaaaaacaatactccatcccgaatttagatgcttccaaaatcctttgtctctcacaaatccacttcttgattatgtcatggaatctgaatgaagttaaaggaatataaaataaaggcagtttctgcagcaaatttatataaaatatgcttgcttccttcaagccacatccccctctaagagggtggaactaacacttctgtgaatgatgacacacaaggattttttcgattttagctgtttgcccatcagctgcccattctctcactggtcagactattggttgctaagcatcagcattattacacccaaaattgcaattttttggtttctcccttcttcctcttctactcttctcctcaatggcctattcactgttgtcttgtcacccgagtacttaggtcaaagcatagaaactggaggactgagctgagcagtttggggaatggaagagtggaaccagcaactccgtttatcccatggagtcactgctcccagggcacgggtcctcagggaatgtccacaggaattaccactgcaggcttcctggggcctcctgcaagcagagatctggcgtctccaccatgattcacatcactggatgtggatttgtaaactaaagaaaacacagaccatttccatccacatgccacttaatagctgtcagccatggttgactcctatgatgaagtgagggtgttttcagacgttgtgtcatttagccctcaaggaagttctaggcaacttttaatgaccattatccccaatttacagatgaagaaacaggcttatagggagggtaaggaacttgcctatgttattcttcaggtaactggtggttaaaggcccgagtctggctccaaagcccatgtcctaaacacagccctgtgtcccctgcaccagctatctgcctcactcaccagtatgtatgatgcattccataaccttaaccttagcttccttttttgtcactcgttttcatggtgacagtgggataagaaggcattgctatttttccagtggcagaatgtttaggatatgttattcttatcttatgcatggtttgtaaaagatatctgcaattgatatatgaaatgctatcttcatatttgccttacataagaaacaaaatagaatgtctttttcttcctttcctcttaaataagtgattacacttgttttggaagaaatgccagggtagatggcaccttaaaatagttttggcaaatatgttcatgagttaaagtcatagaagtcctcataccaaccagattttccaatggcacaagtacaaactgaacatctgaatgctgaaaccaacttaggaatttagttctcaagctaaatcaactacctcttttctgcttacttcttagttgtggatagctaaatatttgctcgtggagctgaactgttgcccattaagtcgttttctcatgtttccccctcacctcccatctttcctaatagtcgttactgcctgaaatcttttattcaagtaacaacacatcatttgagttggatctcattttgaaaattttaataattagaactggagattgttcagattagctcttattttaactataggatatttgaaacaacatcagtatgccttttatatgtaagcagtttttcttaaaactgaaataatgaaatataataattatatcttgctttcatggatcactgagaatgctttgtaaatgaatcatcactgctatgcatagatgctcaaacgatgagactctgtcatatatgttttctctgagggttttagaaaagccggttatatacctcaatcgctatggcagggtttcttgacctcggtcctactgaccctttggatcgggttgtttgttgatctctgtgcactgtagaatacttttcagtatctctggcttctacacattagatgtgagtagcaacttcttactcagttgtcattgccaaaaatgtcttcagacagtgcccagtgtcccttaggggcatagtcacctctggctgagaaccagttcttgtcttaacaagatgagaaaccagttagacatcaaaacattagctctgttgatggtcaagttgaagtggagaatgtggctgaggtctaaggccaagttgaatttattttttctttttctttttttcagatacttctgcccaagggtaccatgccttccacggctactgtattcaaaaatattacaaccctgtgactgtctctctcacttactttactcaatttgtcctcctagcccccatctccacctgaaattcatattgaattgtttattgttctcctcctccgctaaaatgtaagcttcatgaaagcgggacattttttctttagtgctattaccccagaacacagatcaatgcctgccacataatttgaatccatgagtaattgttgactaaatgagtcaattatttagagacacttgctgtaaaaagatagattgaggatattaaagatcacaaacatagctgaaaataaatagttgaaataatttttattgaagaaggatggcttaaagtataatcattctacttaatggttttataattaattaatcaatccataattgagatttaggcttttccctcattttatataattagttttgctggtctatttttcatgtcaagcaaacaatgccttcagagaggagagggctttgagctacaaggaaatgaggagagaaagctcagatgatgcatgaagtgagaaaacagtaggaaataccaacatttcttatgcagtcagtcactcaaaatacatcaataagcaaaagtctacattgggtagtttcactggaaggtaaggagggttaagcacaatattcctttgaatgctgttttgagtttcagagctaacaattgagagttttgaatttcaagtaagtaacaatttatccattcagagtttaaaatttgtattatatattttcaaatctttcttgatttatacttattttttcagctccccaaatttaaccagttacatgtatttaagtgccattatcctcaataatttgaactgaagtagttgcctttaataggaaatatgaatttcatcatgaaaatagaacacaaaattcttagcttagttataaagtccagaaatatttgggctgaaatgctgtaagctgagcaaataataaagatacacattctaccaaatgtgttctggtcttgaaaaattaagaacatgtgtcccaacaaggtagagaatgcagcctcttcaggccgtgtactgaccaccactgaaattttatatgacaagaatcacatcctggtcatgggcagatgccagaattcactagtattgtcaacaaaagggctatgacaacttatcttttaaaaaatgttgtatcaaattttttgttattggtttattggaatgccctcatgtgtttcttaattataatgcctatttagctctttcaaagaacctatttcttacttttaaacatacagtcaaaatagttagtaaaaataatggatttgtttttgtttttcctttccccatacctacttcctgggatatataaaaagtcctaaagaggctagagcaatcctagggctatggattgggcacctgtttattacagattacttaaagaaatggaagaactaaagtgaatattctatcccagttctttgttggctgtggcttggagaggagttgcctcccccagtctcacagtgcatcagcgatggatcctgcctgaaaccccaactcccatgatctctgtacagcattattcccatcctccgtttatggtataatatggccatattttatccctcctggactccaacattgctcaacacccggagtcaggggatttgttgttgttgttgttgttttagagacaacacagtcatggttcactgcaacctttaactcatgggctcaagtgatcctcctgccttagcctcccaagtgcctaggactacagatgtgtgccaccgtgcctgacatttttttttaagagatagggtctcgctttgtttcccaggctggtcttgaacacctgacttcgagcaaccctcctaacttaacctcccaaagtgttgggattacagttgtgagccactgtgcccagccttcaggattttttggtatagttttataatgatgatgggatgagtgaaggtgacagggaacaaagaaagagggaaaagaggagagggctgccaattatggaaattctatctggtagaacattttgttcaattaatagacatattaactttccagtaagtgcaaaacatataataggtgatatggagggatacaaagataaatatgacctggccctgcattccaggaaagcatgccctctaatgattttcttacttgaaaaggtccagtgcagccaggccgtagccacagatcttcctggaagtgttagcaattgaaataaattatgctcatggagacccaaaagaatggcttaccttacatggttcagctaatagtatttttattattccttagaattccttctcttggggacttttttaaaaaactcaaaaatgtatttgctttatcctgtgatttgctctgtgtggctctatattttctaagtatattaacatcactaaatgaggttaaaagtaggattccaatgttagcagtgagggagtagagcttgtctcaaatagctgatgctttttgcaaaagcgaaataaaacttcctcttttctctttattcaaggagaagacagttttaccaataaatccagttagatcctgtctattgcaaagaatagatttgtagactaatagaattttagagctgtaaaattagggataagctagacagctaaatcggtagacacttagtatatatcttccttctagtcattgaataataggactcttgaattcatttctgatgatttattggaatttgggtaaatgaaagtagggttgaaatgatctagttgcaagtcttttgacattttggatccatagtagtattaagccaaaaagtctgttttcagaccttttggtagccacataaaagtaataattttgactactgacatatttaaactgtgacgttctaagagagattaatgatatggatacaattatagatataatgaaagcaattgtcaatggattgtgtagggatttttccaatcacattaattatattaccaaataattaaaacatcgttgaggcaagctttctaggagtgatttccagatgtgagtgagctaatctttatcattagattaaagataattcaatgttttaatgtaactggaacaaaaaacatgtgcttcagtagaaccttcaagaatccagtgttatttgcctgactttattttacccacaaattgtttgaaaggatagactgtgaattctttatcatctataatatattacagctttctggaaggtctatgtgagaaacactttttaaagcttgctaggataaagtgatggtcataacatctttaccacaaagaacatctgtttaccagctcttctttttttgaccggttgtaggagtgctttagggagtgatttctttccttttttttttttttttcttctcttgacaggcctctgtgcttgaggccagactgcaaagataacaatagtgtgtgagtgtttttctatgtgtattcatgtgggcacatgtgtacagcatgctaaaatcataagcatagccatgtaacaatggttctgtttcatgatttgaaagtcattgacacttccacctatgagtagataccctcaattggaaaaaatatatatccatattgatcttactttgtctccgttctaattaagttttcaatttctagaaattcttttcattttcaactaaaataatgcatgtgacatgacaccttggtataatggacaccttattcaaacagttctgtttgtatcttatttttagaaattataaaaagaagtatattgttttttcacctaacataggaccatgaagttctgcaaaagaaggcaaagttgaatttgggaaacattcattctgatttttcccctgataacgattttctttttaaaaaaaataagctaaaagtgtttccctttttatttcccatttttttgttggcctttgaatatccaacagtaccaagcatgttatgagcaagccaacgtatagatagtttgttgttacatcttaagtcagtaatggtttttcttaaaaatgatagaaatgttgacaaatactgaatatatttcaattttcctcaaagcattgggattcccccatccattattacagatttcaaaggacatatgcctttcattccaattttcgtaacaattgggatacaacttgaaaatgttcagttcccaagtattttttatatattagttaaaggaatgggaaacctagaaataaagtttattcttttttattaagatatcttaactcattaaaggaaaaaagacatataaaatagctttcactgtgtggaattatggtataggcaatttatattgcttattaccttcatgttcttgaatagtgggatggtaaaaggtccctgccctcatcgtctgagtccccacagatcagttacaatggagttgtcagaagaggaacatattcactgatgaaatgactagttataaaagtagtcttctaaaaccctatcaagttaatgtttctgttcatcagtttggggctgattataagatgcttataacaatttaatgcagtaaaaatgctatgcatagtgtacatacaacccatataacaaaggaaattgattataagtattctttaatgccaagaaattgatgttgaaaaattgcctgagtcacatataaacccattgacaaatgagaagccagcagaattggaccaatgaacaattgaaaattagagaacaaaaatggatgaggacataagatgtttcacataagaactatgtcagaatcaaaagatgagaaaatatctggaaaattgatgacgtttttgagtatttctgccataacaggtctagtttaagctgcactgttgtaaagttttgtacaaaaaaaatacgtcctgaaaaatcaacaattgatttggtctttaatctagttcatagcttaaattatagtttaaactttgttccttgtgatataatttttaatgaaagtcatttaagataatattccaatgtgatctttgtcactatttctgtgaaaaagtagattgacccttttctgttaccaattattctctgataatgaaagcctctggaataaagccaccactctgaattttctatcacaattaattaggaatagaatatgcctcagttgattccttcgtttaaaccacaaattatttatttgcgtcttttcagaatatttttggaacgcgatgatcctcaactctggttacacattaaaattgcctgaggagtgtttttaaatacagatgcccagttcccaccccagaaaaattaaatcaaaatcccagggctgtagagaggtaggaggtagagcttgatatgaactgttgtttaaagcttcccaggagattctaatgactaccactgataatacctctaaagggtattacaacttccagcaagctttccaactaacgaaatgaatatagatatgatttgcttcctacccacactgttttaatacatagaaactttcaaggatttcccttatataaatcaacttttaaaatgacagaaaattagatttttattaagaagaaagagaaaattcttaagataactaatttctatactccacactaggtatttcttccatttgctttttctgctatttcctgtctttggagtaattatcatagtgtttgtgtttctgagaggttgaagatctggcaggcagaacctcagcaaagtcaaaagacctcatgctttctgatccctctgctgtttcatcccattgtgcatcctactctagccacacaaatatagtctttatttcctatgctgtggtgcttcatcgggccatgatgttttgatggggctcttctctgcctgtggcagagactacttatctctatcacagtctctcctggcaagtctgaagaccacctctggacttccacagccctttgctcccccatcagccaaatatcctttgtaaagagcagctgtgttgtattcttccctattatgatttgttcatattagatagacacccagcaagttcttatgaagttagggaataatggaaaaggacataatggtgggaagaatctcaaagtttcatttaactgtaataaaagtttatacaaatttatttcaagaattgcattttcttggtcttgtcccatttctacatttggaatacgttaagcatggtaatcgctgaattcgagggtccatcccagctaaaaagatttgtaaatacataaatacgttgctgatctttatattcagaggaaagaagcatcagaggtgattaagtaccatccaaatataagaagataatttattctatcttaattcagtttcccagaatttgattccagtaatggactattttaagatgacataattttttagtattattattttatttcagtatacaatagtatattttagtgtatactaaatagatattatagttcagatttgtgcattctttttgtacacaaaacccttacaaagggtttacaaggagtaaggattttttgtttgttttttttttttaatcaatgttgattactggggaagtcttataaattgttttcctgttttttagctcagactctgactcacaactcattactgaccaaccttacttccaagcgttttgatgcaacaatcatcttatttttcttttttgtgcttatatgggcatgaagcctggaggtcacagaacgtgtgtggtaggatcatgagacaggtctcaaaactgcctgcaggctgctttgcagcaagcctgaccaaaagttgggcctcaaatgggaagatggaatgaaagaaaggtacagagagatcagagtgttcatgatgaagtgagaatagacaggagtgatactacgagatttctttggaaggaggcttagcagaagccggaacaccaaagaccatataagggctaagacattcagtgcattcttgctgatagtgttgagtgctcttgactttccttaatcctaaagatcattgttagaaatattaaatatgtgtctagcacatcaattactatgacccagatctcatattactctgctatgcctccaacatttttctattgattcagcatatttagtttatgttctctcaaatataaaagtgttaccctttttcatgctttttctaccttgtctaaattctgctttgtgatatcttctcgttttattttacatcttctttccctcattaatagatgtgcttatttgattgcagaagaaaatttaaaatgtgaactggccaggcgcggtcgctcacatctgtaattctagcattttgggaggccaaggcaggcagatcacttgaggtcaggggtttgagaccagcctggccaacatggcgaaacaccatctctactaaaaatacaaaaattagtcaggcatggtggcatgcacctgtaatcccagctacttgcgaagctgaggcaaaggaattgcttgaacccaggaggcagaggttgcggtgagccgagatcatgccattgcactccagcctgggcaacagagtgagactctgtatcaaaaaaaaaaaaaaaaaaaaaaaaaaaaaagaactaattaaagacatgttattctttctgtagtggttgtgtacatagcatagtcactgagcagctttttttgttttgcatttaatgtcattaggacccagacaagcctgaacaaagacagtggtcagcagcatgcaacatcttctgtctgtgtttggacccagctgtaacttggatgtttgtgctgacctcatcggggaaggctggctgcttagcaaatttagccaactctaacccaaaccaaatgagtttgtatacagtatttcagctgtatgtcaggagaccagatgatggctttgcttaggaggaggggtttgtcagtgatgatgacctcttgttttccaaaaaagcaggatgatctgatctcacccactgataccctctaggaggcaggccacatctggttcatctaattactctgtttaaagcaacaaggcttatgaatgatcagcaaagagcaattttcaaaatcttggatgctcagtgtttgttaattatgttatcacaaatgtattaaattggtaaatcaggtatttttagtgaaagttacttatctttttgtttctgctccccttatcagatgtcacccagacactcccggaaaaacgagttcttgtgttatcagttctacattgtcatcaaaaaagatgacaccactgcttgcctaaaagtctcaaaggtcatttgttacaaagtttcccgtgatttttaaaagaatatgtttttattaagccttctttttagaaatgtccataggtttgacagcttttcttatattattagagtttctattgggctctcattaatagggttaaaattcactcctttggctaagttatcttctctgatttactgagttttctacttcttttactgaagtacaaatgtgcttagtatgaaccttttgaaaagaatcagcctccttaatcctctgttacaagccaagaaaaagactcatcaattgtgggcaaatgatgcaatatcagaagacaactttatgttccttgtcttagtccattcattcaacaaatgtctattttttgttatctccatgcaaatgagttacaggctacttgaaatcatcttgttttacagtaaatttttggttgtccatagtcaatatgacatggctctaaccaaacaattcatttcaaccatggatggccaggtggggtggctcacacctgtgatccagcaatttaggaagctgaggcaggaggattgcttgagggcgggaattcaagaccagcctaggcagcacagtgagaccctcatctctacaagaaacttgaataaaaaagagaagaagcgagaagcatggactctggtgaactttacctagaacagtcctggaatcatcaccagctttcagttattcattgccagtggatacagaacccttctacctgggaaatcctttgatacacgtacatacaaagatgacattgcgtaggctctacctgcttgtggttctgcctagtacctgaccaattacattgtcttgggtactttcaaaagtactttttcttattggttgagttagtacttggcatcagcagaattttagagccagaaggaattaaaaattacaacagtgtggataagtcttccaaatattatgttgagcaaaaaaaggaggtgggcagcacaagtgtacataccatgtgattccatttctataaaacccacaaggcaaaccaatctattgtgttgggattcagcatagtgattacctacattgggtaggaggacagtgactgaaatggggcagaagggagatggctttaatttgtgaaaaattcatcgttatataattatgatttatatatttttcagaaaaagcttcataataaaagttatgacataattaagcaaaaaaaaaaaaaaaagacaactgctgtagttaaagcaggtgatatggtttggctgtgcccccacccaaatctcatcttgaattggagctcccacaattcccacatgtcatgggagggacccagtgggaggtaattgaatcatgggggcgggtctttcttgtgctattctcatgatagtgaataagtctcacaagatctgatgattttaaaaagaggatttcccctgcacaagctctctctctttgcttcccgccatccatgaaagacatgacttgctcctccttgccttctgccataattgtgaggcctccctagccaagtggaactgtaagtccattaaacctctttttcttcccagtctcgggtatgtctttatcagcagcgtgaaaatggactaatacggcagggattgcagaaagggcccaagatgagaatggggtaggggtgagccagtatgaaaaccacaggtttaaccaaatcaccacgttagggctgaagaaaggcgagctcctccagagacgatgaattgccccaaattatacagctacttgttgataacatttattaacttacttaatacatgtatattgagcatgtgccacatctcagacatggagcagatgccagaatatagttggaaaccagactgacccagccagactctaacctcacagtttagaattcaagtcttccagctgacacatttacgtgacctgtctggactcagtagacatttgagtttacacttccttgattcacattaatcttcctatttcagaataccagatacttcattttgttaaggcacagactggacttgccttcctacttctacttgttgcatgtttcattgtattcaaggaaaaatattttgagaattgagtgtagactaatattctttatgagagactggtcttccagagaggctgtgatgaaagcagagagatttcttgcgagtgctcctctgggcttgcaggctagagtgcccaatatttctgtgcgggtagactcattcacatcactgggctcccaggcttgtcatttgatcaggctctcatctgcatgtcaatgaggcttagagcccatggaaagaattaactggcctgggatgtttatgcaacttttcagcaaaggcaatttaaaggaaagttgccctgactgaaatgattgtcttggagcagatatatagtgaagtaatcatgttaatattatgtgactcgggttatatgatattttcaatgatcagcctagtaggagtttaaacatgagcaaaaacacaaactaatcaaaagcagtaaatgaaacatcccttttaaagtagatcaactggacttttattcatttttatactttttattcatattaaagcatagtacaaattcagatttcctttggagtatatgagccatattttgtattgcatttcaaaaccaacaatattaatttccagttgtatttcttttcctttaggactaattaaagaaaatatgtttgtttttctaggcatcactcccaaatctgcaagtgccaggatataaagtctggttttatgttccaaaagaatgtttaggttttgagatcatataatctttagtataaaaaactttgtgtgtgagagggtgcatgtgttctttgttcaagagtttagcctcctactgtaaacatttctagagaggtaagcaaatttcatgcaaagactttcctattgcatgtccacaggtcatataaacaaacacataacaaattcaacttaggtataaaacaatgtttcagaggatataaattaatggttaagatctcttgaagtttgcatattctcttttgtttgttttaatgtccttcatatataggatgacttccccaaaatatctcatgagagtttttttcaagttctttcaaactaaaatatggtaatataagatcatgatttcccttctcagtaaagctgaagcaatcctatgccaatgttggtacataatgaacccccatcttataaggtaattaggtgataaaccccgggtgtgaggcaaaaattgtgtctagtcagaaggaccttagaaacctataaaattgcccataaaatccaccttcccataaactcaacatgccagtgtttcctctcgttgtctttgaacatcagatgaggtaaggccatattgtaggaaaaagtatgtttctttaacaccagaaaagtacctcacatggtaagatcctgataccatggaatctcccctcgcatgttcattgtcaggcctagactcacagaggggaatggagtagaatttcccacactatgccagttgttttccttttttcctccttatctcgttacagttgaatttaagttaaatgtgtacatgcagtgacaacactgtatctgtgaagcccctgttgggcttttctgcacataacacaccaacagacatgtcaagaaatacgttgtcaactccgaggttaaacacttcaaaacagcacttatagtgagggaattgggtggtctataccccaactctcctgttagataccatttgattatggttcagaataactttttctgaaggtatcatttatgcatgtttaaatatatgtagatttatttaataactgactgaggtgaggttgacaataatataatgttgcaagagttagcctttcttttttttttttttttttttttgagacagggtctcactctgtcacccaggctggagtacagtggcatgaatgatcacagctcagtggcatgaatgatcacagctcattgcagcctcaacctcctgggctcaagcagtcctcccacctcagccttccaagtagctgggaccacaagtgcctgccaccatacctggataatttttgtagtgacaaggcctccctacattgctcaggctggtcttgaactcacaggctcaagcagtccttctgccctggcctcccaaagtgttgggatgtaggcatgagccccatacctggtcattagcttcctttttaaaggatcattactcagtttatataaattaaaattttttttgatgagactgaactaattggtcacattttacttaaaattttatttatatacattcacacatatacacacatgtacctccatgcttcctaacatatttataagagctttcctggtttgactgcctctgggaatttgagcaccttctttctcttggttccagggtcagtccctccccagtgcctgctggcattgttgttgtaataagctctacaactaaccttgggcttgtcctcaatgcctccctttccttcctcacatacacatatgtgcttaccacatgtcatctgtcaccaaagcctgttggctctaccctcatcctgagtctgcccgctagtattactctaaacaagccactgaagtaccaggcctggaccgatgcaccaccctcctaactggctgctgtttctgctcttctagtttgatctctacctagctcctgtctgaccttattaaatcgaagttagctcaatactcttctacttgaaaccattcactggcttccctgtgcatcacagtaaattccaaactcctttccatgggccataaagccctgcatatttgtatctctgactgcctcctgatactctcgcagtctcctgtctgctggccttcctgtcttgtttctctgctaaggtcactcccaccttaatgcttttgcccttgcagcatcctctacctgtcatcttcttcccctacatttttgcatgacttgctttcttttgtcaattgtatgtctgccctaatgttacctctttatttttatttatttatttatttatttcaagacagagtcttgctctgtttcccaggctggagtgcagtggcgtgatctcggctcactacaacctccacctcctgggttcaagcgattctcctgcctcagcctcccgagtagctaggactacaggcacacaccaccatgcccagctaatttttgtatttttagtagagacagggtttcaccatgttggccaggatggtcttgatatcttgacctcgtgatcggcccgcctcagactcccaaagtgctgagatcacaggcatgagccaccgtgctcagccaatgttacctttttaaaaaagcctttcctgacccaccgtatttaaaaggacccacccttctcccattcctcctgacaagccttctttttttttttttttctttattgtacctttctcgtcctgaaaggattttttgtacttatttacttgttcatggtctgattaatccaatggaactgtgctgttctgtagaatagccactagccacatgtggctaattaaattaaaatgatgaaataaagactaaaattcagtccctcgattgtagtagccacatttcaaatgctcagtagccacatgtggctacttgctaccacattggacagcacagatacagaacatttccataagccagaaagttctgctggacaatgctgtattaaaatatgagttccctgagggcagacagcctgtttggttcattcactgctgaatgtccagaagctatgtctgatctgtggtgctcagtaaataagagtggaatgaatgaatgagtgaatgaatgaacaagagccttatatttttcaggaagaattgccctcatcactttaatattcatctttaaaccttccatacccctaaacagagttaattttcaggatcaaagaaagaaaaatttgtttctttgtgtgtgtgtgtgtgtgtgtgtgtgtgtgtgtgtgtgtgtgtgtatatatatatatataaaatactttaagttctagggtacatgtgcacaacgtgcaggtttgttacatatgtatacatgtgccatgttggtgtgctgcacccattaactcgtcatttatattaggtgtatctcctaatgctatccctcccccctccccccaccccacaataggccctgtaaggggacacttggaatatttaatcattgtaatgggatgccttctaatgcccttgagtttgccattgttcaccttgtgtccttagagcctcactctggggactccatcattcaaataaaattcttatctgacttccgggagaaaggcacatttttcctggtctccttttagcatgataagcccttttccttcctctgtatccactgtgtatgcacaagatttttgctaacactcactaaagcttacagttaccaaagttagaaacatggcatgcttatgactgtgggttgttattggcgctattttcctgagtttaccttgtgaaaaaccacagtttttaaaagtgtcttgacagtgtctgaacttgcagcaccctatatcataccggattggcaaggtctgctgctgtgtaaggattgtagctgagtgttgattaaaagcagcaccctctcgcttgcttcagagctaatacccttataaattgttgctatgaacttttgaactcagagaaacttctgaatatatgtaataagaagtaaagtaatccagggctgagaatttgtgtcttccctgaaacaaatcacatagattaaaaaataagtttgattcttagctttttaatggtttcttaaatctaatgttttaaattataatctggagcctttatactttatataaggttttcaaagaacaattcttcatatacaattgtttacataagaaatttcataaagtagatttgaaaatcaccttcaaataagaattctgtcagaaataatatgtcatttttattttaagacagataaatcacttaagcccagaataatatactaaatcatgttctgaagtgtagattctagaaatgtattagattaaaacaatgaaaataatgtcatagtatttacatttttgagtaagttttatatctgatgtcttattttcctgagtaaaaacatgagatttttatttttatttatttatttatttatttatttattttgagacagagtcttgctctgtcgctcaggctggagttcagtggtgcgataccagctcactggaacctctgcctcctgggttcaaatgattcttgtgcctcagccttctgagtagctgggactacgggcacgtgccaccacgcctggcaaattttttgtatttttagtagagacagcatttcaccatgttgcccaggctggtctcgaactcctgagctcacacaatctgcccacctcggactcccaaagtgctaggattacaggtgtgagccaccacacctggccacaacatgaaattttgaataaagcaaatataattttcagattcactatgcctcactccagaaagcgtatgaattagtgaacagttttatttaataatacattatgagagaaatataatagctattaatggaaagttgtattaattttatttttattggaaaaggtaaagcataatatgtcttcaaaagccgaatgatagacagctaatgaatctaggcttaaagataaaaatcttgttctttaacatgtattgctagccacaaataataatgccttcagctcctccagagagaatctcatgctgcaaggattcctgtatatgaaacatgcaataccaaagaacctgcttaagaacctctttatgcagtcacagttgattatcagcacttgtggtagggctctttcatgcagaaaaaccttgttccagggagcacctgaaaccacttttccagcattcttttttggattttgttaacattttgatgtcagaattgcttttggctcattgtctctaagtattcctaaacgtttcggaacatggccagcctttttgctctaaagattatcccacaacaagcaaatatgtaagaatgtttgcaagtgcttcagatgtctatagtggcaccaatggaatagaatgcctgatgtcatgttggagctggggatcttctgtcttcctgactggctcctcagcctgccccagaaactacatttcagtttctttcttgtggacgctggtgatgaatagggttgtattagcaactgaactgaaaaccaatggttctgaccaactccaacatccagccccacataacctcatcagcttaagatggaatgattttaggcttagagttcaatgtgaatcataatcttttcttcaccagttcttgctctttaattaatgaatgttacttaacctatgtctccatttttctgtctctaaaatgggtgcagttgtaccaactgtgcagaattgtaaggtttaaatgttaggcatgtgaaaaccacctggcacagggtagttgctcaaaaagtagtactgtctgtttagcatcatgaaattcagtagctggaaatctacttgtagaagaggagaactctgggttttttggatcatattcacttagcacctaaattttattttgtaatttctccatgaaatgtctctaggtatactccataagaaaaagtataattatatataccagaggtcctcattatctgaataatcaggagatgaggggaaaaacacactaaaaagttaagccacaaaaaactagaaccatgtttcatggtaaatagtgaaaaaaaaatcacctaattgaaacttgtcttgaaaaactaaatgaattatgaaaataaggctattaatacctatattctataaaatttgttagtttttaaaaatgaattggcaatcagttctttcagcaaaattttacattcatattacattacatcctttattttgtgtttgaatttacagtacataatcaaagatagtcatttttgaaaaaaaaaaaaaaaaagtctttgggctttatcagcttacccaaagacctgtctttatcatttgatagtcagatcatactcttatgaagtatctgtcacacctccatctttgctgatatctttctgaagttatttactgctccaaattttctagtggcctggtgtgtgtttcacttactcagcatcactttctctgacctcgtgaatcctgcatctctcacaagctttgcaatttcacttctaaccttacttgcattgtgtttgtgttgcatcaaaggaaggtttaaaaccttccacaaccagcaaggttccaaacatgttgatttaatgaatacaaagagatgatacttgtaagcagggatgtttgaaggagctgtttttttaaaaaacagccaattcatgaatattttcatgtcatgatgattttacatccctatgtaaccttgaaactgtgggaggctggagaatcaggccttgctgtgtggagttactgtcatcctctgatgaagagctccatcgatgccttaaaggtcccagcatgatcatttctagcatgtttgctcacgccatcccccagattttccagaacagcctttccacccacattttttgatcctctgctgtcacatcatcagttcctaatgacaaactagacatagaaaaaagcaggaaaatctttcataccatttatcagtacaatcagcttttagctatctgtaaaattggccagtaatgattatgaaagaatgatccattttctactcctaggggatagattcagtttggggacaagaaaacagaaagaaatatatgtgagtgttttaaattccagctgtggaatcctaatttcctaatcatcactgatttgcctgcatcaaataattttgcttatctaattaactgaaatagtggagtccttctgtaatgagaatagtaattaaaacaataacaactaaccctctgttgagcacttactttgttccagtcactattctaaggattttgcttgtattatcttatttaaccttcacaatgccctcagataaaagtgtgcctattttatagacaaggacagtgagtccccacctcttaaaatcctatgagcaataggtgatggagtagaaatttcataagactgtgagatgaatatggatactgttgcctttgaggtacaaagaaatagaaagattatcagtatggctcaccatagaggaaacattggagattgaggaatctgagtgttttctgaccccaggaatggagcaaattgaaagaataacagtggagaaccacatttttcctctgttaaaccagagctatctagaggaactctgcagtattgacgtgaagagaattgtagtggataagaacaaggaaaattcaaggcttatcagtagaaatggaatgtttgaagtcggagaactcataggaatgctagtaccaagtacagaatcagattagctggaggagggagctggagaatgtctacacttcactagataatgagagtggagtgagccaagaactcagttggagtttgacggaatgaagcagagggtccaactgaggctgaactgagcgtgaactacattcagcggcctaggcagtgccctccttgataagataatgataacaaacatatgcaaatgaattaaacagtacagcaacatgtggtccagctagcctcaccttggactctgaaaagttccataggggcttaagtcccagacaaacaatatagccaagagggaaagaacctaaagaacctatgcttaaaacattagattgagtttccaggtcaggtatcataaattctattttttttttttttttttttgagatggagtttcgctgttggtgcccaggctggagtgcaatggtacaatctcaactcactgcaacttccacctcccaggatcaagcgattctcttgcctcagtctcccaagtagctgtttttacaggcatgcgccaccatgcctggctaatgtcgtatttttggtagagatgggatttctccatgttggtcaggctggtctccaactcccaacctcaggtgatctgcctgcctcggtctcccaaagtgctgagattacaggcatgagccactgcactgggcctgcttctatttttctcactgacttggttgcattcagtgccagtaattccagtggtcacatatccatgttgtctttcttgcctgttctaccagttggcattgctccctggaagggacttggtctacaactggcagaactccttctcctaaggccttgtgtaaggtcactgggatagaccatggccctgatggttgatattgcctccccttgccataccttacctgggaaagtgaggcccaggagaagggaaaatgggtgtagaacagatgtaaacacaagtgtgtttaatttgaggatccaacatgatttaagaattgaggataaagtaggaaaactaagtatccattttccacagcacctagaacagtgctagacactggtaaggagttaaaaaaaaaaaccccctcttggttggtttaatagtttggaaatgggaaattttttaaacacactacatttaatgcatctgaaaaaataagcatttattgtcaactatttatttatttatttatttatttatttatttatttatttatttatttttagagacagggtcttgctttgtcacccaggctggagtgcagttatgcaatcgtagttcactgcagtctcaaactcctgggttcaagcaatcctcctgcctcagcctcctaagtagctgagactgcaggtgccctccaccacaccaggctaattaaaaaaagaatattatgtgtgtgaagatgaggtcttcctatgtttcccagactgtccatgaactcctggcctcaagtgatcctcacctcagcttcccaaagtgctaggattgtcagaggcgtttgaaccagagcaactccatcttgaataggggctgagttaaatgaggctgagacctgctgggcttaggaagttaccctatatagtctgaaaaggggatgcatgaataattcaccctttgtttagcatataatcaagaaataaccataaaaatgggcaaccagcagcccttagggctgcgctgtctgtggagtagccattctttttattcctttactttcttaataaacgtgctttcactttatggactcaccctgaattctttcttttgcaagatgcaagaaccctctcttggggtctggatcaggactcctttcccattaacaggattgcaggtgtgagccactgtgcccagccaattttcaacattttattgttcagctatttgacatagatggaagactttaactggatattcgaaaattatattcaagacatatgtgttatttgtaccaccacatcctttgcctgcttataatgaaaataaaacaatgtttatgaatgtcatgctaatgaagtcatttgcactacgtgctttgatacaaaggtgcagtcaacagccaatttgaggccaagttgctttcatgtaaaaatttttttttcattaatttcattttctttatttcttttttttatatttcaataaattttaaaaatgtagacagaacaatgcaggagacctgtcttctccccacctatgccattagaaaactgtgtgaccataggcaagtcactgggcccttctagatctcttttttccacatttgtagacctatacaattgtgagagataatcctaaatttttaaaatatactgctcagtgcctttttccagtgaaagaaaacatagaaaagaataactgttaaaaagagacatatacaaaacatttgggtaagactagagtttgaacataaaatgaatctcaaaagaatctgccatctgtattggtgatctctcttccccttggcttcctgtctactttgttgcccccatgccccgacccctatttaatcccatttagcttatttactcctgtgaaatgtccatcttctttttgctttccctaattccctgtctggactctttggaaccatgaaccttattaatcgtgaccaattttatgatatatgcttttccccaaaatgccgtatgtcttatgtttatttttaaataattaggccatgatttgtttggggataagactttttctatagtaccagtgcaaaaaatgtgggataccgtctacggctaagccaaacttggcttcttatagaaagatccctctggccaggcgtggtggctcacacctgtaatcccaccactgtgggaggccgaggcaggtggatcatttgaggtcaggagtttgagactaacctggccaacatggtgaaaccccatctgtgctaaaattacaaaaattagctgggcgtggtgacgcatgcctgtaatcccagctacttgggaggctgaggcaggagaatcgcttgagcctgtgaggcggagattgcagtgagccaagattgcgccactgcactctagtctgggcggcagagtaagaccctgtctccataaaaaaaaagaaaaagaaagatccctgtttggtctcatggttttattcattaatacttttccattcattcaaaatattcttgtgtgtctatgccaaactctgtgctgagcactgtgggttatggtgaacaagccaaaggatctcatcaggcgggatgcagatgcatggacagataataataggaagtcatggtaagtatgtcgagcgtcatttgctggggaatttttcacggaggaagaggcaggtagacaacctagacttgaagtcaggtgtaaacttaaaagcttccttaggagttacttcctaagtaacccctaagctgagtttttgaaaaataagtttaaagggcaagcaagtgaattagtcagggtcaagtcaacataaacagaaaccattctaaatattttatacagaggaaaattataatagagaattcgttactccaatgctgaaagagctgagccaccaaactaagcaagataaggcaatcttgatactagcaaaagcagggaagccaccagctcccctagggcttaaaggacaaagggaaaaggtctattaccacccacaagttagggccactagcaaagctggaatgatgttcagctgctgaacagttacaggagctgatgacatagaagacactgcctgtggcagggtgagtatgtatgtgtatgtgagaaagagagacagagaaagactaagtcccttctccaagccctccagtcttctgattgagtctgccattggccagatttacctggaagccagtcagttggcaaaggagcctaggaaatatcatttcctgagagaatatatctgagagtaaataggcaaatgttcacaccattcattggcaagtgaaaagccaaaggttgggtgttggatggcttggtgtggtcataagagaaggaggacatatacagaggtatcagcataagccaaagcaccaggacaagaaacagcatgagatatgcacagaatctcagtctgtgtcataaagtttccagtatgagtcagagattgataggagctgaatgtaggcaggcacccaacatgagaggcttcgtgtgacttaacggagttgcggccatcttccctgtaggcagtgggaaaattctgaaaggttttcaacagggaagtggcaagcccatatttgtattttaggtcactttgacagttgtgtagactcctagaattattttttagaagcaaaaatctaatttatttgccttcgtcttgtccttctcaaattcattcaagcaaaaaacaatgagaaacagcagtaagaaaatggtaggaaggatggaaaacataaaaatttaattgacaggatgattggatgtacaggtgagggagagggaggatccagggatggtacccaagtctgtcacctcagctgaggttgatggtattgtcaagtaaggttaagtttgagttgggagcctaagggacatcaagcagagatatccaggagcagatggaatctgtacacataggtattagtgggtgagtaagaagagaagtggaccaagacttgaccatagggagcaacaaatgtaaagccttaaaagaaaaagagagtatcagacaggtccaggtgtgattggatttagtaatagaagataatcttattctagatcattttcagaggaaaaagtagtagaaactaaattgtgctgggttaggaactaaaaggaagacaagaaagtagcaatggtaaatgtagatgtgtcttttgagagtttggataagacgagagaaaagacgggatgaaatccaaagttgggatgggtttcatttgcagggttggtgagacttgaggatgtatgtggtcaggttccaaaaaccagagatgagtttctttagaggatagagtagagatagagactaagaggctcagggctggagtcaggcctggagacacttgggggaatttcccacaactgtttgccaaggaactgcacttatgctgcaaagacagtgcattcagaattccagtcttggcaaagaacccaggtagcactttcccgtttcaagcagaaagcgcctgtattactgtgtgtgtgattttaggagataaatagtaacaaaaactagcagttgtatagcactctgcatccttcaaactgggctcagagtttcatttgaatcccatgattgtctcgtacctgtgtgtgcataaattatatatatatatacatacaaacacacatatataaatataagtgtatacatacacacataggtctatatatattttatggtctctgagaaactcattaggagcctgagacacacagcaaataggacttgccaaacctttcataattcatacatgatttaacccaagtcttctgactttggagtcgtagggccatctctaacagactttgccattgcaattaacagactttgtcattctgatagattggcctagagagtggcaagtatataggcactgtccccttcactttacttcctggttccctaggactttcagcctcagatagtctgggggctcctcctttggataccctagtgttccaggtagtaaatggtttcgctgagtaccatagagtcagttttcctatgatggcagctcctcccctcccagcctcctatattctggggctcttcctttccacacacaagaaaaggtgcctcccaagcccttgtacttgcagaacttttcgtcatggcctcattttcaaattctgtcatccttctctgctaccagatttccagtttttgaacctcgtatatacagaaatcacacatttctccccatttctactcaagcccatgccacacaaacctggtgggactcctgactctgtcatgtaccagctggaactaactgagcaagcgactcagccttagtgaacctaatgataccttgcagagttattataaggatttcaggagataacttatttgaaggatccagcttagcaccaggcttaataaatcttagctcctttctcccatcagagtggcctggagctcttatccacatttctcagcagttagcacagtaatataattagcaacattagtatatctaaaaggcaattaccatttaattgctctggccccagccagcctgaagtttctctccattcacttttaatttggggttaggggtttttagtcctaccctggctggtcacaaaatcactgcctcagagagaattgaaaatagctgtaggcagccattgattacacagtaagagatttggtaattccttccattttgtcctatataaaaatgcacatatcagtttgctcccggccagcgaactaatcagttccaagcggcatttttctgagtcagtgaaggatcgtctttggtcagaccagctctgatctcaagaaggcaagcactcccacagatgctccacactgatcttcattaaaataaattagtgcccttgtataggttcagactcagaatcaagtttcagccatcctttcttagaagacatttatttacattacatactcaatttaaaggagcaaatgcccttctctcagcctgtgaagtttgtttatgttagagctactgtgagaatataatgcccaaatgaaggcagtatgttttatttctcctcctctgacccaatgtcgcataaagtaacagcagtctctaatcaagaggaacccaatgtactttgagatttccaatcaaaatctttaatattcgaatggcacatgtgcatttgaggaaacctagattgcctcaggccacacggaaagcatttacatctgaaccactttacataggattgcaagttaaagcaaattctaaataacttttagcagtctgagatttggaaaacagcctggcccatataaattctcccttaattctttttctgttaaatcttatgccaaagtaaatggaagctgtagagaacctttgaactcagttctcaaaggacctcggtgaaattgaattggcagagccaatgttaggttttcaaaggaagatttttttttgttcccccttgaagtgtccacatcacaatcaccttccttggtgaaggatgcagtcttgctttctggaccttcttggctctggaccatgtatgtgcctctgagaaatgggctttctgctgtaaggagctcctcaatgggactcttcaggacccttggggttggcatccaggcttcttagctcctttgcttcacagttcagtcagctgcacttttccttttctctttccaaaagagcttttgaatgcaagagccctggggttcaacgccacctcttcctgccacttagagcaagtggtttcacttttccaagcttcactttccttttctgtgaactggagattaaaaatagaatggtatatttcaaaatagctagaagagaaaaattgtaatgttcccaacactaagaaaaattaaatgtttgagttgatggatatcccagttactccaatttgatcattacacattgtacacaggtatcaaaatattacgtttccaaaatatatacatctattatatatcaacaaaaaaatctgtatgctcaaaaaaaatagtatggcccacatggatcccacacatctctgaacattttgctcttgtactcaatagccatgcagtttattacattggattattctttttattgatatttattgatattaattaattattaaaatataaatatattttatatttcttatacatgtatgtatgtaatacaatgtaacatatatgacatgtattgtactttagtgtgttcttactgacaaatcatatgcctctggaaggatgggacaattgcaccctgtgtaccatccttagaatccaggccatgctgagcacacaactgcttcttaataaacagctaattaagtgcagtcttatgaaggcacctctttatccttctgtttcatagttatcaacagaaagtattattcatcagtcaagcaaatattcacaaaaattaactttgttcccctcatattttaatgtgtgctgtttctctagtctagatataaccctgaaggaaaaaatggcacatattttttgtcctttttatcctaatgtaaaggaacatatgacatgtttgctaattgtttgcaaagtttcatgtaagctttttttggttttgcaaaatatgtttttctaattattcttcctatcatgcatgtagaaagtcagtattatttgctataaattgttactatttgtggaaatttgagaaatagcatcacttagacaatttctcaatttatcatgccaaaactgaatctcaaactcaagtgggctatatgctgcctgctgtttagagtttttcttaaactgctctacagagttacttcaggcttggggctgggcctggtggctcatgcctataatctttgtgccttgggaggctgaggcaggaggatcacttgagaccaggagtttgagaccagccggggcaacatagtgagacactgtctctacaaaaaaaattaaaaattggctgaacatgctcctgtagtcccagtgacttgggaggctgaagtgggaggatcacttgagcccaggaattcaaggttgcagtcaactctgatcagatttctgttatccaacctaggtaacagagcaagaccttatctcagaaaaaaaaaaaaaaaattacttcaggtggtcattgtgcctttacttacacactgccagtataggggctaactactgctgaaaacagcctttttccatttcaagcaagtcatcttgagctggtgtacagaatgcttggaggtctttatgaggtacagaggtgtaaacaaccatatttattactgtctctgaaagagaagggagaagacaaattgccattcaaaaacctgcatgatttgtatattataaactcaaagaaactcttctcagtgtgttatatgttgggtgtaccaattataaatcatcagagggagactgagaaaagtcaacagaaatctgcaatctgacgtgtgtggaaaggcagtgactgagaactggtggttttggaatcagtcctacctggctttgattcctgtcatcattattagctttgagcaatctgctttactctctggacttctatttcctcatctgtgaagtgagagtgatattaaagattaaatcagattaaaattgtaaagaataacaccaacacagtggctggctcaagttggtgttaaataaataatacgcagcattattattaggttattttattattagaaccacaggggtttctatttgactgataatggatgtttcttaaagaagaaaaatgtgtgaggactctgagttgactatcttagtagccaattaggggaaagggggttaatagaaactgtcagcccccagttgccacctccccacagtagggttgtgtggcccagctttcccatctgcttccacagccataaacctcttatctaacatgcagcactaggagtttttcatacccttcctgaaagggctgatcaataccaaatactgatcatacctttatgtaaataaaacatcagctaatttcttattctaatctgtatttttttggtcaggccaatgttgtgtttctaaaagagctctcctccgaaaaagctatgatttgcaacatttgccagtttccatggtgtaaatactcccagcatggccaattgtaagctcttaacacaaagtcactgaacacagagtttggaagagatgtgcacagctgttcaagttgttgccactccattacaccactgggccaggctaaagcttatgctttgatagtataggacaggatgattgacaacagcaaaacctacaagcaaatgcagtagagggaaaatagtttgtcgtagagtggatcactataatatacttggattcatccagaaagtgagttcatgccagattactcgagcaatgtatctcaatgccatctttctcttcttgttctgtactctccagtcatacttagaagagaaatatttccctagcctcttgtgctgtaggaaggaaagtctccctaatcacttctcaattgtttgaatgtttccttcaccaatagtttagatatttgctcgtggacataatccccatgtttataaagatgtcttctttttctccctcctctttcccttccccctctccctcccttcttccttccttctttataaccatccttacttccttcagaagtattttccaccatcttttgtatttctaacatccctacaagatcatcagaacaggcaatagtacttctgctttgcaaaattgtagagaaactagaaaaccattctacttgtataaatctctgtcatgttattgctctcatttttaatttgtcattttgttattttgaaatcttcattgttattgagacatcccgtactttaactttcttccatgagtggagtggtgtactttcaacctctggcttttcttttgtgtcataaatttaattttattctctccatcacagtttttgaaaactgtattatactgtatataggaaattgtattacagtactgtaaatacatttctgagaacttttaattaagtgatgatacctaggactttctcatcataatcaagtccctggagatgacaaaatagaatccttttgggaagcagttctgttttcagcatctcatcactggagcaagcagaattctgttacagactttgaactgttagggtgatatcagttgatgattttatcaacatagtggatttatttaaaaatccaggttgtctcactaaagacctcttaaaagtattccaaaagcctagtgacaaacagaagagaaaaagacatttgagataacaattcggcatttaccatgaagccctctgcagacgtgcttgagatcatcacttgtaccatcctaatcttcatgagcatcgtgggaaacacgtttgttttattctacaagaagatgtatcactgggcatttacagacatcctttcttctaattttcaatcttatttttgtccaccttattaaaaacttggtggtgaatgttatgaaaattgtttactcttctggtatcatattggattcagctggctgcaaagttctgtgctttacatcagccctgacaacttcactggccatctgcttcatgttacactttgcattgctttaccactggaagctttaccaaattgcccaccccttgggtgtaaatccaagcctggaccaacagaagcattccttgaaggtggtttctgtactttgggtggctggtgtggtggtatatatcccagtttaaattcgtaccagaaaaccagaattctcgaatgcaggaaatgatacagatcccttgtctactaacaggatgtacatggattgcccagttgtctttggaaacaagcaggtagagtttttctatgggaaaatttttttcgttctgattgatattctttctttagctattttagtctttgtctgtttctggatgtctttcctcctttcagagagaaagaagatgacatatggtgacatctggattggagatgatgattcagaaattgaaatccttagaggggccaagttcagtattttattaatgttgctgatcactccactttggatttctcactttatcttagtctgtttcttgaaagacttggcagcatgcagctttattccagctgttcttacagccatctcttcaagcttctctgctctcagtcctttcttgcttatgttggttaattacaaaatgaagttggtgaccttctgtggtgccaaagaggaaaaacccacaccacagcctacaaatgttattctttctccatatgcttaatggcaaagaattcaagtttaattattggaaaacagaccctgtcattggagagtatagctagagttttcatagcgctcatcaacagtttccaaaagggtctctagaaaactgactcctcttcaaaaatagacttcagaggaaactgtgcgagaaactatatgaacattaagctattatatgttaaaaaattgtcatcacaacatttgttatttaagacaatactgagagttctaatgtaaaaattataaagcaactcaacagttttcagtctggaaatgaactcaaataatatattatttactcgtgcaagatattgtgtttaaaaaacaacatattgatgaaactgaagataatacttcctagctgaattttaaaggtacacataaataatcttatgttgtttttgaaatgcttccccacatattagaagtatattaggtaggtgtgcagtgttcagtttttgcacttttaataatagtacctcatctatggtggaagcagattttgttcatcatctctaccctaagtgtctttagtaaattagggccaaatgaaagcattggattaaagaattagtacttgctaagtcatactctgtgtatgtacagatgtgcaaatatttggttgttcagacatttaactcactatccttgcttaatcatctaaatatatattaaactatactcttttcttcagaaaaaaggatattattttatagggaatttatctcctttcagttatcaaattggtacatttacaaattggaagaatttataaaaccttcataataatttgatctctggatttggattcaataaaaataagcacattataattctaattaaaaatatatggctgggtttttctttttctcagttagctgggttagctctttggactgcttccgatacagtgagaaattgttttcagtgtcttcacatacatttatgtaagcattgatttttaagcaaattcttagtagatttttgctttttttttttttttcatttttcttctgtgttaatagacctgggatttattatactgtcattctagtgaatagatatccccaaactgagacctggttctaaaaaggctgcattgaaaattataaaactggacctcattaacagaagacactaagaacatctttgtagccatgaagtgctatagagaaaggaaattttaaagtagccaaggcccaaattgtgtaaagttgtgtgtgccaatgtctatctcttgtatagcacaacaaattgaaaaaaaataataaaaataaaaagacctaagaccctctgagattgctgggtggtcttcatgggaaatgcttagttgagtccactgaggcagcttaatcaaaagggcactaggcatgaatcctgtataatgaagttaacatctggatagatgtggcatgtggggaagaggtcaccatcttttaattaagtgcagatgtagccaaagctgaggatagccattagcttagcttaggtagtggttctaaaatgtgattctgagaccagcagcatcagcatcacgtgggaacttatgacaaatgcaaattattgggcaccaccttgacctattgaatcagcaagtctgggatttggacccagcagtctgttttaataagccatctgagtgactctcgtgcactctaaagtttgagaataactcatctaggattgctccaaagtttaatcctcataaacaatcagaatgaagccaagataactgactgaagatgtagtcttcagtgatcccatgcatgctgctgttgtgtctgcttctctctaaaatggcaatcagggttgtgatgtgttccaaacacatccactgtagaaattgagtaatttttgcaaaatcaaaataaagcataaccatttcaggtgtgccaaaatttggaagttagatttggatagtttcttgtacataactgagtaagggctccagttcccagattattccatagttcccttccagaagccagtgcaagacatgattggttggcttaagcccatgctcaacttcccagtgcttgaaatgttttctttttctttccagatattttcttcttctttggacctcattaggtcatagttttgtccttgtggaattgataagttttcatttacaacagggaacaaatcatatgttcactgaatgaacaatattccagttctctttaaaaattagtttgattttaactctcttgctccctcctttctctcccttaacctccaatttcactcaagttcctggtgggattatgatgacagatgaaagagaatagggaaattcaacagagatggtcatggcagcactctgaaaaggtgtaaaattggtcaggactgtcctgaggacctggtttagtttcatgggtgtttgtcaatgccatctcagactacgcaaaatcttttcagctgggaggccgtctattcctccttcacaatgcaggattctgatcttcttctctcagaggacttctatttgaacaatttcttgctgaggtgggtgtgatttcacaaagcagcccattccattaaagcccatttgaaataccatacttacaaagtctttactgagactgacatccctgatatgtcctccaagatttacccttgaagttaaatcctccttttacttgcgagatctttagattcttagagaggaaagcttttttctcttcaccaagttagaaatttccttagctgtattgcataagacagtttctcaaccactggttttcttggcttcctttctctgtcttggtgtattccagataacctgtggctttttaaagaagtgacactcagaactgaatacaatatgttttttctttgtgtatgtgtatacatttgtgtttgcatgtatttttttctattatacattcttttatcttctcctgcacagctcctgtgagcatgaattctttctttcttccaaaaagaattttaaatgttcaactcattttaaatcacacacacaagaaaggggtgagagggagacagacagagagagagagagagagagagagagaaagaaagaaagagagatcagatattttttttatatactttaagttttagggtacatgtgcacattgtgcaggttagttacatatgtatacatgtgccatgctggtgcgctgcacctactaactcgtcatctagcattatgtatatctcccaatgctatccctcccccctccccccaccccacaacagtccccagagtgtgatattccccttcctgtgcccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcgcaatccagtctgtcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatagccacactgacttccacaatggttgaactagtttacagtcccaccaacagtgtaaaagtgttcctatttctccacatcctctccagcacctgtcgtttcctgacaatttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctctcattttgtaggttgcctgttcactctgatggtagtttcttttgctgtgcagaagctctttagtttaattagatcccatttgtcaattttgtcttttgttgccattgcttttggtgttctggacatgaactccttgcccatgcctatgtcctgaatggtaatgcctaggttttcttctagggtttttttggttttaggtctaacgtttaagtctttaatccatcttgaattgatttttgtataaggtgtaaggaagggatccagtttcagctttctacatatggctagccagttttcccagcaccatttattaaatagggaatccttccccattgcttgtttttctcaggtttgtcaaagatcagatagttgtagataagtggcgttatttctgagggctctgttctgttccattcatctatatctctgttttggtaccagtaccatgctgttttggtactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactacgttgaataggagtggtgagagagggcatccctgtcttgtgccagttttcaaagggaatgcttccagtttttgcccattcagtatgatattggctgtgagtttgtcatagatagctctcattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatcgtggataagctttttgatgtgttgctggattcggtttgccagtattttattgaggatttttgcatcaatgttcatcaagggtattggtctaaaattctcttttttggttgtgtctctgcccggctttggtatcagaatgatgctggcctcataaaatgagttagggaggattccctctttttctattgattggaatagtttcagaaggaatggtaccagcgcctccttgtacctctggtagaattcggctgtgaatccatctggtcctgtactctttttggttggtaaactattgattattgccacaatttcagctcctgttattggtctattcagagattcaacttcttcctggtttattcttgggagagtgtatgtgtcgaggaatttatccatttcttctagattttctagtttatttgcatagacgtgtttgtagtattctctgatggtagtttggatttctgtgggatcagtggtgatatcccctttatcattttttattgtgtctatttgattcttctctctttttttcttcattagtcttgctagtggtctatcaattttgttgatcctttcaaaaaaccagctcctgaattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcgttggtttcaaagaacatctttatttctgccttcatttcgttatgtatccagtagtcatttaggagcaggttgttcagtttccatgtagttgagcagttttaagtgagattcttaatcctgagttctagtttgattgcactgtggtctgagagatagtttgttataatctctgttcttttacatttgctgaggagagctttacttccaagtatgtggtcaattttggaataggtgtgttgtggtgctgaaaaaaatgtatattctgttgatttggggtggagagttctgtagatgtctattaggtccgcttggtgcagagctgagttgaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacaacacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcggttccttcaggagctcttttagggcaggcctggtggtgacaaaatctctcagcatttgcttgtctgtaaagtattttatttctccttcacttatgaagcttagtttgtctggatatgaaattctgggttgaaaattcttgtctttaagaatgttgaatattggcccccactctcttctggcttgtagggtttctgcagaaagatctgctgttagtctgatgggtttccctttgtaggtaaactgacctttctccctagctgcccttaacattttttccttcatttcaaccttggtgaatctgacaattatgtgtcttggggttgctcttctcgaggattatctttgtggttttctctgtatttccttaatttgaatgttggcctttcttgctaggttggggaagttctcctggataatatcctgaagagtgttttccaacttgtttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcattggctcctgagacttctgcattcttcacgtaattctcgagccttggtttttcagctccatcagctcctttaagcacttctctgtattggttattctagttatacattcttctaaattgttttcaaagttttcaacttctttgcctttggtttgaatgtcctcccgtagctcagagtaatttgatcgtctgaagccttcttctctcacctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgttcgttagttttccttctaacagacaggaccctcagctgcaggtctgttggaataccctgccgtgtgaggtgtcagtgtgcccctgctggggttgcctcccagttagcctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtctgtctgtgccctgcccccagaggtggagtctacagaggcaggcaggcctccttgagctgtggtgggctccacccagttggagcttcccggctgctttgtttacctagcaagcctgggcaatggcaggcgcccctcccccagcctcgctgcagccttgcagtttgatctcagactgctgtgctagcaatcagcgagactccgtgggcgtaggaccctccgagccaggtgcgggatataatctcgtgatgcgccgttttttaagctggtccaaaaagctcaatattcgggtgggagtgacccgattttccaggtgcgtccgtcacccctttctttgactcggaaagggaactccctgaccccttgcgcttcccaagtgaggcaatgcctcaccctgcttcggcttgcgcacggtgcgcgcacccactgacctgcgcccactgtctggcactccctagtgagatgaacccggtacctcagatggaaatgcagaaatcacccgtcttctgtgtcgctcacgctgggagctgtagaccggagctgttcctattcggccatcttggctcctcgagagatcagatttaaaggtacataaaatatgtatatctgccctagacttaaaaactagtctctccaagctctcaagttcaggtatatgttagtttgttctcaatatttgggtttcagataccatgaaatgacctccaaatcacttgcaagaattttaatgtataaattaaagggcaaaactacaaaaagaccaatccttacaggaatttttcagagaaatcctgatctccagaatcaagttttctaaaacagtgccatcttccttgcctttttaataagacattaaaaggatggtcataatccaattttctttaaaggtgaagttgaagacttaaaccaactggctatggaatatgttgtcttatagactagttcagggatacctgtgggtaaggtgtgttagagacacaaagtctatacacgttttgttaatgatgatgatggtgatgatgtctaccatttctgtttaatctctccaggaaagaagggtaattcatttggagttaggttcatgaacatccaaacaatacaattcagggctagggatgtctggaattctgacctagatggttcaaagacacacccatgattcagagcagtccagggcaagtcagaagagcactagactggttagcaggaaatgatttgtgttagctggctttgcccctacttagtagtgcataaccttggatggaatattcctgaggtttgccatctgtaaaatatgaaagatatgattgcaaattacaaattatggtgcataccttctgcctccatcacaggttgcagtaaataatttgagctaaaaaatgtgaagatgattcttaaaaaaaaaatgacacagaggcagtgttgctttaccttgtcattttggcaagttgaagtaggagagaaaaatactagacttaaaatcagaagccctggttgcgtgaatttgaggcaattacagaacctctctgagccttggtttccttatctccacaaaagaaattataatgacatttgtctcccagcatctgtgtgagactaagtgagcaagtatatgtaatagcacccagtcctaaatcttgatacaaagttttcttcacaaatttttctgtgggtgtttccttcaggacagcaaggaagaaatgcaggctctcctctaggagctggagcaggctcaatatattacactgaagtcccttgtttgatatcaaacattcacttgtattcttacaaacatgccagaaatttgatattccaagatgtgctctgtgttcactctggctttgaaaatactcccctgacaatccctgtttatcaccccaccctcaccatcacgcttcaagaccgctttgtagaagcaaaaatacagcaatcaatgctaaatcaatgttatgcgtctttctggacattctgttccagaattctcacttccaggcctgttcccatactgaaagcacagacaactggaacacttcctcctgtcccaaccactcccttcccattcacacctccatccttcggctttcagctttgccaggctgacttctgttatctccaaggtctagattgggtgcctcagcctgctgtgtatttatttgtcctggcgagcatcacatgatattgtaatagcatgccttcttgtttgtctcccctggtaccatatactccatcttggtgtggaaactagtgtaggtcttatccaccacatgcatccagaatattccataaatgaagaagtggataaagtccacagggcttgtgctttttctttgttcatgtgtacttcttggctctccttcagttgcctctttctagtaaaaatttcttgcctctatcatttttctgcttcaagatgaggcatttactgactgccatgcttctggccactgttgaatcaaagagtgaaagaaaccaaatccaacatttggaatgagttgcttccttgccagccaagctactgagccaactggggacaacatttctacccagaccttccagtacttattttgtgatcattttaagtttttatattgaagaaagtaagcccaatatcgatgttcaggctttcaaattgaaaatttttcccagtacaaatttggcaggcatgcgtgtgcgcacgtatgtgtgtgtgtgtgtgtgtgtgtgtgtgtgtgtgtgtgtaggggtgcagggagcggctgtgtttttctaagagctggtatattaaaaggtaaagaaataagttgtaatgcaaatcctttgaagttacctcatcaccgaatgtactctgctcatttattttgacaaatccaacttacttttaattaccaggcctcatagtatactggtaaatggagcaatagcgactttggcagaaaaggagaaatctgtgtaacatgagccttcagaatgagtccaagctgactccttgtaaaatagagtgaggcaatacatttttaaaaatttttcagtagagcaatttatgtgatatgtgactgtagtcacaaatcaatgtgccttttatgagccaagcacaccagaatgcatacactaaaatgagtgtagtttctcaaggaaattttgttggccactataagctttttccagtgatgctgccattatgcaacagatttttggaagtcttcgtttggaattattttcaaagtcagttttccagtcacaacaaaaaaattaaaaatatcacctgaatatcataatacgggggtggcaaggaggctatttttttaattgcttgtctatttttttattatgcaatgtggttctcagttattttgagctctctcccaaaaggaaacttctatggaaggtagcagttgggccatcactgaggtcactcttgagaaggtgacatggtgttgatagacccattaggggcataagcccctcacacacactttaataggcactggagggacttctgctcttggcagtttatcaaaactctgtgagagtaggaagagtcctacaaacattgagtgtagttgatgctgtttgttttgttctgaaagccgggcatcagtttggagtttgagtaaggtttctcccagtgctgtgggcacatccaaagaagggagccaagctgtcattagcagtttctgcacagcatatagttctcagcagccgagccctgtgtccccacattctaatctgtttcttctttccctctctatcagttttcctacccaaattgggagagctgaaccattgaaaaatgtttcctttacctttctcaactcaccctccctggcatctcatctctccccacttcaaaaaaaaaaaaaattaaaacacataacatacctgcctaaataaataacaaatcaagaattgccaatgccagtaaaaagaaatgggatgatttcaatccgtggacaatactcatggtggacaaatcttgaaaaaggtgtgctgtggggagaggggcttacatgcaaaagaaagccctcggaaggccttagaaaacctgggaacaagtgattgtagcttgtagggtcagggctgatggcatgggggagaaattcagattcacaaatgactaggtcctgagatccaaaaggggcctatgatgcatagcaataaaaatcctatataaaggatttttgtttgtttgtttgtttgttttttgcgacggagtctcgttctgtcacccagactggagtgcagtggtgtgatctcggctcactgcaacctccacctcccgggttcaagtgattctcctgcctcagcctcccgaatagctgggactacaggcgcccaccaccacgcccggctaatgttttgcatttttagtagagatggggtttcattgtgttagccaggatggtctcctgacctcgtgatccgtccaccttggcctcccaaagtgctgggattacaggtgtgagtcaccatgcccgaccctacataaaggattttaagctggcctgccctttctggaaagcgtaaaaaatgtattttgcttaggtataaacccactcttgttggcctcagtaggttggctctcttgcctcccagctgctggtttgggccagacagaggatggcttcaggactttttctgggtttgcacttggcacggcttcctcccttcccctggagtcacagcagtgaagtgtcaccatgtaaatccacaccaatcacacaaagcaagaagaacccttccttcccccagttgtaaagtgaaggaaacataatccccacttcgtaacattttattaagtttgcaaaggttttcttttcctagtactaagagataaagtggacattctgtgaaagcacaaattgtgatgtgccaatagtttatttgtaggaaattgtattttgttgctgttgtggtatgataatttaaaatgatcttagaatacaaattaaatcttagaatacaaatgaagtcaacatttttggcaggaggcaccaatacaaaattgggggtaatggttgtacttatgtttaatactgaattcctttgaagggtcgaacactcaaatgtccccaaggcatgttggtgagtagagcagccttggagaggctctgggaaaatggggagcacaggccccatggacaggtaggagcagctgcggcttagctccagctagttgttgccatggggactgcagacccctgttgccagagcttcaggtatttaaaacaaagccagaaatccagaattttatgtgaaatcacccaaggtctgcaagttggcaactgattcaattttttttttttctttaacactgttggggtcaaacaaatcacatctgtgggccagattcagctcacaggcctccaatgcatgccctctgtagctgtgctttctgttacagcatgtttgccatgggtctgaaagaaggcttattggtttccatagtggattggtgtgcagagtgggaggtgtcagaagagcaggatgagaaaagcaaccacagttcacctcattgtccttatcatgtttgatcatttgcagcagctactctaacctgaccttattgcttcctatcttgtcactgattccttagaaaagagtgcctgagagtgccagaggcttggtggaagggcagacgagagaagaggaggcattgtattggccactgggacaactgcagactcactcttacctgtaaagaagcagttaatgttggggaatgtagtcaggattggaaaaccacggggatttctgcacattataattgagaatgtaaatattcttaaagtggcaccctgaaagagacaagcattgaaaccagacaaaataaattggatcatgaacagaatgagacatcttaaaggagatagcatgtggaggcctgctgggaagtagaggcaaattccagatgcctaggagccttagtctaaggtggggccatccaacccacagaaataaatatgggcagtggcccaagacttcctataatgagctgcacctgttgtaagtcttgtgttcttgcctatagaataaagaacctcactaccatcctgcaagtgcaaattgaaagattcctgttgtgatgccatgagttattatccgctggttatattctattggaatggctacactcaactggatattgctgtctatattgttggagcacctcaaacaggggtgcaatggttatttgttaatttacttaattaagacatgttcatccacattttatagtttcatttatttaaagatccatttggtccccagcttcgatgcatgtttctctgcttcatctccccatatttccatgttcctgctgatgtttataccatatcctggcacccagcatcatctgtgtgttgttcaccaaggccgtgggaacagagtctgtaaatcaatagttcatcacggagtacagatttcatgaaaagaaattggattggaagaaagtctcctagtgaacacgctagtatccaaagagtctggattgtatcagaatccatcacagtaggagagaatgttgttttgagtaatttccaagcagagtacatatattttcctctgaaaatctttgtaaattgaagaaaagtgacatttttataccaagcaatttgtttgataacctattttcagatttctacaaataataaaatttctgattttaaatattttttacaaatacaagttggttttcttttcattgtaagccttactgtgatttcagaagaatttttaacatttgctaaatggataatctcatttaaacatggaagtaacatcctaatcctttcttggatggactctgtatctattgtaattaagactttaaaaatggtatatacatatgggaaaaaaaggagaggaaacaggaaaattaaatcaagtgatgggtttgaggtaaggaatggcaagttttttttttctgtttatcataattataccatttgcagagcttaaaaaagaaagaatggctcaacatgagggaaaacaaatgccttcagaacaaatttgcttttaaaaagtaggtctttttacactttcagtcttttatcgggaggcccattttcatcaggctagatgtattttcactttccagtaatgcactccttattgttcagcaaggtacatcttgattagacaatcaaagagggcaaaatgaattatttcagatactcaaatctgggtacttaagataatttttacaataagaaagacaagttgcaggaagcagaggctgattttgctatctgagagttggcgctgcagaagataactgcacaccaaggcgctgtcaggagatctatatttctgctcttgacatctgtaggtgcctctgccgccgctgatggggatgatgataagtgatgggaaaatgaagtgggaggtgatgtatcctactgtgatagatttaaagggttgccccaggcggccctgaggcaagagctgactgaagacgttccggggcctgcatcaggtcactatggcacagtcaggcaaagctgtttgaggcagagggcagtgcaataactctgaggtttaaatctgcacttagatcctctttctttcttcctttttgaggggtgaactggaggttgtgctacaaattctaaaatatccattactcttggttagtggtatctgtcttgtgttattcctgtggagatgcagtattcattgctccatgtacaacacccaaggatatgcccacaggaaacatttgaaaatggctttcctaagatttccaggctggctccccatttcccaaagccctgccttttaccctggctgtggtaagagttggtgtgaattctaatattgattctagggggagattctgacccaagttactgctctggcaaagacaaacaggcacatatcaaataaagcaaaggactttgagtgcccactggggagccacactggggaccatggagacgctgtgtttgctgcttctggaaagccaggctgtggacagttgaaggaaggaaatgtgctccaaggcaacactagcacccaataacccttctcatcttatttgtttaaatgtagacattatttttggttgtaaaacggctaaatttttttgcctttcttttctgcttctgtctcgttcaggaatttataagtatttgaccgtactcaaaatgtgcaaggaagaataatggaagcccctgaataccttgatttggatgaaattgactttagtgatgacatatctgtaagtaccactgtatacaagaaatgctttcaagataatctgccttcaacttcatagcctactttctccattatagtctatatatcctcaacttttctgactacatttagaaattcacagcagaaatcctgtgtggcagactcggtgtggtttggggggatctcttagaccaagaagtgaatcttccctaagtgtgtgttttggaagatgagtcatttaacttcaatgaggctttcattcctaatgtgttccaatgttgtcaaaactattgattgagtatacttacaaaatgcagccactttcatagagttaattccaaattctcttatgtggctggctattccacagccagcattttctagagttcacagggacactgactaaagaatagccaagttggaatttattaattgatgaacaataaaaagaatctttccaatcactgtagatatcaaagcacagattgtaagcttgttgggaatattaaggaaaattcgtgcagtgataaggactggactagctgacttttgaggtcctgcttaatcctgtaatgctgtgggctgatgagtctcttaattcccataacagccacaaacttcctgctgcttaaatcaggactgcttggaatggattgtctacatgcatcttgctttgagctgcttgtgccttatccgggaccacataatcaattctgctacgctagcaaacatgttggcctggagtgccccagcaaaactggctaactctcagagtatgtgatgagaaggttgctgtttctgagctagacatacaacttttctttccaggaccctcaagttcacaacttctaaccttatcttccatggatctctcagggcctggagctatgggtcaccactcaaagtcactgctttaaaattgtctcaaaatgatgaacttactttatcatgcttctggcagttgtttattcatctactttactccttaccttgaagtaaaatatgcatactgtacacaataattggattactgggatgagtttgataaatcacctattttatacaaacttggatgagtcttttttttttgtaccagagaaatgtgaattcaacatttgcctatttcagcttccagacaatttttattagtcctcattaaaaccaatgtggagtgagcttcttccttcccatgatatatttttgtctacgtgtctgtctgtctgtctgccactctctctctctctctctctttctgtttctctttctctctctaagtcactatgcttgacttggaagcattcaaagcaaggttcttttatgatcactcccctcacagccattgtgggaaaaagcaaggaatgtgaatggtagcatgggtgtatgtaggtaggatggaaggtgttgtagaaagggaaactgtgttatgattgggagttaggtggtagctctccgaactttgataatgatgttgtgttttaaaagcaaaggctttgaaagcagccagcctgggttcctaccttgttctgactcttactggctgaatagcacattaacttcacctttctgagatacactttaggttgttgtgacgattgagtaaaataataatatatgtgaaacacttagcttggcacacagtaagttgctcttaaaaatggtagcttttgttattatttcactgaattatacaataatatttatatgaccaatggtgaagaaagaactcaagggaaaacactaggcataaagtcaagatttttttttaatacaacagagcagttgtatttacagaagaatcatctggcagcagcccataattttgatgaattgggaatctccacttgaaagataataaaatacattaagcaataactaaaaccgtttagcaaactaggctacaggattatgcaatagttgagtgtctataacttgaccactctaaaacataaacaaagatatccatctgtaattgtgtaactgcacccaaaatttccctcttaaacatgtttcgattgtttggtcctttaacctgcatttaaacttatatcagattttgaaattgcatagatttgaaattctatgaaatttcatagtaattgatgaaataataataatagctaacgtttattgaacatttaccatgggacaggcattatcttggttaatcctcacagcaatcttctaaagttactgtttttatcttcattttacagatgaggaaactgcagcatgaagattttatgtaatttgtccagggtcacccagctggttaggtgtattctgtctccagagtatttacttttagccacaacactttactgcttctccgggatgaatatagtttattgcagtggttcacatcaggggcaattttacctgccccacccctaccccagaaacatttaacaataccaggagacatattttgttgtcataccggggagttgctactagcatctagtgggtagagaccagagaggcttctaaacatcctgcaatgcacagcacaatcccctacaacaagaattgtctagcccaaaatgtcagtagtactgaggataagaaatcctagtctatttaaatccacttgcaactgaagacgctctactttggcaacctctacaacatagattatttaatcataatttagtgtgatccagacttcataccttagcgaagccagaatcatattgttctaacttaatgattacatggaaaaagaactggagacaacctcttaaatactggaatgattgttctcaggctgtttaggtaaactaggagcaatgaatattacaacttctttaagggctaagtggagattattcaaatgctaaaaatgaaaaaatgaagatgtgttcaacgtgctaattcactggcataaaaagaaatgtagtttcccatgaacatgcaattttcttttttttttttgataccagaaacctccatctctgacagcccctaagcctctttcctggttaagtggcaggagggggaggaaactgcacattacacctgaaaaatatgtttatgaaaaagatgcccagtttcaaactcttctccttactctctagctatagccctattacatagtctaggctttctattccatggtatttccctctggtcatgagcctggttcttgttttaattaaaacgtaagctgtatattggtagaaaaaacaactagaacttattttgcctttacttaatgagagaaaacacagcagctaatttattttgaagtttcccagactagaaaataacgcacatcctttgcaaaacacaaagtttaaactatacattcttgtaatcctgccatctaaaagggcagaacattctccaatagctgcaggtctgcaagggagagatgacgacacataagcacaaaggtttaaagcagggtttttctgtcactgtgaatgggttcacagatttctctcttcctatggaagccagatccctatgtcttaaaaacaaaaaccctctggaattctttggagctatggtgtatttattttattaagagaggccagtgtggtgctcttaaaaatagtttcacacacaggactaaagaaagcagaggctgaactctggatctcctgaggagctcactcacagccaccatccaccaatgttggccgtgccgcacactgagataaactctttaactaagttatcttgttcaagcctcatacatcagctttgcgaggcaaactctgtttttattccttttggcagatgagaaaattgaggcttagagagcttgtctgacattcacaaggttacagggccaggacctaaatgcagaactatttggccaccttactcctccccatctatgcaacttagctgagtagtagtttctctagaccagtcacctcactcatcactatccctgattggcactgtagtgattacaaattgttttttggaagtaaagggattgatagacattataaataagtaaaatgaaaccagctaatgagaacttaagcaaatcttttaattttactgtacctcaacattcccatccgttaaatggtaacacctcaacctattaccctaaatttatacacatacactcacacatgcacacagccacatatatacacatatatacatgtaagtatttacacatacagacatatacacacacatacaaatagaagtgagagaaatattctgttgcctttctgtataactctgactgcaaccttgatgaaagttgacttttttggcaattgcataaactattttttgtacaggtcaaatgagatcaagataataagtatccttccacttttcaatcctctttggtcaaagcctttgcaacctagagtaatggcaaaaaattatgtgggttcattttcctaaggtgcttgaaccactgtctgatagaaaaattaattcttatggtaaaataatctcactttcagtgagttttcatgtctttctatcacacagactgtgcagcatttttactaaaaatgcctgcccccttctgttttgtgtgcatcaccttttcctccattcaatcccctgatgcttccccagattttgttacattttgagaaagactcatttcaagtagactcaggcaatgagctggcatgggcaaagaatacagcttagatgtgaaaaagagtataaaggtattcaaggtacaaagaacctagcctccccttctctctagcaatgaatatattgaataagatggaccctattgtactttcttctgtaccttctagaaggtgaccaacactttcatgtggcctctgagtggttcaatccctttttcactgtctctgtctgtaagccctgcccttcctagcagtcgccctgttcttatctatatggaaactttgtttagtgcttctccgtgtgatctagttccagcaactgtccagaatacctcagctttatgcagtgtttttttgtaatatcctgcattcaaggctaaattgcctctcattcttcccttctccagctcagcatcatcagaaacctcacaccttgttctaacatcatatgccatatgtgttatcttgtttttcttaatacctgccaggaaatgaattaggaatcatctaatccagaaaagatgagttacattttgatattctattgttagtgttagaccccaggactagaatctaggttcccaaactccaaatcttggactggagacctctgccagagaaggtagagaataactctacaaatagagtggtttctaagaagaatgagcaaccgctggatttttttaaattttcccttttactctgcagatagtcctggaagttcttatcttgcctgatagtcaatagaaattattagattgactatgcagattattgacaaaaactgttcaccttttcatcacaattagtttttatgccaatctagtcaacaagcatttactaaacattaacagagtatcagacttggttctaagcttggggtgaatgacacagacttgctatgctctcaaagtgtgtatagtatgctatattaataactaagcacattatgaagtcaggttaacttcatggtaggtcacatttgattatagtactaaactccattcttggcagtgagtccttgtattttgacagtgattgattattggctcacaattaaaaatagactatcattgaagttgaacaaggtttatgactggccatctgccctactataacatacttttttcttgtaattcttttgtcatttgtaatttttgcttgtataattatgattactttggcttcattttaaaatgctggttttggtacttttaaatataaataataatatgattgctaacatttattgaacacttaactgtgcatcagacactcttcccaggttttatattactagttcataatcttcccggacacaccttaatgaaggtacagtcagaaccttgttttttaccagtgaagagactgatatacaaaggttaactaagattaattagctagaaaatggtgaagtcaggatataatgcaggtagtctgactctagaatccatatttgtaaccactgcgttgaaaattacatctgctgggccccatggtcacctctggttttcccagttcaggtaggtctcttctccatccatgtccacttcttattatacaatataaggagatcattcaatactgtgatcttaccacatttactaagtggatcttcatctcttgcctgactacacattatattaattaaattaacattgcaatagagtagttcctgatgcactcttaaaatgatcaaaagagttactgagttttctcaaataccaaccacaaacaatgtcttagcataaaagaatttaaaaaaaacttcttagaatgaagatatgataaaaataaggtaccagagcaaaattcaaatttatttgaaaataggattagttataataattttcattaatggagcccaaatggtgggaagaaatgtatttaaagcagagtctaatagaggtatgaaagtgtggatcaccagtatctgtactatgtagaggtggtggttgaaattgggggtatagttaaggtcatctgtgaaaacatggaatgtggaaagagaagaatattcaaaagattgaactgtgcagaagtatattccatgtggtggggtctggacaaaggcatttctacaaaagaaactggaaagaagttttcaaagttaaataaaactaagggaactaaaaagacaaggggggtgaatttaaggaattttaaacaacagttgatggtggcaaataggtcattataaagacgagagttgaaaaatgccgtctggattttccagttaagacccccttggtggccctagtaagcacagtatctattgagtggtgggcagaatcctattgtgagggctggaggagtaaatgcagagatgaggaaatagaaacacagagacaattctttcaaaagagacggctgatgaatgcaagagcaggaaggcccatgctcagtcaaggaggcagtgtcttgaggtggtagtggtgcttgcttatctttataagaccagaggagaaagccaacgctgagagtgggctgaggataaggagagaggaaagaatggtggcaggcaagagtccttaggagatgagaaaagaggaaacctgagccccagcaaagggttagcagtggaggagcagactgttagtgccatgtcccaagggaagggacaatggaacacagtttataatggagggcatgaagtcttcctgaactggaagggcaggcctttagaggggaggctaaaattttagaaaaatattatgttctgaaaatttcatttcagctacatgtctctgctgtcactcccagctttgtttgtacacattattgccattgtttttattgtgtgcctgttgagatacctgcctgaattttggaaaactgtgcgagaaatcatgaatttcaccatggttgtttggatggctggcttaattgtttcttttggaaacttttatggggccttagtagtttgaaagtctctagcttgcaaaggtgcttgggatgttcgttctttcattttctgtggctcattaccatttgagtaatgtctgctcattcgcttagtcggctccagttttcaggaataaaagccaaagcttttcagcactgaacaatatctggggtggtcagagatccccgtagcccaacgtagaaatcacgcactgtcattatgaatctcatgcatgttccaactgttttgcatggcatggtgacaaaactgactggcgtaggctgggatgtatagaatcatcttgtgccatatcaactctgtgaagtttttgaagctgacttttcagtgtcatccctgggccacagactctcttcagtgaggaaagaacaaagaaaagccaaataatgtactgagataggctaagttatatttcctttcctttctattcccagctcgacccctctcttcccgcctcattagttctcatgtcttcatctgctgagcttaaagtcatggcggaaatgaagatgaggagggaagctctgagggcacacttagaaaacaggataaagagaagagacagacatttactagagctttacagtttgcaaaatgactgcatctatgttatctcatataattatctgtcttccacacataaggaaactgagccccagagatattaaatgaattatttgtccagaaccacagagttaataagtgccagaaccaggacttcaatccagatcttatggctccaaatccattgtcctttatacaaaagtttaagccatcagccattactcatgctattaatatattaagaatttttaaatataaaatgatttattgctagacttgtaattatgggtttttctaagattagtgctatgtaaatattaactactgacattattattattactgccaccaaaattatggactgagctatatccctgcctcattagttcttatgtctagaggaatttatttaatttggtttaataagtgcctagtatcttgggtaaataaaatattgtccacactttcaggaagcagagaaagcatttaggtaaatatatagatgaaccatcctatgatgagttctgtaatggacatatgcctaacatcaggaaataatataggacaatgattctacaacttcatcgtgcgttataatcacccatatggcttgtgaaaaaacagatcgctgggccccaccctcagagttcctgattcagtaggtctgggatgaagcccaagaatatgaatttctaacaaatcctaggttgtgttgataccactggtccagagaccacactttgaaagctggctttacttccttatggggcaggggtcagaaaagattttgtagaagtgatacccaggcaaagctggaagaattaaaaggagtttgcctagtgtaatgggcagaatggcatttcaggtagatggagtagcatatgtaaaggtatagacaggcaaaacaatgggtatggcaaccaccgagaatttgttattgccacaatcagaagagaagtagacaatgcgagatgaggctgagctcatggaaggcttcatgtgccatgctaaggcatatggtctttgtcctataggctgtgcagagtcttagtcaaatttttatttcagaaagctaattaattctagtgttagtataaaggcctggaggaaggtcccacttactacttaaacatgaaagagctcctttgaatgtctataatattatgcccagggattagtcaatatgtacacgtcttgttatttcagttaaacagttaatcagtccctgtgtgccatgcacatatacaagtcaaaaatatcattctttccctcaagtgcttatggaagccaacacctacagataagaaacaccacagcacatgacaatgcagaaacttaccaaggggagaaaagagaaaagtcagtaagggctaaagcaatcagccagggcttcatggagaagcagaacacagctggccttgccttgtgaaatggtggcatttgcctggctagaggagggcattgcatgaatgggggacccccaagtaaaggaacagaaagtaaacaaaattttggaagcacagggacggtgaagaagctgaggcagctggtcaacctttggcagagctcttcttcagacatggtagagaagtggaaaagaagtctggaaaacaaatttagatcaaaagtctatgttcactgggaataacctctggaagacttctagaaaaagaataaattatagagatagaaaatgtaatgcttcttcattaactgcaagccccctcttcactcttctcacccaaggacaataggagtcaagggaacaggctacaaaagcttggattggaggacacagacagggaagatgcaatgggctttggttcccatagggccaaactgacagtagttgctgccctgggagcttgccattgtcctgagaatgaggtatgttggcgaactgacagttacttataaaaggccatctgtcctgtgaactgggatgaaggcctgggaagccttccatttcagctcccagatggtagcacaatgcatacttgtaagggagacttcttggatcatttgctcattcccaaatttgcaaatatgaaaacatttttagatgttggttttgtgagttatgtgttccctgtgcatttcttcacatcacagcttaacaatcttcacaacactcccttaagccttttcttccatccaaggagcaatgtttatacttactgaaacagatccacaaattgattttatcttgtgtctttataaaaaatgatggacttgttcacaatgtagattagagtcattgctgaatttgatgttcatatacccttaaaattttccaaaactttaatttttctggataaactgtcatcttttttagattgctatactttttatttctattcccaggagtagcaaatgatattttcttcacagttattgttaccagagaatgaaaatatatgccttcaccaaagtgacttcctatgtgactctgggtagagaggcaaagtgccacaagtgatttaggttgaggcagtggcagtgactcacctaggctagtgtccgcctgtaactcagttcccacaccagccaggtgctgctcaaatgtaaacctcgtcaaattaaaacttactatacactatgggcctttgaggccaaataggaaaagttgaagctacagcgaatacatcagagattctgatatgtctgactttggggtgggagatggcagttaggaagcatgtgcctcgaaatacagatagcagctcacccattttaatcagatatatatcattaagcccagtgaacaaaccttagtgaatttttcattaactgtatttaaacacaattcatcttaaatttcctctttctaaactcttgccttggatgaaaagaaaaaaaaaaagagtgagactttgccaaagggtgtttcatgggacacatggcaaccaaaacaaaaggcccaattttaattgaattatagactgtgtaattatctaacttgtaccagctggtctcaagaagctaccagagtccttagagagcttgtacttggccagaaacataaggtaccttattagtaccaagaaaaatgccttgtgtacctgtgctaccccagacccccaaagaacataatgtgaaaggaaaaaaatacttacaggttaattttgggtttaagaggtagtcatccctccctctgagcatgtgggtgggtttgctaaagcacctgtagtctcagaggcatggccaatataaacaggatgttattgcatcagacaggtaagggtaatttccctaattagtcatttgagatttcacttttcacttggaaatactggaaatttaatttgtttgtgacatgcggttggcaaactgacaatatctacgttcccaccctatgtcttgctgtcctggtatcctggggaaagcacaaggaagtctcaatgcagacgctttgcttcatgtattgacgtcaagctaactaaagtaccttcttactgataaatgtgtcctaattacacattcttcacttgtaatgctagagtaatcctaatgagtttcctgtgatcatttttcttttagattaaatgctttttctcaatccccccaaattttgcaatggtgaagtaatttatgatacaagctcatttactttaagaacattgtccttagaggtaaaaagcaaaatagtttcagggagctgcattttatgaattaaagtatgaatgtgattgaagatagtccctgacttggcctttgattaaagaacaatttcattttatttattttattttaaaacaccctcctctaaagaaagactgattggcatcacatgttgtcctcataaatcatagctattgattttacatttgttttagctcttccaattgtatgcccccttgtatcataatttatcctgaaagccagcctctgagtcggtgctgaaactgagcctggagggtggtttctttccactcaaactaatctatatgtgaaagagatgagctttcaaacacagaaccacacccctcttgctttttatgacattaccctggtatttcccatggagataatggatgctacacagtaaaatctgtggcaagtggcaacattaggaacttttgcctagtccagtcagcatcggcacagacatgtctcctgactgccccggatgctgcaggaagccaggtgctcccgtacttggcttttcgtacacaagctcacccttaggattcagaatgcaattattaaggccatcttcttgaaactctcagggtcagacagttcttccatcttccacaagtggcagaagtgataagagggagagagtgtctgctggctacaccccacctttttttgttaaagaaggagtgcccagccctctttttaaactgcatgtggttagatgctgcaggtagatcttaggatgctgccaggtcaccacgcagcccatttagggtaaaatgagataaattttctgaatatacatgttgtgcccaagtatcacttattgtgttttgtttttctggccaatctgagtgaatgctcgcattttaaattattttatgccctctcttctctggcttcccgttcagtattcagtcacatcactcaagacgatcccagaactgtgccgaagatgtgatacgcaaaacgaagacagatcaggtaggttttgctcctcccctcttctccttatcctggctcagtgttaatggctcctggaaagctgtttttcctcacactggtcccccctgctttcagttttcttttctctttacggcttctccactcacaccaccccccacctcatgccctgccttcaacaaacagatgttaggtcatctgaaagaggatagcaggacagggaggccctaatgaggactcagctgtatacagataaataaatatgggagatcatctcggcatctccaaaccacaatatatgcagcaatttactgaaaacccgagaaaccattggtgacaaaacataatgatgcaggcgccaatgaaaaaatgttggatgcatttactacccatatggcaaggaccagcttggggaatggtgctttgccaaagtcggaaaccctatcagagatgcgacatgatagaatctgcaataaggcatactgtaacagttaagattaaagcaaaggctttggagtttaatagtgtaaactaaacagagaattatggcatatagatgaaaaccagctggtcgaccttttctctttacacccccaacccccaagaataaaaaagtacattctgagttgttttccctctgtaaatcaaattaagcttctcttcttttccttctatgatgggcaaaaatgaaaataaaaaaggatattgatgggagtgataccatggtattaaactatgaaatgatgtttattatttttccaagtaattactctatggcatcaccattaaccttcccaaagctggacctactctgatagtcactagaatcctgagaaccagataatcctcaaattatgtgtattgtgtttaaaaataaatagatgtgccttacctatacagctactagaattctaggcctttctaatggaaaggattttttacaaagctaatttacttttcctctggactgtttgttttcctttgacatttttcttaggagagacaggaaaaataattagtctttctaggtttgtttatcttggtgtttttttgtgtgtgtgagtgaaagtaatgcttcaatgtttgggtcagaaacatcacagaagatagttttcagttcaaataaaagcttttacttaccttcacttgttttttatttcaaaaacattcaagttcatataggatttaatagaggctcttggctataagtcttataaggatgtgtcttcttaaaaggcagtgcccatttcaaacttgaaccaatgactatgatcaatgacacaggtagctgactgcagtggagaggctgccaaggtcagagtcaccaggcctaggtttgagttagagttcaggcacttatcagctaaatgaccttgaatctgtgactagttatctacaaaatagagaagatacgtgtactaatgttgcccagctgtccttaggatcaaaattaggtgatgtatcaaaaggttactttgcagacacaagattttcttttttctttaattggatgtagggaataagagagaagaaaaaatagcaaatactttatcagggcttaatgtgctgggtactgttgtaagcactctacttacattaatcccattaatcctaaaatacttgtgagctaagtactattaggatatttatattatagatggggaaactgaggaacagagatgagaagttaaatatcttacccagagtcacacagcaattaagttacagagctgggattcaaaccccaggaagtctacttccagattctgttatattatcccttacatatactacccttccagatagtttgacttactggtaataatttacttttaagatattatccttttaaatctttacaagtcagcattttccctgattaagtttaaattattttttccgttaaatggtgactcttaccaagttaagtgaataaacagaaacttttagtttttcccagggctggtacattccattctctccaggtcttacaatttctagtcatctccacaataaatgatggtagacttttcttccgtggttgaggaggaggccagtttcaaacttagaagcttttgaactttactcacagcaaaggcgcagtgctcaaggtaatcagtaatcagacctgacaggaaatggattatgagggaaagactcaggactcttaatggaattgcatgtacatttccaatttgatggaccatttggaggctgggaaactgcattctgatagattgagagtgatcctagaaaaaggaacccacggaaaaatgtgtctgcccacagcatcactgtagaattatccatgggcccctctgaaagaaatctcaacgtgatgaagttttcggagctggtttcctaaagaattgaggcattctcaatcagttccataggcatccagatgtagaaataaccctcctccccctgtctttcttgtaaatcagccacatagaaggagtttgctccaggaaagctagcagatttctatcttttcaaacagacgcagcagaatgcactttggcttctgagaaaagtccacatcttctttgggatggggcactctcaggggaaacttcctcaaccgtctgtcacttacagtatacctgatatggtttggatctctgttcccatccaaacctcatgttgaatggtaaaccctaatgttggaggcggtgcctggtgggaggtgactggatcatgagggtggatttctcatgaatggtttagcgccatctccttggtaccatccttgtgatggtgagtgagttctcatgagatctggtttaaaagtttgtaatacctctcctactctgtctcttgcttctgcacccaccatgtgagatgcctcattccccctttgccgtctgccataattggaagcttcctgaggctgtcgcagaagcagaagccgctatgcttcctgtacagcctgcagaatcatgagccaattaaacctcctttctttataaattacccaatctcgggtatttctttatagcagtgcaagaatagactaatatgataccccacgagacaaagacatttctctttacctttctagaatagttacacacttgctattttgtataggttgtcaaatgttaacatctatccttgtacatattatatctttgaccagatgttctcatttactctcttatttatttattcaacaaatatgtgttgagtgtcctctggcccaggtactgaggacatggtaaagaacaagacagacaaggcctctgtgctcatgaagcttacattctactggcagtgacagccaaaaggcaagcaaacagataaacaaggtcaccacagatagagagaagaggcaacatgagagactgtggtaatttttaggagctggggagggagggaggtcttagggcatcagggaatattagaaggctccagccacgagaaaaccagcaaagagtgttgaaggcagaggaactagtaattgcaaagtgcctaagccaggaatgagcttagcaagtatgaggaagaaaaaaccagtgtagctgcagcatggtgatcagaatgaggagcagtaggagatgaaggcagagagatgatcagggtcagactccttggggagttcagattttatgcttagtgcagtgaagagcaatgccagcaggattccaatttttctaaaatcttatgacctggaaagaagcctcagcatgtagaatcataactctcactaagagaaaggactttcaaaatcatctagtctgcaagaaagagcaagtgagaaagtacaaataataaagcaaatgggtaaaatgctgacaactgatgaatgtggataaaaggtctacagctattttttgtactgttttcatttttgcaactattgtatacatttatttaaaagtgaaaaatataagagttacacacaaataaaaagttttctaaaaggcaaaaaagaaaaaaaatagtccaaagccaatcagatctttgaaggtaatcctccttatcccaaccacagggtcatgtagcctgtacttcatcaatttagcaacagggagagcacaatctcacaaggcagcacatccataaaggttaatgctttacctgaccaaagtcagtgttcgttgaatttccactcattgatcctggttcttcctttggaaccacagaaaaggacagtccctcctggccaagagtgccactaggtgtgtggagacagcagtcactcttgggcctgtcttctccagatgaacatttccttcctcagtgctgagtgtgtgctgctcattcttttcactctcctgtggatacagtacagttaccagcatccctcttaaagtggagtgcccagaaccaaaccagaggttcctccacatgtggtctgctcggaaacctgtcagccccacagaacagtcccctgggtttcccacatatcttttctgctttcccaagtagggccgtccattctgcctgcttcctgagtgtcctcagaggagctagagtgtaaaacaagccgtgtttgtggcccttggaagcccctctgtgagacacgcagcctagggctcacctcacttcatccctgcggctttagtggtgggctccaagaatggaaaatggcaatgttgtcagaggcctggaagtcatctccttgcaccttccactggctcaccaatgcccacaaatcctccttaggagtgccctttctttagctagaagctttgattcctattgaagtctatgttttcccctaacaggaataatattttaaactattctccatcaattacactgcagtaggactgtttcaaatttttgtgagaaaagtggtctagaaagaaaggaagtgcaagggaattggagatgccacaaggtgggaaggaagcaaaaaactaggagtgggaagcctgagaatgaactgcctgtgcatggagatgcacaggtgctattgaggtttctgagttgtttcataagccagcagtgtaccaggcattgtgccaggcctctgtaagcagcatatttatcctcaaaataattatcagagggagaagcattactgtgcctattttattgatgaggaaactgaggctcacagagggtaaataatgtgcacaaagttctagagctaacaagtggatgtgaaacttgctctacagtctccagaccccctgtgggtaagctgactcaattgaggaataatttattccagagaaccatgtgtagcaactagtttgggacaaggattagcagaaaggaagttatgtgtaaaaaaaaaaatgcacctaaaaaaggaagttatttgtggaacttttgcacgcattctctgcttaatatctactactcatgtgggaaaagaggacaccacaaggcagtgaatgttaattcttctctatggttttctccaaatgaggacaaaaaatacattatggtgacatatggtgttcaaatcaaaacatattcagtttcattgatttagagtttttaaaaattaattgggcattcaaatacacatttgtctcaattcatgctgctttaaatgtgattctttcaacatctgtatctgctaaactcattgtataattttcttatgaaagaaggcagataaatattaatactgcttcacatctgaaaatttagatgtgctggatttagaaagttcagttatgtaaaagtaataaatgaccctgtaatgtgtctgagaatggattctgaaaaaaattttatacctaaataatataaagtgttacttgtatgacaatgagtaaggaaacagtactttttaaacttggtgtctggcattaaagtcatgtaggttgtacatttaaaagcattgcaaattcgctatatttttgaaccctgtgcatgcaaattttgtgacaaaccctaaacctacaaagataaaatatgtgatgttctaagattaaagggatttaagccagcacctaaaataagttgacatgaaatttgtcctgtagatgctgttatgacatagttggtgatgctaaatatataaacctcctgttttcaatatttgttaaggtttaatgctaaaagcttgaaagtgaaggttggtatggcagtttgaattgaaaagcttgctgattaatccatttcacaggatgtaatgtaaactggactctaaagagcagggaaacacattttctaagatctcaatcaagaaaatgaacacttcaacctgatgcagcaagaaacctagcatttatgacaaagaaatgtttctttaactagagtaaaaatttacagataagacatctagatgagattgtttatcaaataaaacaattatttttattgtttaacaaaatataattataaaggtgatatgatccattatttttaaagaacttaaccttgccaccaaaacaaaattactgcacttcttttgagtattttttccccgaggcatatttgtacgtatggttgtaatcacaatatgaggacaatttttgctgctttttctgttgctccagaatgtgcatagctgtcattttggatggaccacagaacttacccatgaaagccgagctgccccctctgtggaaaaggagagatcatctctacctttaaccccttttaacttattaacacttcatttatgtttctgagaggaaagatgtaggtcaatgttcataaagatgggggcaggaggtgagagaaaagttaaaataaaattctggtggtattgaaaataataaaaggggctgggtatggtggatcacacctgtaatcccggcactttgggagaccgaggcaggtggatcatttgagttcagaagttcaagaccagcctggccaacatggtgaaaccctgtctccactaaaaacacaaaaattggctggtggtagtggcacacctctgtaatccccggtactcaggaggctgaggcaggaaaattgcttgagcctgggaggcggaagttgcggtaagccaagatcgtgccactgcactccagcctgggtgacagcgagattccgtctcaaaaaacaaacaaacaaaaaaagaaaataattaaaagggctgaaggtagcagagcttaaacacatcgcatctttgcccctttttctcttgactggaacatttctttgcttaaccataaatgttaagtggcacagcaaactgattttctacaaggttcacagcagtggaattaagaaaggaacaagacagtatttgagggaaagaaaacttacgggtaaaaactcacagtcttctctcctgtgttttggtttatttttactggactcaaagaaacatatcttccactccccaaactggtaagtaaagaaaccgcctgttggtagaaatgagttaaaggaaatctgcagtaaaaaaggatgaaaaatgggaagtccagagagggacatcctttaggcagggagggaaagaactgaaacatagggacaaggacaaatggatacacggccaagtccctttgactttgtctggctttgccgtgacttccttctcacaagtccccatcctgtcacaggaatagcagtttcccccatcccatcttcccatactttttaaaggcaaaagtatgagtgtgtgttgagggacatttctagtttaggagcttctgttatagcatctctgacagcaccccagttcttcctgaaagcatacccttttgcttttgtctctcaatattaaatgggctctatcttcccatttcagatcacccctttttatccacatatctcctttgctctgactcttccctcaaaaaaaaaagtcataaagtaaacacaagtaatagaaacaaaatcctagaatctcatagttgaagggtcctcttgcataagtcctgacccttctgtggcatttgcttttcaaatggcccttgcatctcaccgtatgatccaggactcaccccagcaccgtaagcgtcagcatcacccaggaggttgtgagaaatgcagactctcacaatcaaaatctgcgttttaacaagctcaatccccagggtattcgtttatgcacattcaagtttgagaagcactgacctgggccacctagataccagcccattgtttttagtgaggcacagtgatcttttcaaaaatgcaagtcttatcatgccactccctgctcaaaaccaggcaatggtttcccaggatggttctcaagatatgcagtgggaaactctctcatgtggccttcaaggccagagtgatcttctcttggaccagcaggcttcctcgcacgcctcctgcctgccagtcacgtcaaggagcctccttcagttcttcaaatgtgcagtgttccttcacatgggatattattccttttctccctccaccttcaagatcacctccttaggtgatcacctccatcttaaaaaacaaacaaaccacctctagaatctcccatcctgtttctctgctcctccttgccaaccctccatttagagccaagctgctttaaaaagtcatgggaaactccctcctctgtccccaacttcctatttaccttaaacatccctagtatgatttccatctctctagggaaggtcacggcttccatgctgtcaaatgcactgacactttgctattctcatctttcttgacctgtcagcattagttgagacaatagtcccctcctttctggaaacggtcacctctcttggctttgtgagaccacctctctcctcatttttctcctaacactctgacatcctcttagtcttcctttgcaactcctcctccttcccaatttgacctttcaatagtcaaatggaactaaatatttaataggaccctccctctgccctctcagcctctcagttggtctctcatacatgcttacagcttcaaacaccatctacatgctgctgtgaatccccgccatactccagcctcctatttaatggcccactcaatgtctacattagatgtctcatggaattctaaagagaaattcttgaattcccctgcctgacgtgttcctcctcagactctctcctcagtgaactgcactctgctgactgaaacatctcatcaggcgctgaagccagatttcttgctttccctgatgtcccacatcaattcatcaccaggtcttgagtctctgtgctcaaagtatttccccatgctataaactaaatgtttgcgtccctccagaatttgtgtgttgagacctaactctcaagatgatggtatttggaggtgggatctttggagaagtgattaggtcaagaggatggagccctcataaatggaattagtgtcttaccaaagcagctgctgagagctccctctccccttctgccatctgaagacaatacttctctgtaaaacccctcagaaataccctatttcagttaaaataaaaaacaaactctttgttatggccaataaaatccccaaatgggttggtccctgatgacatcccccagcttcaactttgcttgctttgactctgacccactctgatctagcaataacagctacagaacctgccagattctctctgctttagaaacttgcacatgtgcttccttctacctactcagatcttcataaaattatctttcctcttatattatctcccagtttctcacgtaattggcttcttctcatcctccagatcttagcttaaatgtcacctccttgatgaggttctcatctgttttctattccagtcctctccttatttcttcaaagcagtttacattaagtaattttttttatttacctgtgtacttgcatcattgtctgagcaggattatatctatttcattcactcctgcacccctagtgacatgtgcatagagacgttcaatatatatttgttgaatgaatgaactgtctaagagtaccatagcattctgccaattaccaattgctttaacactctgaccatgctttgtattcctgctttccttgctaagttaaaaaaaagaaaaaagaaaaaaaaaggatcaccacccttagccagttgaaggaattagcagctgtaagaacagattaccggtgataaaatgactaaatttaggctaatgctgctaaaaataaagaggaagaaaacccttccactcaactgtttttaagaaaggttgggggatttttttgtttgtttttttatagacaaggtctcactctttcgccgcagctgaagtgaattggtacaatcatagctcaccacagcctccaactcctggactcaagcagtcctcctgcttcagcttccctagtagatgaaactacaggagcaagccaccatgcctggctaattttttaattctttgtagagatgaggatctcagtgttactcaggctggtctcaaatttctggctttaggcagtcttcctgcctcaaccccccaaagcactgagatgacaggtctgagccagtgcgcccagccaagaaaagtcattaaaaattatttttccttttttttttttttgagacagtcttgctctgttgcccaggctggagtgcaatggcacaatctcagctcactgcaacctccatctcccaagttcaagcgattctcctgcctcagcctcctgagtagctgggattacaggcatgcaccaccatgcctggctaatttttgtatgtttaatagagatggggtttcaccatgttggccaggctggtcatgaactcctgacctcaagtgatccgcccaccttagcctccaaagtgctggaattactagcgtgagccaccttgcccagccataaattacttttctgactttgctcccacacagaaggttcctagtaaatggttaccaaaatttagacagacaacacagtgttggatttaggttagagtgaatccaaaatgagtacgaccactgatttctgggattccattgcatataggtgacccaaatagagaaaaatgtgaattatatctttagggaataatttaatttcaataaggcagtcctccagtgttacgggaagaaagttagagtcagagaaccttggtcctagttgagaagtcagcatgctatgtcattttccacattatacttaaaattctctgagttctcatttatttccaagtaagaatacataagaactgcctttccatcctccagagttgtggaaatctctaatgaaatcatacacttgccttgtactcagaaacataaaaagccttaacacaaatgtatcggcaattttaaagtattaagtggaggacattttaggaaaattccaaataagaaatattgctttgtggaattcttaaaataggtttaaatctttctttcactctttatagtatacttgtgaagtgtatggtgacctgcacctgaagacggaggtgcagcagctctgccattcattaatcccagggcgagccactttccgctgttcctcccactttgtatgccactgcacctgcctgttctctctctagtcttgtagctgagagttcaggccatggtaggagcctgcatgggcagacccacagacctgccaagagcaagagtaggctgcaggccagcactgggtcttccatttctcctccccttaaagtgtgtccttcttaaaataagaccagttttcacagactcaccactttgtttcttgtggaaaatagaatgcatttaagttttagcaacaataaaacaagaagggaacactcttataccctaaagacataccccattttctttgttgtcttggtgtctaaagctaattttctaatgtggacacatagtccatatttagaagtaaaatcagcaggcattttggaagttgtcagttggaaatggagagaagagggcagggatttttcagcctgtgctgtcagcctcctgttctctcttaccaaggagcagtaactcagagtcctttgtccttgacggtagatcagccctgtaaaacatcgccaccttcagttaaaatgtgtgcgtgctgcacggccagaagccatactgagcctgctcacagctctgccctgttccagagcatctcaaatggtgagcctttcactgtcccttgaaatgtatctctccctacatttcctcaagaaagggagggaaagaaggaaaggaaacctggtaaatggacctggaatgaacacaaaacttaatccactcccgaggttttgctagtgtcgaagtgaaggtcagcatactttatagatgacacaataatgcgaagaccacgtaactttctgcaccccaccaattgctgttctatggaaactgtacttttgaagcccaaaggtttaaagttgtcaaaatattgagtctgatttcgtgatggaatatgcctctttggtgaagtatcttttctatccagggtagtagggcttgagtatttcaatgagttgtcactaaaacaaagaaatgggtgcaaatagggtgcaaagttatgtgagcaggtcttgacaattctgggcagagctgggaataataaaacatgaatcggacacattcaacgacagctgcttgatatcagtagccacttaaagacagaaagtttagaacccaaatcaatgacgctttccccacagtgttttaatgccctaatgtggatagatcgttggctggcatttctataataaacaagccttctgtcctccttcctcagcctcacattacccttactagagggtctgtagcatcattgaaaaggatgagcaagcagccagaagggagcatcccagaaacactcattcctcacacacacttttgcttttcccaagacagtgccccatcacaattctccaaatccagagttgactcagccttaactttgatcaggtcatggtctcatctctcaggacagcacagaagagcacccagcaagtcgtcctcactcagactccatgccttcttcctactgtcagaacatgggataagccacctgtcatcatttcttacagagcctgaggtgtctgcagtaagtgggtgcagtacagacttcaccttacataggactaaccaaactcctgactctagcattaatactcccaatcattcataatgcccctccttttgctgtgaaaatggaaagaaatggaatgttggagaacttcaaaagtatgtccttgaaggcgcctaggtttccagtagctatggatgtgaggtatattgttgtgtacatttgaaggcaattatagctaaagctgaccccttttttcctcatggaaaataaaatccatttaacttttaatgaaaaacagtaggggaacactactttatcctaaatcataccgcttttctttctattcttgatgtctcaagctaattttctaatacggacacataactttctatttagaggtaaaataaataggcattttgggagccagcattgacgtttggtcctgaaaattgaatccactgttgcaacagcaaactgtccattatcttcctaagaaaatactaatttatcagtcttaggagccaaagagttgctctgtgtcagcaatcagcatagcctcataattataaatttgtgaggatctggtgaaagacatagatccagagaaattatagtgtttcatagtgagtcattcagaataaagagctctgttatttgtagacattccatacagtcatagaaatttaggggtggatcgggttttagcaatcttatagtctaacccgttcattttacagatgaggaaactgaggaatgttttgtaggaaatagatgaaagtgttttaatatgcagcacatcttgtctaaacattttcaagagcttactaacactatctttgaaagtatttggcacaattagtgtgcccgaaatgtggcaaggtgacttcattgtgtcagaattcatatttatttactatacttttcttctttggttttggcatcttccttccctccttcctccttcctccttccttccttccctcctttcttccttccattctgcctttctaccttcccccttcctccttccctccccacctccccttttattcattcatccattcattgaaagattaagtcattggtccccagtatcttcaaggcactctgctagacaaagggctggttataaacacaagttggttctcaggctatctttgcccttgaggggttctcaggagggaaggtgaaacaggtatatgagtgaagagttgtaacagaatttcaaaaatgcccaactctaggtatgtgcaggtattatcagggcactgggaagcaaggagcaattattccctaggagagtcacaggaactgcacaaaggaggtaacccctgagtgtaatcttgtgagatgagcctgagtctcaggcagagaagacagccaagagcattgtaggaaagtaagaataagcttaaatgcagggagagtatggtatatccagaaaggatgaatttagcagtggagctgcagggaaaaattagtgatttgggaatcatgagtgctgagatgataaggcaaattagaaaacaaatacaagagctgctacataccatgctaaagaatttagctgttatcctggaagccaaagtttcacaaacctagtaatttaagtatcatttccacaacatgtgttatatcccaagtctacctctgttatttttgctttacctgtattgcacctgtactatgtttatttaatatatttttctaaaacacctgactttcaaacatatttgtttttaaaggaaacttcatgtcactatggttgtaaatagaaagccatggtcacttgcaataaattcaagttcatcattaaaatgaatgtgataaattgaacataaaacattcctttcattatttgcttatgaacgtctctgagcctgaggcctgaggtctcatttttcgaatagggaattgtaagttttggaaaggagttaaattcattctagcaccaaaatgagtctccttatattaattagtaagaaaaaagagaatttgaaaggccaatagcattctcactctgtaaatcaggggtatttagcatggttcctgtgtgcctcttagatattgcagggatatgcacccacatatggggaaatattgtttagtacagggctacctgaaatatttgagtggattttgggtgacaaagtcagacttactgaagaaggttaactcaggactgaaaaaagagaccaggggaagccaggaaaaccttgcagagactgtgggagaggatgccagtgtggtccagccagtttagtgatgatgaagagggcccagatttcagagggattgaggataaggacacagcaggacttggtgcctgagcgatgaagggcaggggtcaaggaaggagaagggtcaaggaaagagaatagtcaaggatgccttggagatagattgcttaggagactgcataagtgttcatgtcaccatgtaggccacgatcacaagggatatgttttgggaaggggagtagcatctggatgtgttaggggaaaaggggaaggggagggagtgggcaaaggtggagagagatgaggcatttggatcagaccaggccacctatcaggaatccttgcacattctaagactgcaccacatgtttgttcaatcaatagatgggtgtggacagtcagcaggcaaatactttgctaaagctaagtggcattccaagtgtcagctagatccgaagagataattgtggcctatacatcagcagcaaatacatgtctgtttacttactgaccattttagaaaatctgtggtgtaatcagataggcaggtttaaggcttattaggcatgtttacttctgtaagatgttaaaaatgagcccattcaaccaaaaagtcattatgaatctacttatgtaaagcaattttctgggttctttaagggatagagagataaattagacacagactctgctctcatggaacttgtacaaatctaaaatagataaaatttggggggatttaaattttgctgacatgtaaagaatttattcataatttccaaaaagcaaatttagcctcaaaatttttctagtaacaaaataagtctaaactttgtttccatgtatggtaagaaatttattattatattgcaataaaataaaagtatgagtgaaatttttgatagatttaaataattgcgagtgaaaatcttactagtcattaatagcccctcttctgtgttattcttaaaatacatgattacagagcttagcagcaataaaggaattgaattttgtcttttgtatatagcacaaagttgcccttcttcccatccaggtgtatgatatagcaatacattggagacttttaatgaaaacctgtgaaataatccatttttcattcctgggatgtcttttcttggcaatcaagacatagacgagaaaacacagatctcactcacagcctcaaaaagagccataggtttgaagaaggagagggacaacaagccaaaatgttggcactccttcttcagtttctagatccttctgtgaaaagacgtgttttcgtaagacccagacagaattcatttccatagagcgtttttaatggctcctgtcagaacaaaacagctgggaaacatatggtatccatttccctgtatcacttggaaaaaatttcacatgtaaataaagccaacataaaagagtagccctttgaacctacgaccttatataatacataaatatattggtacaatgcactcgttgtattgacctactaagttatgtggctttaaaattttttattacattctgagatgcacattttctagagcttccaaagaaatcaaggtaattggcaaaatattactaaatatactcagtaataagagtgtatctcagaaatgtctatgagtatatatatatttttttttccattttatttaaagccttgccgaaagttgatgaataaaattaaaggcatatttgcatcttataaactctatgtccactatctgctgttttaattaaataagtaaccatgtgttcttgaggagagaagacttggcagaaatttctggcagtcattaatttttcatggctttatatttttagagagaaaagttcatataaaagatagaaaacttcttaaatttatgagaccaactgtaattagtctttgcctttgcatatttacatttcataaataactttagcaaattgatctcttactggtgattatcactccactgagtttataacaggattttgtcccctgtgaaattaaactgtaaatccctcagaaggatgcactttgtgcattttagaagatttaatgtgttgtgcaaagtgagattcaaattcacatactagcatttgttaattgtctgatctatgccaagcactgtgtacaactgagaactaaagccagcaaaagggaagaaaagcagcagcctaagaccatctagataccttccttcccttctggaacattctcttctacattacttattggagagaatcgagccctccttccacagctcgtagtattctcttcttagattctaaaatgtcagagccagaaaggtctgagaagtggactgcatagtgcagacccttggaaacctcatgcaaaactgtggtcaatttcagggaaagaactcactgatagttatatagcattcaggctcagagcactcactctcatcccgttagcttggttccagaacttctctgaatccttttagaacatatcccagcaggaagaagaatgaccagtagcttaaatttagggaactttaataatgtatgttccactttcaccctaagaatcagtcatagccagaggctatggcagaagttatagatgtgagtatacacccatctcatgttctttttttctttggttgttcccagtagcaaagaacacacacatacacatgcttcccacttgtttcagaagagaagcggtaaatggaaagtccctagttgtagggcatgccccctgaaatctcatcctttgatgggggatgataggaactacatggcagggaactaggaacccataaatcagtggcctgcaagtttccaagggtactgggtcatcttttatctagcagtggagtggcccagggaggaagcagtataatcatatctgaggagactgttattgctccatctgcttgcctcaagagaaggcaccaggcagcctctcataaccaggagagatggctcttatctttcacctccaggtgtgtctggctgtttcactttctactctatcgcaaccagacacttactcaaatgcaaaccaacacacaatctttatccaaactttgcacagaaattagaaaaaaaaaaaaaaaaaaccactctgcctgacccattttcttttcagaactttcttctcctgtttgtttccagccttctcaacaatggagggcagtattgaatcctaaagaacatgttctgttgtgaagtgttagtgcattctgtcactgtgtcatatgtcagaaagcaccatgaaatgttgctgcatgatagttgaccagggtactttgaccaaggtggggttaactcaactatgtcttctctcccacagtcctttcaactcctgagcactgtattccttcctattctttccctaatccacttaatggcacacctagggagtcactcaaggaggtcatagtttgaatttgctcaatattaaataatttgccacttcttttcatgggacttcttgtgcattaggggtgtatgtggacatgcacgctaatgtgtgtgcatgtgtgcatacgtcccttttctccctaaatcagtttggaagtttatttaacactgaagatcttattctctaatcttgtttttcagggtggtgacaaatataaaaatattgccagggaggtagatctatccagggaataaacctaaatacctatctgggtttgcttccttagccatttacctgtaccattattattactttaattaattttgagtcactgtgttataaccttctttgatcattcactgttttccaatggtaagtatgattttttttgttctattgatgtgcactctaagtcatcctcacacacagaaccttaatttgaacataatgtgaatgaaccacatctacctgcatagccaagatgtgttcagcattccagattaatagctttctattttaattttttaaaaacagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctggtaagtataatctagttcagtatacatgtcaatagactggagactcctttttaataaactgcattcgttagtaacagaacgatgctgcatttgttttggtttttacttaatctttacttgtggctttagttgggagatgtgaccttttgagttttaaaataagaagttatgaagttaatacagggaaaacaaataactatagagggagtgttatttcattttaactttgcatgaattcaactgaagactcttaatctcaaagagagcccggcactttctttaacttgaatctcaatgtctttctttttgcttttcaaatggttcccagtgctctcacgcagctatttgtgaggatgtcaattcttggctgatggtggacctgccagacatgtaaacagagggtcttctgttttgtcctgatcattattcagaagaattggaccaggttgtttgaaaagcatttgtagatagaagcttacccaagggcttcattgccctctgacccaggtggagtttttacttacttccagctctgcatgtctagggagcatgaagaagcttttccaaagactctagacacagagtaacatgatgtaagaaaagtctgttctgctttggcttagagagagctaaacttaaatagcactccatctgcctacattgttcttttctggcttccagacttggatcaaacagtagcaagcctgggctcgtactatgatgctaattaaagtctcattcaagaaaatcatcacatcttggcaatgtgattctacttagtataaagccatgcatacttaagtacaatgtacttgctctattatcacaaatactattgtgatagggtaatataattgaataattttatgaaataaagtagtattttttctcctgaaaatgtcttttccattttcctggctcttccccctaattctctttggttcattcctttcttttgtccttctcatgttttcatgtttcccaaatgctaaaaacacctcttagctcacccaacaatctctatcaacgagttcatagtcaagggacaaaaacttcactagagatgagaaaccaaagccatgtagcctccagatacccccaggagtttgtttgatgacagtgtctagaggtacctatgagagcactagtagcagcagtcatcatgttgtttgccatagccagttctctacaattcaaggcaaaataaacaggtagagacaaatagctcattcattcaacaaacatagaacagggaataaaacccagccccagccctcaaggacttcacaatcaagtaggggagacagacagggaacctgacaattactgtaaatgtaattatagttctttagaaagccaacttgaagcctccacacctcattggccctagccctgttgccatgtctcgtatgaagatctgtctctcgagaactcattttctaaagcatattgtaacaaagaataatagcaagaaactgatttattagatccccaaggctgccaccagagcttctataagctcatttcttctttccagtgcccagagaaaaactcctacagggtcttgctctgatttattgacttgggttttctaatcttactatttatacagccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaaggtgactggttgggggctggaacctccacagctagaagctggatttctattttttaagattccttgtgagctaaagtgttggaagggagagaagagagtgatttgtcaagcaaagagcaaatgaacatattgcatttaagagagtaatcatttcagtcactgctttgagattttgagacttaattcccagtttttgtcaatctgctactaaagagaaaggaaaatgatatgttgtagttctaacaacttttgttattcatagggattgcaattaagcttcttaaccacacctggatctatcaaagactatcatttcttcctaatatgacaataatgagcaagacgaatgtggggaaggtgtgttttaaggatgctagcactcgggagtatttcagatcacaaagtgggcgcttaacggatcacatctgaagtttgagtgtcttcagtatcaagaattttttagagtatcagtgccgagtttgagtttagctcttgcagagcacagtacgctaccaaaaactacacaaattaatgtcgactggaatagagttaaaacctagaaactgtgagacaagaaacatggacttttatagcactgcagcaagtgcctctgcaaaatatagcacatcactagaagattagctattcaactaaaattacctaaaagatctttggcaaataaatgtagaatccaatcatatttattaaaaagccagaagtgacattcagggaaatataatacatcttgtatttttgcatatgtgctttgctttacataatagttgtgtcttctaaaagctgaataatcataatttttataaatttaattatattgaaattggtgaggggaatttgttagagaaacctacatgtgaattcactaaagaacgttacatttaaaaaaccattaactgctgttctaccttaatatattttttacgcaaacctgatttttttgtatttttaatttgatgattcagcaaagttttatacattaaaaaataatttccattttatttaattttgctcggttaagcaaggtaattaataaggtatacttcaaatctagcatagaagataattttttaaataaaataaatctatgaccctggtaggtattattttgctttggttgtaagtgatatgatgttgaattaagaagtaaacttcaggcagctatcatgaagaaagataaatagaactaaactacaggcagctatcatgaagaaagataaatagaactaaactacaggcagctatcatgaagaaagataagtcaaatgtaaagtcgagatttaatatagttgagcttaacaaagtgtaccaagtttaccaggtactgcgtttggtggctggcaatacaaatttgtataagtcatagtccctactcttaaggagctaatattattgctagtggataagactggtaagttatcagtaacacaagtataggatggcaaatttgggatatagccctgtgacagagttctgtagacatcaatgagcatgtgtcagtgataaatattcttgcagtgctaatgagtgttaagatttgccttgctgttttagtgtttataaaatacagttctcattagtcttcctaatggtagattatttatataggtagaagaaaataattttttttaatttgtatgccctagggcttgttttgatagattaaaaatctctgagtagaaggtacataagaaacttagtggttgttacgccaatcttcagcataaacaccttctatgatatccatattaagtttcaattcattcttatattcctgcagtcaacataagattgccatcataccatcagtgtgcaaacttaaacagcagtgtttttttttttttcattttaatgaaaaagatttcaaacccataagactcaaaaacttttacaggtttgaggtctcaggcttttcatacttaacttccagaaaatgatttgaatgttctattcctttattctagaatttacaaaagcagtaaatacaaatattttataacaagtgcttccctctttagaaatctgtcctgacgcatattttgtctcagtccattcagtgtattttgatgaacattgatgacattgagagagtcctaaagagtcaccattttgttttaggaccttgttttgaacaccagtaaccaactagtggtgtttcacctcattaaacacagttttgagggccctgctgtcatggaaagacaaagttggtacaaatgtacagaagttgctaagataatatgacttggctaacaggaagcagagtcagggataaggtatcaaatagaaagatttacctgggaacgggctttgaagtcatatcaggacttaagaacatctccctcactattaaactcctggaatggaacgtaataaattctgccagttacatacagaatttattcaccacttctgggatacccaagagtacatactgtgggagttcagggtattattgagttttctttagaaatgattaagcaaagtaattggaaagaaatatttctaaaaggtgagagcagtctgttttctaaaacaggacagaagaagtaattattttaagacttaaatagtctaggaatgaaataatcttaattcccttttcacttctcattcagtccttttgattaagccaaaaagcaaagtgtccatctggatataacgtgacttcaaacacataatcttactgatacccccttgctgtatgttaaatacagcaagtggccccaggcccatagactttggcaggcaaaaatctcctgctagaattttttgtttgtttgttttcttagtatttatatttatggcaagtaatactggtttcaaactcacaatagtgatataatatttccttctgcctttctaacagcattttgtttaagtgttgcctccttgaataactagaactaacagacatctaatagaacactacccaacaatagcagaaaacattcttgtcaagtacacatgaaacattctccaggatagaccaaatgttaggctatgaaacaagtctcaataagtttttttttttttaccttttatttttatttatttatttattatactttaagttctagggtacatgtgcacaacatgcagatttgttacacatgtatacatgggccgtgttggtttgctgcacccattaactcgtcatttacattaggtatttctcctaatgctatcccttccccatccccccaccccacaacaggccccagtgtgtgatgttccccgcctgtgtccaagtgttcttattgttcaattcccacctatatgtgagaacatgcggtgtttggttttctgtccttgtgatagtttgctcagaatgatggtttccagcttcatccatgccgctacaaaggatatgaactcatccttttttatggaagtcttaataagttttaaaggatcgaaatgcaaagttatgtccttcgatcataatagaatgcaattagaaatcaataacaaaaggaaatttgggatgttcataaatatgtagaattacatgtcaaaataaatcaacgtgttaagaaatcacaaggaaaattaggaaatatttatagatgaacgaaaatgaaaatacaacataccaacacttacaagatgcaactaaagcagcacttagagggagatttgtagctgtaaatgcctctattaaaagaggaggagaggaaagtgggaaggagaaagacttcaaattaatagcctaattttccaccctagaaaactagaaaaagaagagcagactaaatccaaagcaagcagaaggaaggaaataataaaaattagagtaaaaagaaataaaataaaaaatagaaaaataatagaggacgtcaataaaacagcatttagttctatgaaaatatttttaaaaagtaatgaatgcctaatttaggtaaactgaccaaaaaaaaaaaaaatagaagacctacattactaaaatcagaaatcagaaatgttgcctcacatttctgtgttctgtgtaaatgccagtttgcttaaaccgtcttgcctagtaaatgatcaatatggttgctattcctttcttcttttagcgggaatgaagcacattgtatttgtgtgttagtggtttttcgtttttaatcctggtaggaaacatttggcatgctccaattgcgaaatttaaggaaagtctgtaattaagggattatatataaaaggatggttgagggtaaggggttcgtaaaggaaagtgcagtaccctggggtgtttatttaacagccaggacacggttacctccccaaagctgggaaagggaaaggagtggttataagaacttgagatagaaaggactgagtacaaaggactggcttacttttgggctttttaagggactcagatggccaatggcaaccccatagagagggcctcaaactcactttcctttcctgatctgccactgtcaccatcagccagatccagccagaggagcagggagccaactcattcagaacaaccttctcgggcaaatacctcaggagaatagaatctgcatgtgaatagttgggagttccattatccaaatggaataaaatgaagaatgagcagattacctcattgtcctccttttagaataaatttttacccttgagcagttaaatgatagaattctaaaataaagagaaactaatcctattctactaatttaaatgctaccctcagtgaagcctcccttggctccctgccaaccatacctcttttctcctgggctaaaatcccacaagctgcaaactaggaaggcagttgaatgtttgatttgtctgacagagttattgcgagaatctaagagagcattctaatagaaggtaacaagtattgtctgcttagtaagtttacatgctttatctcatttaatcttcatggtaactctatgaggtagttactattatccctgctatttcactgtttcacagataagaaaattgagtatcggataggtaaagtaatttgtccatggtcttgcaactaagtggcagattaagatttaaaaccatatcagaatctgggttttaatcacgaggagatacgtatctgggtttatatatcatactgctctataagtggtagggaacattttctacagacatgtatggactatattgtagctatttacatgccttgattgctttttgagagaagtttaagtttctaaaaattatgagaaattttttaaaaattatgagggtaaaaaatactcataaacgactataagaaaatcctactcttttttttctgcctacttttacttgatcctaaaggtcaagagggttggtttccttaaaaatgtaaaagttgaggatattttactttctgtatccatagttatattatttgtatataataaaagataatttccctttttaaaattgtttaatattttactaattaagatatttacctcatcccttaatgaaatttttaatttcaaatatgagtttactgatttttcattaacaaatatgattctttggggattggaaaacagttgtgcatcttatgaagtttaattgaagaatactgattaactgaccatgccgtgtgttggcttagttttggaacaattagaatgctcatatgatgctggtggtgatataaagtgggcaatcactttggaaactagtttggtggctttttattaagtcaaatatacagctaccatatgactcagaaatttcgttatttaccgaggagaaataaaagcatgtattcactattcacaaaaaaaattcatagcaactttattcataatatcccctaagtggaaacaatccacatatctatcaataagttattggataaataaattgtggtataattctacaatgaaatacttctcagcaatagaaaaggaataaattactgatacaagcagtagcttggatgagtcccaaaggcctgctatgtaaaagaagccagacacaagagtatatacactaatctattgtgacagaaatctcatcagtggttgtttgggacaaatgagaggagggtgagaaccaaagagtactagaacacttctggggataatggaaatgttctttgtcttgagtgaagttatagttacaggagtatacatatttgtcaaaatacatcaaaccgtatactttaaaagattatattttatagtatacaaattataccttactaaagtgaatttaaaataactgattacaattatgaaaatgaacttaaataaaaattctgcaattgatttcgagccaaatccacagatcaggaatataataggtgatatctttatatcataaataaattaagcctgatataaatgccaaaatttatatgatttctttccttggtgaaattaccatctttaatgtatttttcaaacctgagttaccttgaatttccatctccctttcttttttaaaacctagaatggtcagttggagtgcgtacgctggatggtgagcgaaacagaagccattgcagaactgagttgttctaaggattttccaagccttattcattacgcaggttgctatggccaggtatgaaggagttttttaagtatcttccctttgtgtaccatataatcttcctacttttttattattagtccatcaaaatccaaacataagaaatcatcaaaaatgtatccaaaggtatataaccaatgatatttgttgttatttttgttttaaatgaaaaaaagtttacaacaacctaaataaatatcccatgacagatattggataaataatgaagctgcagccattgatgacattttatgggaaaatgttcattatatagtactaaacaaatatgtatgatacaaaactggtcctataatttagcaccaactttgaattttggagataaagagaaatagaaattaatactaaaaaaattatgtcacaacatgtttatagtagttatcactcagagtagcagtacaagtggcttcgattttctatttttttaatttttcagtattttccaaattttttacagtaaacacatttaacatttatcaaaaggaacaatgatacattttcttgaacccaaagttaaaaggaaaatctttataagacattaatcaaggcagtctcactcaattaaagatgaataagcacactaaccagatggctctcagttgcaatcaatttccacattaggaaatcccaacattaattagtgtacacagatcacaatccagtgtttgcagttaaaaaaaaaaattactacctccctttggagaatgtgactgtgagttatctttttaaaaaactggaaccacaaaataccaatctcagtcttaaaaaataatagtactgtgttaaaatagatttaattgtgtttgtggcaaagaaaattgcttctcatgcatttaactgtattctctctggcttcataaactttcctagtagaagtaaactgtggcgttgtcaacaagagattatgctttttcaagtaagacaatctcaagttcaaaaagtagacaacactattaccacagtctttctttagtgggagtcatgcttagggatagtttattttgtgctgtggtaacttctagtagtgtgtgtgtgtgtgtgtgtgtgtgtgtgtgtgtgtataatatatattacataaaaacatgttttttatatgttatatacacatgtaaaatgtttcctatgtgtgccaggcaccacgccattggattttgtgtacattctctcatttattcctcaaaacaaccctgtgagagcttgttgtgtttatccccatttcatagatgaggaaggagactgaagaaagagagttacatgacttgcacatggtctaatggctagtaagagcaaagactagatttcaactcagattctctcacttcagggccagatcctgttttgtccccatttgtatagaaaatgtatgcagattgtttgtagaggcactgatatagctgaagaagacttttttttgcagttttatctaacaatacattgtaatatttggagtgcttcacactactcattgaagagatttttaactgtaccaaatttatgaaatggagaaaggagcaggccctacattaaaatttgtaaaagccactgtctttgaaatattatacttactctgtgttctttgtgcattgtacttactagtccccatccacagtgtcctgaaaatgattactggttattaaggcatgacgtaaggatgtcattttttgcttatgcagacgctccccaacttaaaatggttcaacttatgatttttggacttcacagtggtgtgaaataaatacacattctgtagaaaccatacatcaagtttgaatttcgatcatttcctaggctagtgatatacagtacaatattctcttgtgatgctaggccgtggcagctgcagctcccaacagccacgtgatcacaagggtaaacaatcaataccctatagtgtattaagtgcattttcgacttaacaatattttcaacttaggatgggtttattgggccataaccccattgtaagtcaaagaacatctctactggcaaagaagagaataggattttcaaatgatcggaagaatttgatcactgttcatcttcctaatcattttgagtctaaaacaaaattttattcaattgtgtgaatagttatttcatgtctccgatttcatttgcttatattaaagcctaaaaaggaattttaagtatcagtggaaaggctgcctgcacttttggtagagcttgccaaagaaaaggaggaaagaattacagggctgttctgagactctaagtaaataattgggcattcggcatgctttgtcttgggaaatgttgattatatgtgccagtttctttattcagctctcacagcaggtttctcataattttgaagctattgggactgaacaaaataaagtgccctttttctgggactggttgggtcacagtgtgacttacttggtgggactagaggaaaatatggaaattggtgacctgtttgaagagctgtgtcaaacgtttgcttcatgctagtgtcaatattcaggttgttatttcaagatgatatgcattttttatgacctaaaatacagctctgaggggggcagtccagcagtgcccttaggagatcattcttacccaactggaaaatatagaagcccattagaactgcaaatgctgtccagccatcctacatccgccacagccacttatgtaacagataacctgtggagatgctgaacttggaaccattacaagcctaatattttcacaaggaagactgttattgaacggttttctaatggattcagcatatgcaagtttttctacatccagcaggcatttgagtgtgtcctggctttgtttcttcagtaaatgcccctggaaaggatagtacagaggaaaattcctctcttggtttattttagccgctctctgcccttcatatagattcctaaagaatgggctccacgtgactcctaatttgtgtcgtttttcttgtaaaaattacctttaaagactctagtaccacagggtagccaacagtttttagtgctctcctgaagtgatagatccctgggtgataggaattgattttcttcatcttgacacatgaagtctcagagggtgcaattatttcattgcctgactgtacctggcagaactagccacagggaatgtgaaggtggaagcatcagggacacccgaggaaaaagcagggagtgtcctcggataggcctgctttgctggcccttgagaaagatgttgctggcaaaacaattgagatggaattatctcaattcaaagctactgcctgtgtaacttgggctgttttattcaaacatgaaggttcagattgtctcatccaggctctcccagcacagcttcctgccctccactgcttgggagcctctgcctgctctgcgctggttattagtccagtgggctctatgttactttcaacatcaaacctgtgattccttttgtttctgaatcattcatgtgacttttagtcatgagattcttctacgaaaacaacctgcatcatggcattgaacatttactaacagcacctttacctacactgtttttattattttctgtagtttaaatatttgccctaatacagatttttttaagggcactttttgaaaaaagaaaaggctcagcaattcttgcaaatggtcatgagcagtggtagacatgctggtgaggggggtgttcccgcaggctgtgttattgttgtttttccacaatttactttaaaaaggaaaaatattcccctgcctttattgttttgctgtcatagggaagtaagtcaacagtactgaaagtgctgcgatcacagatgaaagcaaaatagaagagtctttgattagcacacacgcatctgctctccaagttctgatcttgacaaagcataactgacacagagccctacaaacccacagactgacaggcagttaactgtgatttctttgactcaaggggcacaaagggagcatgtcctttacagagtcaggggtcatgaggggatgcgcaattgtggatatccatactcaaaagacagaaaacagagtcatgaagaacattggttcatacagcaaactgtctccattgtcatcctaaccttaccacttactagttcaatgggttagatattttaattttttttttttttaaaaagagagaaaatataagaataggtctccctggacctcagtttcttcatatgtaaaatggagataatagaaccttcctcacagtgttaatctgaggactaagtgagaaaagccacattgcccaacccatactaggcactagatgaatgtcggctgttatcactattgaatctcctccaacttattgtttttattcctatcaatattattcagtttacttattttaccattagtaatgtataggagaaacttgcaaaggaattattaaggccataacctatttaatcaattcttaggtgcactttatttcacattttaccgtcttttgattctacatatatcttacaatacatgaaattataaaataattgctgacctttattttttacatttttacatctcaaaaactggaataaatcttataattggtggcatattagatttgataatctatgatcacaaagctaactccttttaaaacatggattgccacacactatagagactttattgataccagcaataaacctgtgacatacttctcaagtacattttttattggaatttgtccagcaaatctcataaatcacatgagataattgcctctttaaacaacttgcattgcccttaggaacacataaaatacaacattaaaacaggttaccaaaacagcagaaaatccccagaagaggaaactgctgaggaaaactatataagaggagttttcagtcagtacatgaaggttgaatggataagtggatatgtgggtggatgatgaaatgtaagttggagagccattctgggaaacaaatgatacagaaatcttcatccatgtgacttcattagatattctctgaaagcaatacttatggggaaatgaaggtctgaagttacatccatcctttaatgtctcctgcatgtagatacactgactgagagaacacacactgaggggctaagaggggagggggacaccattacatatgtatctaatcatattaacaagtgccctcttggctgaagaaaagttttgtccttcttaggaggtattttcagatagtcattttgaatggtagaactgtgcatctccacaggcatggtccccagaatcagggcaggatttgtctgtaagcagatattaaatatgcttttaccaaaaccagagactctagccatctccatgtccccctcaaaaaccctaaatgtctgttgttaaaagacaaggtatatagtcaatccgtcattttggggagtacttctctgcattgtataatggaagattttggtttacatgtcatatctcagtggacaggccaatcgcacttcttattttaaattcttatgcttattcttaaattgtccaacataaaacccaagactggatttgaggtgctaggcaaaaccttgttctgaacagtcaaataatggttctttctttatgtaaatcttgcatattgaattggttagaatctttcattgtaaggaagaagagttatccatgccttcctaagaaggaaaggcaagttattgtaacaatataggttgaacctgacttggaggccccctcaggggcccaggtaacttttggctcacacagaccatgtatgtcttgttctcccagattatcaagcccctgaaaagtccgaggtcctagactctccccacagatttccacaatgggaacattcccactcttatgaggggcagtattccattgcctataaccccactactaaaactaaagcactgtgattttaataaagggcatttttttgtgtatgtggaatagacataccccccataatattggggcctggaaatatggaattacatccaacaagaagatacatgtaaaatgcttctcagtatcttgaactcctccaggctttacttgctaaagaaagaagtctctagaatatcaaggaatacagcaggtccttacattaacctggtttctttcaacatcatcttcttataatgttgatgagaagaaaaaaaccagttcccagccagggccactgtccctgtggagtttgctcattctccacatctcagtgtgggttttctctgggtactccagtttctcctcacgtcccaaagatgtgcacattaggtgaactgctgtgtctcagttgtcccaccatgagtgaatgtgtgtgggtgtgagtgcaccctgtgttaaggtggtgtcctgtccagggatggttcccgccctgtgttctgaacttccaggatgggctccagccacccaaaccctgactggaatgatcagataaataattatcttacttgtttgtattagtctttcttaaatgtatgtatagctcatatttgtttcaatgtttcactttagaagtgtttggtctttatttagaagtttggtgctgtttttgtgaccagaaatatgtcataggaactaaaatggtaaaattagtttcattatacttcattttgcttaaagtcgcaatttccaagaatctgtccatgccatcacatgaggacttgctgtatatcattgtccgctccctcagttttctgacttataaaataaggctttttgaattggatgattctttaaaatctctcccctccacatgtttaggagtccatgatttaatatcttgaagcaaaccaaatcaccacaagtttgagaatgacccattgaagagaatttgttctgcctatggtgggtccatctgtttcactggtagaggtaccataatctatcctcttgcagcctccatgtctgagccattaacctcaaccagttggttatgtcttttatcctgagatacttccattcatccagatttttaaggagttaagaatcgtatgctataatcatctatgtccaattaaaagtaatccagtgtttttcccctacctaattagaaaaaaaacaaaggaactgcttttacgttatgcaaatgaaacatcacctgctgtggtccaaacatcagctccaattttctctaggtttgcctttgaagaagaggactaagcatagcagcatattcttatccaacctctaactcccagccatagctccaggctctgcttctacctcattctctagggacccttgagggtttcagtttctaccatgtctgtctccttttgcagttaacactcaccctgctttctgggatgccttcttagaaggctgtaggcatagattacattgttctcatcatgctctttaggggtcttactccctggtgctcatttagaaaaagtgtggtgcaaatgttcagtctctccctgatgtcacaaataccttcataaacagtgccctgttccccaacataaggggtgaaacattaaaagatttggctgtttttatccaacattcctttagcagattagttggcatgttcagaagatgaaggcaaatttaatccagaaaagtataaaagttcatgagcagtcggagcaaacaactggaaaaaaaaatcctttaaaaggctaagaagaaagaagttcaaggttatttcaaacacatgatcatctttttaaatgtcaaattccacccactaaacttcatgctgttgtttttaccactctcatatttttttaactttatatttaatcttctattttaaaacagtgaaatcccatccccctgctttctccaaaggccaagcataacatgaaaataccacaaaacactcagtgggtaaaatgcaaacagattatgacaacacatactgtgactgctctatgtctttgcttttgaaaggtttgcgttccaagcttttggttcccttcctttaacatgaaagaagggaaatctttaccttaagacaccaccaacacttggtcagaaaatcaagagggtcctggttttatttcaatgaacttatcttacacttggcaacttaacgtatttacctgttttttataagcctgttgattgcaggaggtatggattataaaggcatggttgaagaattataaacttaagagtagaagctaattctcaacaattcaaggttttatggtaacattcttgaagcctacaggcagtataacacagcagcaagaacattgccttgggagccttggaatcaaaagacatggattctagttccaactttggatctgtctagctgtgtgccttggatgaggcactcaatcttactgcaaacctattttcccatctatagaatagataagtaaaataagagcgcttccaagggagcttcctgctcttaaaattctctatgccgtcctctttcattcatttcagtcagagattcaaggattttcaattcacatctgaatgagaattttctcttgctacggtaagcatggttttacctaagcttcacaaattagggtattgttttcctctgtctttttatctaacttctctgcaagatattacatgaattccaactgtctttgtgtttataggaaaagattcttctgtggcttcttcagtttatgcaagaacagggcatctcgttggatgaagtagaccaggatggcaacagtgccgttcacgtagcctcacagcatggctaccttggatgcatacaggtacacaggccctgctgttttgcaatgagaaatgagtatatcaaatattaaacaaaacattaaaattatgttcactaggagaatgtctgaattaattcaccttttgtatggtcgtagacaataaggaattattgctctatttgtgtttccagaaatccacacaaatgtaggtaggcataaatatccataagagtttctctttcagtgtcccagggtgttgaaagggacttttcctgctcccttatcactgctctaaagccccagtgctgaggacaatagacattaaatttccccatgttctcaaggcaccagagaaaccactaccaggcagacatctgtctctcaagtggcaggctgctcttcccctaactagtaaatttcatcctccaggtatatgaagaataagatagatttttcaggaatggattagaattctttgtgtagggagttgtaggctagagagagaatgctgtagttccccctttctctgtagtaggactgagcttctcaaatgcattcaaaaggtccagaattggttgggagtagattcagatattggtcctctccgcccttgggcaggccacccagggccttgattgcccaaccactgcacccaacagcctcaagtagccttatctttttaccctaacttgccttctaaatattgtcatatccagtgtgtacaatgatgtcaaaaagttggggagctgagccacaggagaggggaaggagtctcgaccccctgccccaagccacatgaagggtgctccaagaaagctccctagagagtgtagggttcctatgagaagaagaggtgacatctcatccctcagttgaatgcagagctgcatgaaactgggccaaacccagagctgccatccaagtagtgcatggcaggaaagcccaacaaaggtctccaggagtctggagtatatgtgaacataagacccaattgatctttccaccttgaaaatgtcgaatgccctcagtgacagagcaaaaagaggggatagctgaaggaggagtagcagatggaagaggcatgacaatgtgaggaaaggaaaggctttgaattggaaacaaagtcaaagtttagacttggtctagaattttatttacagacataaatcattattaccagaatcagaccaattataccattattatcattgaaagtgacccgacatatatggatttattcccatatctatctgatatataggatagggaaattgacaacatatggttgaaggtcatgattagagacaagacttttacctcatcaagttcatacggttcaaaatatgttatggtatataacatgtaatacactttctacctttaagaaagcagtactcttttttttttttttttttttttggcttacacgtgtgttattttcctatgttgcaaactcagtgtgctcagttattcaacaggtacttactgaggccctcctgggtgcaagatagatggtatccaaaacagaaaactgagaggtgagaaccagttgctcaggaaggtagaggagacttgggaaatgacaggagaatatatggggaaactataaatataaaaggcaagagatttatgaaaacaaaaagcagagataatagcagaaatctctctagagtgcctactcacatgaaactgctgtttggagaactcacttgataggaaatagtccggagagctgaaagtttttctattattgttggcaaagtgtgcatcttctaatttaaggcatcaagtttttaaaagagtgatatgaaattggagagtataggagagaaatttaaattcttaacaggttctgcagaaatattaaaggagtagcatttttttgtaaaggaaatatgattgaataaacattgaaaaatatgcttttctatttaacaaaacactctaatatttaatagtcttgaaacaaacttttaagcagctaagaaatgactaaagccaaagaaagccagctgatatcactacgtgagattttagttatttttctttttaatatgtgaagagagacagtctttgcttttagagcgttcatcactccacttacacacaaatgatatttttggcactgggtaccatggaagtggaaacttggataatcttggaaggggatctgtccactgggtgtgaaatttaaagaaaaaaaaagataagagaccgagagtgagcaagggaccctatgaggtgaggaggggactgagtaaggaaaacaatggaaagaaaactgcagaggtcagggccaagggggagtaataacagtgtgtgtttatatagcatctcttcaagagccctgagagctcaatactgacatggtctctgtgacactcctgtgaggtaggtggcaatggctttgtggtgagttgacctttcatggtgagtgatcataaaccaaaaggaaaacgaagctccttactgacctctcagtctaagtagtctaaaaatttaaatactacaactattgcttaggggaaaacactgtctactacccagattaatccaggtttgcagtctcatcatgatattgtcaaagaatctatcagattgtagtggttgattaatattgatgtaataactttttgtggaatctaataatatcacagtatggacacaaaatagtttggatttttttaaattattaatttcaaccatgttccatcaaatttctctctctccacaactaatgataccttggccagattccgtaactttctcctttcttatgactattaaaatttactccaagcctctttaaaatctcagtcttacttctgattcaaagcattctccttcccacccagactagactcaagattcaagggacttggaatgggagtgagacatgcctttttacacaccactttagctcctatccccctatctcttctgggctgcagtgtcaaggacaagaaggaggtatgaagagaaaaagtccggtatctctttgcttaactgggaaaggcatgcaacctccctgaaagttgtccctgcttctttggctggctgtggtcactgatgccctctgtgccaaccttcagatgctgactctccagtgagtgccatggttggggtcttcagagggccctctggagccttcccctcctcccccatacagttctctccacctctggggcagcctattgccaattgtagccatagaaccctctcctcattaaagaggtgataagaagctcacacaaagctttcttctacaaagcctgctcaatccacagacatgtcctcaccatagcccattgtgggagggtgggagctgcttcacagcctccccactctcagccatgtcatttctttccagttctttttattcctgatcaggttggcgcagcaacaaataaacaggtgttatttcaaaaccaattaccagagaccaaatccagttactagagcccaagcaaatgagaacaggtaagattccagtctccccctcttacaggcatctctgactatgagtgattctcttggagcccaaccatgacaagagacagaactccccaccacaaagactgcactgcatatctcataaaggagagcacactatggacagcctcctcctctccttcccagccccctccttatgtgggctgcagatgagcattgatagtagtaggactggctctgctacatcatcatagactctgaagggaggtgtgtgatattgactgctgaaaggtccctagaggctctcttcatactattcaacattctgttacagtcattaaaaaataatgtgtacagagatgtcctgatacacatgtccttcattttctgacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggagtaagtggcctgttggttccatgagaaccaagtctaactcattattgttgtacttaggcttcagccccatgctgtgctgagcactcttctttccagttgtacagggaattcctagcattctcctcttctgttcttccatccaaagtcctcacagccagcgttcgtgctgaagatgccatctctgcagaggcaaaaggatgtctaaacagtaaagtgtacagcaagctcccaaagcagggaatttaagccagtggacaaggcgagagagcctctctctgtgttcacaactcagggccagattacagagcgctggaagcactcataggcatcatctccaaacttttgtccttaatattttaggaatcataaagaacatgagagagaggaaaaggctagagatggaccaatttcccagttttctcaaaaagaaaaatgtgtgggggaaattacagataaataacttggtgactatcaccagcaaatttcttataaaaattaatcagatgattcatgaatcttcataataaaaaatagtgctcagtcagcatgaagttacttaaaacacttcacgactaattacagtcagttcttcccttgataagattattaaactggtaccagtgcatgtctgggtgtcagggaagtatttctgggagattgtcataatatgcttagagaaagaggtcccagatgaaaggtcatcaggtctctggcaagttgaaggactaaggagttaacacctgcctgaggggaaccaaggtcagcccttgaaaagctcacccattaaatacagtttccagattggggagggtttcctgaaaatcagtcagtattcaaagtaatgttgacagattaggagggtaaatcttaaaaattaaattttagagggaaaatactcttacctttaagttttacacacacacacacacacacacacacacattttttttctgaatacagctgtaccctagaacttaaagtataatcaaaaaaaaaaaaagaaaaaaaccttggtttttttcacccaaccttggttgggtgaaagacctcaattaattaattataatccatgcaacaatatgacaaggccttggaccctctgcctcttctctaagcttagggaaatgtcccttctctctctccttccactcttttgccttcaagctacaagtctctgtgcccctctacccctccccctgtcaatactagaataatttctttaatgagtttagacttctagaaaaaataaattaaaatttgaaacttgaaaaaaaggggttactgccaaccatcctttgcctagttacacaaaacttccccaagttaggtgagctaggtaaacttcaaggtctcaacgtaatcacagggaaaatgcacacaaattaataagtcagtaagctgtctccccacagtgaacacactgtgcaaatgcctttatgaacatgtatagatatttcaaaaaaacaagttcctagaaaaggaattgctagagcaaaagacatacatatttaaaatgtggatagatgttaactaatctttccaaaaatgctatactaatgtccactccctcaagtaatgtatggacatatccataaagaggaactttaaaatgatccaaaggaatgttttttctaaaggttcatactcagagaagggaatcacaaaacatcctccttcttgttcatagcatggaatctacaaaactttcatgagctacaatcgctcttttattggtgaactgctcaaagtcaaagtcttggctgctttctcagttggtgatcctgggataaagtacacatatgtactagtagactgcagtccttcagttgtctccagaacagaatgctgtggacagctatagttgggccaatgacaagatgaactaagagaggctacgttgtataccctagtcttttacctactgtatatctaggtgaagttggcaaaactagaaatgaatggagaaatcaacttggtacagccacagtacactgtgcccttcaggctcccagacaccaataacatagacaaggacaggagagaggatggaaaacactagtcttcccagtccaaaattctgggggaagacagtcttgagtgccttttccaaccttcagcaactcctcagagttaataaacatacttaatatttagaaatggcaaccttcagctctactgaagtgctaatcaacaagcctaggtattatgggtgtccccatcaaaaaagtatgttagattgtgaccttatttggagacagcacctttacagaagttatcaagctacagtgaggtcattaggatgggtcctactctgactagagtccttataataggagaacatttagacacagacatgcacacggggagaatacccgtaaacatgaaggcagggatcaggatgtgcatctgcaagccaaagaatgccaaagactgccagcaaaccatcagaagctaggagagaagcaaggaacagcttctcctcacagccttcagagggagccagcctggccagcaccttgatctcagacttccagcctccagagctgtgcgataataaacttctattgtctaagccacccagtttgtggtacttccttacagcagccctgtcaaactaatacagtggccatctgcccatatattttcttttctacaattaaagctgatgagttcttcctgagggctactatagaatccagagagtagtcttccttctccattcatacctgagattcaagttgtcagtcaacccaattaccccaaaatatttttctttgactgtgtcataattcacttaaagacacataataagccctttaaaagcagacgctaatctttcttcatctgttttatcccctcaataaatatttttcttaaaaacatgtgacttgcaataccagctagcaaagtgggaaaagtagaatgcttttatgtttttagtttttatttttttcattagaccagaatcagcaaattatagactgtggaccaaatctagcccatcagttgttttcataaataaaatgttactggaacacagccacacacattcatttgtctattgtgtaggactgatttcatgctgcaaaggcagagttgagaagttgggatacaattgtatggttcacagcctaaaatatttactatttggccctttaagaaaaagtttgcttgctggttcccatgttagacaattacatgtcagtaggtgagtctggaagaatgagtgagataaaatgagatcacagacttctctggtcttagtgatgaaatgtttggactaaaactgatagcttctgagaaaaacaaagtgcttggagcttatagaagagtattagcaggatccgatctcacataattagatttagccagctaatcgttgctgagtatatgcagtgacactcagcaaggagaacattgggccaatatctgaagtacagcagtcattttaagaaaatttatgatatatttgtttagttacatgtcctggctcgtgagagctgctgtcatttttttctgctaattgtattattataatagttttctattgctctgtaacaaattaccacaagattagtggcttaaaacagcatcaaatttatcttacagttctgtgggtcaagccaagctaggcagaacacacctgtagtccccactacttgggaagctgaggagggagcatcacttgagccaggggttcaagtccagcctgagaagcatagcaagactctgtctctaaaaatatttttaattaaaaaattttttaattcaaacaatttaggaaaagtaaatataacattttgaagtatatccttccatattttttatatatatatatccttccatattttatatatatttttatatatattatatatatttttatatatataatatatattatatgttatatatatttttatatatattatatatattatatatgttatatatatattatatatattatatacatatatataatatatatgttttatatatatatatacacacacacacatacatgtgggaaagacagagttagttttcttaaaaatgagattacaaggtcaggagatcgagaccatcccgactaacaaggtgaaaccccatctctactaaaaatacaaaaaattagctgggcggagtggcgggtgcctgtagtcccagttactcgggaggctgaggcaggagaatggcgtgaacccgggaggcggagcttccagtgagccgagatagcaccactgcagtccggcctgggcaaaagagcaagactccgactcaaaaaaaaaaatgaggttacagatgctcctaaatttaccgtgggtttacatcccaatgaacacatcacaaattgaaaatatcataaggtaaaaatgcatttaatacacctaacctgtagaacatcgtatcctagcctagcctaccttaagcgtgttcagaccacttacattagcctacagttgggcaaaatcatctaacacaaattgtactttatgataaagttttaatatcccatgtaatgtattgactactgtactgaaagtgagaaagaatggctgtatggatactcaaagtacagtttctactgaatccatatcactttctcaccactgtaaatttgaaaaatcacaagttatagtaagtcagagattgtatgctgcaaatagtattttgtagtttccttttttatttaatgaaagtaaagtatacttcatatatacatatttatatatatgaaactatgctttatatctacattatatagacataattaggaagacttcttctatgtccatagatactcaaacatattatcattttaatagctgtcattatagaaataattataatttgttcactgagacttactgctaagcatttaggttacttataatttttcattaatattgacaatacatatctttttggggtacttttgattgtttccttaggaaaatttctgaacctgtaaggatgaatattatgcacattttaaggcttttgtatttattgcaacttactggaaattattacgaaaaatattatacaccctaatttatagcagtaaccagtatcagagtcctcatgtgttttggttgttttccccagacaaacagtagaacgtgtcacgctgcagaaccaactccaacaatttctagaagcccagaaatcagagggcaagtcactcccttcttcacccaggtaataccagcacattgttgtttagcattcttaagtatcctaaattgttaagccttcttctgaacttcctttgatatattttaagaggatgacaacagaaaacattttcttcttataaagaggaataaaaatgagaaatcacagtgaaaaaggcactggacctagagtctgaagacctgctgtattctctgattctgctatttcttcattccacgactataaacaagtcatttactcttttgtaagaattgaatctttcaattcttcatctgtgaagtgggaataggagatatatatatatagcttgataagtttgttgaaaatggaattaactgagaaaatttatgcaaaattgatgtataaacagtaaaacagacaaatttagtagtcatggtagttatagccgaaggcataaggcaccttatagctgatactatggagtatttgcacattgtttcgaaaagaaattatgtacttatctgtattctgttcttatttacttatacattattagtgtcagtaaagaccatgtagtgacttgagtcatttcaacccagtaggaaatcatctcatatgtccttcatcttctttttagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagtaagtgctatttggagaatattcttttttttccttcaaatggattatgttgttcctaatatcacagattgtgggcccacactaccttgagggaatccccaggaaaaaaaaaaatccaaagggatgcatggaaagccaacttcatgtgtctaatgagacatgtcatgttagatacataccccttgctcttcttttggaaaatactctaagagagaaaggttaaaaaaaaaataagagattatattctggtccataaatttccctaaatggcctaatctttaggtgttagggtcctagacttggaggcatttctgcaagatgaaaccaccaattagcgcaagtttagtcctgcattggcattgattctgtcccaaggaagagtttgttctcttcatgtgatgggatagtttattctcaggcccaattaaaaagtacataaatagatgctctattgccaaagacttaactacacaactttgggatgacctttgaaatgaatacaccacagggacctccacataggtattttacaacacagactcctaagtgttgattggagcctataggagcctgaagtgcttgccagtccacaggggatggcagagtatgccatgaactacattttataattgccttcactggaaacccatgcactataatctgtgatttatatccagtggataggcgatatgaacatctttttaggcaatgtttcctgcaagctttgtgcttgccatgccattaaaaaatggtatagcagccaaaatgcaaaactctctgtggaatggaatgacctagatcattctccatgtgatccagataaaccacccagtggagctgcagaatctttgtaatttatcattagctataatgttagaatcccattacaatgaggtctaagaactgtccaaattctttttgcagtacccaaatcaagttttagtgagtatttctctaataagttgaacaccaaattttaaattaaatatcaaattcctctgtaaattgtccttgttatagaagactatatcatgtatttgtttcagctagaaaaggcatactcgtgcccaaaacaccagaccttttgggttaaatgtgtcaaaacttaagtcactcagatcaaacttttccaggtaacttactgggttctgctgctcagtagtaacagaagaatcatctcaattgcccatgctccttaaagtgcatactaagccactgtcctctaatctatctatcttcctgcatgcttcatgtttactgggacttgtgcatgtgctgagcttgttgcatgttttcagatgatttttaattgcacctctctaggaaatgtacagcagctgcatcaatctttcctctaacatgctgattgaagagcatctgtgtaacgacacacggtacgtggtgctaggagatatgctgtgcggcattgacatgctttgctttgaattgcatgagcttttaaatcatggacttggagcacctttcatcaggggataacaccaaggaagaagaaaattacaactattcccccaagtagaagcaggcactgatgtaatggtaactaggtcttaggtcgctagtctgcccttggagggctttattccagtgtcagccagaagaatctgctcagttcacaaacttttgctgtatttcctagttgactttagctttcaatctttgttttaatggagtcaagtattaagaaagtattgaaattaaatttcctgtcatggtggagtgagtcagcctccgatcagaactagaactttgaaacagagctttaattttatttcagtgctgattacaaaccaaaagctccttttattaccattttgctgatctcaggagaagcaaggccttgccattctgaaatttctctgtgttagcattatgaacacgatttcagtccatgagccaggtttatgagtgccctctaataaaacaagggcctttctcaaataagacgtttacaattcaaaatgcatggactacataacacagaaaggagagaatcgagtccccagtggctgggccacctccttgggcaaagttcttctgcaacatagctttcatctccctgtgggatgaaaccagtatgccttaattggtttacttcagaagagttacatccctaaacccattttaaaagactatcacttttttttttttttttttgaagacagagtctcactctgtcacccaggctggagtgcagtgacacgatcttggctcactgcaacctctgcctcccgggttcaagtgatactcctgcctcagcctcccgagtagctgggatcacaggcctgtgccaccacatctggctaatttttctaattttagtagaatggtgttttgccacgttgctcaggctggtctcaaactcctggcctcaaatgatccacctgcctcagccttccaaagtgctgggtttacaggcgtgagccaccgcacccagtcataaaagactatcactttttaaatatttaaacgaattgaaaaattataacatgccattcagcactcttccaaaatcctccaaagcatgcatgtgggtaggtggataggtgggtgttggtgtggatgtatttgtgtgttgtgggtatgaattttagttgagaatactaagttgtaagaaagtcactctgcttttttcttcctctaaatcaaatttaatctgctctaagtctttattcaggctagagagaaattaaatctcagtcattttaggggatgcccctagggggctcattaattcagtatgttaaaggaagaaccttggagcttcaatatttactggtcaccagtgatctgcttgggtcaggctcacatgttgccagaagtcaggtgtctgaactgcttccggcctcaccggggcagggaatcttggccaatggtgagagcccaatgcctggggtgggaaaggaatagaaaaaaaacatactcattcccctcctagaccttggtattagcccacttctatttcatttctcctaacctgggttcctcacccctatgcccttctctgtccccatcttgggaggaatgtgttttctggtgcctggaaaattctggttttgtccttaagctgaagttaccagcaaccccctgaggcaagaaagcacaaatagttggcaaactccttgggaaggggaagaatacttcttatttcttccaggctcctacagcaacagggagcaagacaattagtatcacagtagattctcctgccagaaacatttcattctgtctttttataagaaagggaacaaagctgagacatctgttataataggattacaaaaatcagagcacaaaatgaggttatggggctactcagttatctgatgctaggttaacactttccttctctaagcttaaggaaaagtccttctaaaggctcagtttagattcactggctttacttattaacagagtttaatttcaacaataaatacttagaaaccccaaaataaaaatattcactgtatttaaataagcatcttgaccccttctcctcattaccctgtaaattaacctatactttatcatggttgtcatttggcatgtgtttccataggaagtggaaaccttagttctttcatgctagaaaggagaggtttcactcactcataatcacacacagacagagagaactaggccggttcactcctgagataaagcaagaatggatctctctggctgaaataaagattcttctgataaattaagactagagtgggaatgtgggcctgaaaaatacctaggcttgcctaattttgcctatgggaccccactgcaagaaggaaaggaactaaagtgttcatctctcagctatgactccaaatcttggccccaaaatttgcttgaccaccaaatggctcctctcaggtagcagggatgcacagagtagtatgactttggaagtcagtggcagtcattgggttggagttggggccaaatgttattgcctctacatggccctatcagcatatccctggggaaaagagtgaggcgatggatcccggttccaggaatacattggaattccattttagttaaaagaaattgttatttttttctgataaaggaaaaatagggacaataaatataacatttttaacattttaaagaatgtctgctctgtgagggctctgtttgctgtttatttttctaaattgttcacagcttgatagcaaaaatctaaatttcttttcaatgccctttaaaattagattcaactctattcctttgagcagcatccccagtgtgattcaactgtagaggatcacttggtttataacaagcagatttatctttactttatcttacaaaagacaagttgtttttaagttattgtaactccaaggaaatgtttgcaattacttgtcttaaaatgccagtgaaacattcatttcccagagtttaagtccatctgagatctttagggcacaaagtgagcagtgattccagttactgataggcaaaagggcataacccctggccaccaccagtaacacccactttgaccacagttgcacagttgcctgaggggttaggaaacgcctaatcctagcaccagcattagcatagagtccttaaaaatcataaagcaataaacaccattagtgtgggttttactgccaaggtattagccacactgggaacttcatactgagagccaagagctggtatcaaatattttgcatagatcttaaggttgttcagcagccacttcaaagagactggtctgcttcgccagtagtgagatgacatctactatagtaatggtcatctgctgtgcccattagagagtcagagtttagggtatcattcccccacccctaacacacacaaacacacatttctgtccttattgccaggacatcatactaaacagaaaaaggaacaaagatgtggaagacattgggaagtaaaggtgaggccctggctgaaacctgctcccaaccagagcatatcctcagccccactaaaaagcatttccagaatcctgatgggaaaatgcagccagtgcaacaagaccctggtgctgctgaacaaatgtctccttgccatcatttctctatatattatcaaataaccatattttaatcttgctttcattttttgaccttaaaatgttaacattatttttaactcatatgcttgattcttgaaaggataatgataaacctactcaatcatgtgggtgttgttaccaaactatgtaatatatgttgagtgcatccttccagagacagacaaatctcaccaatgcaacagttcagaaaagtttgttaaagctgttaatgaaaaagtatttagtaaagtagttggtgcttaacactatagacatttgagtttttgctcagaaactgtagtttcatgttttttatttttgttttgttttgttttgtttttgagaaagggttttactctgtcacccaggctggagtgcagtggtgcgatcttggctcactgcaacctccacctcccaggctcaggcaattttcctgcctcagcctcctgagtagctaggattacaggcgtatgccactaccacccagctaatttttgtctttttagtagagacgaggtttcaccctgttggccaggctggttttgaactcctgacctcagatgatccacctgcctcagcctcccaaagtgttgggattacaagtgtgagccactgcaaccagcctgtagtttcatgttctaagccctgaacggaagtataattttctgtttgcctttctaacctgctggcatcaggctgcatgcccaatgagcaaaagttgaaagacaacagccaggtgcctgaagttgggtgattgcctctgctccagaaacccttagagcagcactgaccctcccagctcccatgcttccccaggtactctgtgctctcccacagtgtacccccaggtgctccgtggttcctccccaccaatgcttccccaagtgttctgtctgtgtccccacccaaccccgccaactctttctctctctctcactctctctctctttcctgcctcctcatgcttccttaggtgttctgtgttctctgtcctgcccacacccacctcagcctcgcctgtagtttcaaagtattttcagaaagaaaaccctcattttataccatgacttggagaagaagaggaggctctaaacttgaactatttcttcacatgaattaagcgacagttccttctttcaaatgtgccaggttttggggtttctattgaccattgcacagtagaattacagggaattgttgccaataaggcagagtcttgtgtataaagaaaaaatgtccatgttatgagaagccagaatgatcacatcttcccagtgtctaagcacaatttagcaaagtctttatagaggctggcagagttcccaagatggatgcacaaatggggtgtcttttcataagctccttacactgggaaaaggagaaagcagattgcaccacaagaagacagtgaaacagtttagttagtgtcaaagtatgatatgttgagacataaaaaaggcagggaagaccctcgtactctcttaaatcactattccagggaggcaggaaatgaatgtgtggagtttgtgaacacccatgaaccaacagtaggaagacaacaggaagagaactgccttggacaccaaaatcttcccaccagaccatttgctttcaacaagccgctcctgatttaaggatagtcagaaaacctaaggacaactcacttctccacccccaccctcctttccttattccccagagatccagttttgaattgtgtgacctcaaagcacatacatgttctattaatgtcatatttgcaccacacgtctgccaccactagaggcatctttgtactttaaaagaacagagcctgcctgtatctcttaaggctggagtttcaaagaagcaataggttagttgagtttaaaaataccaaatagagactttacacagccactttccagtgccttcatcaagtatccttcccccggccagtcactggtgctcttcgttcccacgctgaggacagcgcggatggacaatcttcctaatgccacatccctggatggccgggccactctgcaaatattttcagctctaagccacacattttgctctgccaggataaggcctgattccttcactcagggagatcataatcaagagagaatgaaaataggattcaagtaaaacatggcaagctctgtgaaaaaggcctaagagcttcatgaaaatagtaatccccaatagcacctttgtactccacgtgtactcccagtgtcttgcttggtgcctggtgcatgatagagacttcatagatatttggagagaggtgaagctagagagaggaaaagtggaagaagagagaaaaatatgaataaaaaaaggactgagcctgtcttcccacagcggggaaaaatggtgtgttctttatcaatattggccttctggtcacaagtccacctacccacagtgagtttccatttgggcacttcaaatacaagttttcatgccttgaaccaaaatccatttcttagtagatgagacttatagatgtgctctcagtcaaaactctgagggagatcacagaaaatagcaaggtttccctgttttggttatcagcggaaatgtcgtgcgtgccgtggaccattctacatggatgctgtaagttgcagtctggtcaccatggactgtggaaatctgcaatccatgcctagaagagtcagcaagttagaacacttgaaaaactgttatttaaatttaagctttttttctttccaattttggtcactcagaatgtgatttcatatccaaaaatgaaatagaggagtagcaaattatctgaataattcatgccagaattacccaaacactttcgttctttgaatactgttaatttgggactaggtaattgaagggttcagggaggattgaattatcctgatatttttcagataaatgcctcaagttaatattttacttggtacagacttagctctaatcataaggggttttgtcctgcagaaagagtgctcattttagtgtttttgaccacagcacctcttatattaaagcagaaatgcccatcaaagtctaaactttattatctttagactatgaccaaaaccttcttttaagtgttctattttaatttattgttaaagtgatatagatacttataagagtaatactagcattataataaagactggatgtgccctgtgccaaacccacccccttccctagcctcactcttttgaatcgaccattcacttttccttcaggtgttttctctagtattctctatttctaagtaacatgctcatacagattttcagtttcaaatagtatccctgttatctactggcattctactatagaaaatcaaaatgatagcacttataaacacttataaagcacgtacagtatcccagagaatatttcaggtgctttacacatatgtactattttaatcttctcaatgacactatgtggcagatacttttttttttttttaagaaacagggtcttgctcagtcacctaggctgcagtgcagtcgtgtgatcttggctcacagcatcctctaacttctgggctcaagagatcctcccacttcagcctcctgagcagctagaactaccagcatgtgccaccccacccagccaagcagatactattattatcctaattttgcgtattggaaactgagacatagaatgattacatatcttgcccaagattacatagtaatgatggcaataaattgtggagccaggatttgaactcagtctggctcctaaatccgtatttttaacaatgatccaaatgtgtctagctccattttagcatccaacaatccaacactgcacctgttctctcttgttctgtctctctctttccctctctttcctatctctcacacacgcacctacacacatgcacacattcctgcttcctcttcctcccacccccatgaatatagttgtatcactctcaagagctaaatcagtattcagtgttaattatcattatggttatttaaatattaatcacaaggactcattatgttgtcctatgttatattttctttctcatacaattttatgtttgccatggaaataattttggtttcttaatttacaatgcgtttctaaacactctgctgaagaccaaaccatcttttagcaccctcagacagctcaggtgtttgtcagttactctctgttcatggagacccctcctcctgcccccatcttcactgctgcctcctggcactgccacacagctatcatcctggagtctctcatgcacatcatcctgggaattccttgtgcttctctcctgtttagactctgtttcctgaacctgtcttttcctttctattttgtttattctcatgcttcagtcatatatcttcccacccaaggaaggtaaacagttgctaatttttttgagaccctgacagtctgaaaatatcttcaatttaccagattgagtgtttgactcagtataggattctaggtgggaaattattctctttcagaatcttgaacacatcatttcattttcttttgcttctaatgtgtctgttgagaagccctattcttctctgccaatggcttggaagattttatgatttcttctttatctccaatattttgattttttgatgctttgccatgatgtgggtctgttttcattcctgggctgtgggcactcagcaagctttttcaatctggaaccctcagtacttcagttctgggaaatgttttgtacaatttctttgaaaattttctcttctccaatttctctgttccctcttttgaaaatcctcttattctaatgttagacacactggactgatcctcagattttctaatgattcttctctatttttccatactttgactttttctagtttgaatctctaatatatctactgaaacttgcctttcaatcttgctattgaattttttatttctgttataataatattaatttccaacatcactttactggtcttctctttgttccttttttatagctgtttttttttttttttctttttctttttgagacagagtcttgctctgtcacccaggctggaatgcaatggtgtgatcttggctcactgcaacctctgcctcctgggttcaagtgattcttatgcctcagcctccataactgggactacagccaccacacctggctaatttttgtatttttggtagagacagggtttcgccatgttggccaagctggtctcgaactcctgacctcaactgatctacctgcctcagcctcccaaaatgttgggattacaggcatgagccaccatgcccggcttttatagagttttatgtgcaaatcttatttaaatttttgcagtcaaatacaaatgcgtatctttatcttcctttttacaataaaggtgtcgcactgtacacacagttttgtttcttgcttttttttatctgacacgttggaggactttatgtgttagtatatagagagcttcttcattctttaacatagttgctatcatcttcagaagtacacggtgcttctaattcctgcatctggtagtgcaaatcagttagttggattccctgactgtaagcttgggtttttgctttttctcctctgctaaatcaactctaaatgttcatccacctttttgtttctgaaataccattgacattttgtctgttgtatcctctcctcccatttcccttattcatctaaatttgtgccttttttatttattttatttcagtgttattttgcaggatatggaggacaaatgtgtgtattcaatccatcatgtttaattggaatctctcgcacatcttttagccaactagatttttctttcacctcttccctttccctttcttgcccatggacagctctctaaagttccagttagaggaaaaataaaaataagaattataactttcagatgatgatgatgatgatcaaatatattccagcacactgaaaataggcttcatggtctttgtgagcaagcacaattttgagactctggagccatgcctggggttctcctgcatccaaatgtggtctcataatagctagtatcattaccagaaagtgtttttgtctggtgtagcaacaagaagtaatttagtaatatgtggccttgtccaccctcagaatatagctcctctctgaagattttacacccagaatgggagtaatacctcatgaaaatgattgcacctacccaagggaaaatttatttgaaaagcaaagctgttccaaggctcgagtttgtactcttttcccgcagacttagcaggtatcaagtactgagggaaaaggagcatattgttctttagctttttctttttcccatagatttatctacttatgatctttcaacatgctattactcagtaatcacacaccaaaaagcattcttctttaaacttttaaggctcaagcttattggagaataaaagtgtcaccagtgaatctatctaaataaaataaaaatattttgtttatactcagccaacaatactatacttcctatcttgtttaactttgataaaattcccttgactgtaaaatgcctgtatttcaatcagtatggttgagaaattatttccatagctgagttaaagagtgtttagtaactgtgtgttattacatgactattgctttcattgtttaaagagtagtttacatgaaaagagaataatttgcgtattggaatgaagtgttcttcagtgtggtttgtgtgaggataatttccattttttggtgagctgtttagtggtattgtcttgtaacttgaccatagttttatctaattttggcctgtggtttctcttctgcttaggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagcc

SEQ ID NO: 38539 - DNA, 35417 bp, Homo sapiens; identical to SEQ ID NO: 37831

SEQ ID NO: 38540 - DNA, 4927 bp, Homo sapiens
aactttcactgctgccaccacaaccgcagggccccaattacctctctgttagaaatcggtttcagagcggtggaaccgcgggcgggaaaaagcccaggcgctgtctcgggtgccccttcgtgtcagccatcctctggtctctcgggtctccgaagctcggggctaactgggcgcgaaccgctgagcccgcctaccaaccaggccctttctcccgcccctctgcggctgaaaccctcaaggggttgcaggttcagctttcacttagagacagcaactccaaattcagggtcgctggggaaactaaggcaggactggggactctgagtgagaggtcagacgctggtcgcggactctttctcccgagaactggggatagctcttccgatagcccaaagcgattcatgcggatcctagaagaaagcgccgaggtccgggcggttggccggggagagcgaagcgccgcccacgcggctgggaaagcttggggtggcgctggcgggaggtggggccgggggcgggttcctggcggagggtggggcagacgtgggttaccgggtgtgccaaccaaaccctgaacagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggcccccttcttctctagtcactgcccctagggaccttgggcctcagccggcgaccctggagaaggtgcaggggagagggagcggcttccgcaagctctggcctccccacctctccaagtgaagcccgctaggcaggtgatcccgggctccggacgccggatcctggggacactgcttcacctgcgctcaacggtcacatcttcgctctccccgcaggtacggccggtgattgctttccaaggccaccgaggggtaagtgcgagctcagggtgtgtgagcgaggtgagggcgagggagcataaacgtgggctggaggtggaaggtgcggtcggggccggaggctgcgagtagtcacggtctgaggtagttccgataactgaactccaagtggggcgaggaggctgctggggttgtcccagggggctgtggtttgaggggactgtgctgtttcggcctcctggggaactcaggcccagctgcacctggtgtgctaacaagccctgtgggacccgtcttagtcttacttacggactggctcccggacgagtggcggcggcaggagggggaggggctgacttcatggggcttaccgtctccttccacccccagtatctgagactcccaggccctggttggtcctgcctcttctccttcatagtgtcccagtgttgtcaggagggcgctggtggtagcttggaccttgtgtgccaacgcttcctcaggtgagggggaacaggtagccggcaagaaagggtttgtggaaagtgggggagggaaatgtggagaggtgcttaagaggtctccaccctcctatttttttccaccatccttttccaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgggtgaggccagaaattgcagggagttgtgataaggtggggcaaagcctgaagtccaaggtatcccagtactccagggaaccaagtgctcctgccactttccccaccaggtgtcagtgtcagatccactggcaagcaaccaaggacagtcactcccaggatcctcaagggagcacatggcacagtgggaagtgaggtactttggatggggtgggactaacatgggaagctttggcattgtcttcctttctaatctccactcttaaatgttgtaataaaagatccagttccacctcctaccctggtcttcatctgtcccattcccttaaaatatcctagaagccagacccatgttccaaacagagaacctgttcaggcactgccttcctctgccagccggaaacgtctggacaaggtaagttagaatggcaagggctttttttttgtaacattaatataattaaacagtggcaaagactattttgaaaagcacttttagtcaagctaaaatttagaaattggaagctcgttatatgggaggaatttttttagagacaaggtctctctgttccccaggctggagactcctgggctcaggccatcctttttttttttcttattctcactcagtcacctcaggctggagtgttgtggtatgatcacggctcaccacagccttgaactcctaggctcgattctccctcctcagctggtgtgtgccactacaccaggctcatttttttatttttttgtagagatagggtctcactatgttacccagactagtcttgaaatcttgggctcaagcgatccccccacctgagcctctgaaacggtcaggattacaggtatgagccactgtgcccagcctaggagaaattcttgagagaagaacatatttaggaagctcttggctgtttatgtcacacagatattttcctcaacagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaaggtgagttaatgagaggagggtaaaaatgccagtggaaaagacttataatcacttgtgttttcttgcttccttcctagattctgaatccccaagtcctgaagatataccagactacctcctgtgagttccttgctttttccaatttcatcaagacttgttcatatattaagatacacttcctggaagctgggggcttttcaggggcaatgaaattgaaggtgacaactctctgctcctggcaggcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtaaggacaggacccagcctggctttccagctctactggccattaaccccctgctaaccatccatacacctgtgtttataaagtgactaagcaaagtgacaaggaaacctgtttgaagggaaaaattagtctgtatcatttggtagaatgagaagggaagttacttcccttctttttttggggggacagtctagctccgtctctcaagctggagtgcagtggcgcaatcttggctcgctgcaacctccacctcttaggctaaagcgattctcatgcctcagctttccgaatagctgggattataggtatgtgccaccatgcccagccactttttgtatttttagtagagacagggttttaccatgttggccaggctggtcttgaactcctgacttcaagtgatccacccacctcagtctcccaaagcgctgggattacaggtgtgagccactgcgcctggcccctctctcttttttttttctttttgagacagtctcacttggttgcccaggctggagtgcagtagcgtgatcttggctcactgcaagctccgcctcccgggttcacgccattctcctgccccattctcctgccgcagcctcccgagcagctgagactacaagcgcctgccaccacgcccagctaatttttttgtatttttttagtagagacgggtttcactgtgttagccaggatggtcaagatctcctgacctcgttatctgcctgcctcagccgcccaaagtgctgggattacaggcgtgagccaccatgcctggccgcccctctctcatttcttaatgttgaactcagtgctagtaatttctgtttcaggtcctggaagacaagataatccaggaatataaaaagttcaggaaggtaagacaaggtctgggaacggaagcaaggtagaatgagaatttttactttttgacatggatgctttttctctgcagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactg

SEQ ID NO: 38541 - DNA, 33411 bp, Homo sapiens
ggagggagccgcacgcggcccagggcagcggtctaggggcgccggggccggggcgtaggggccgttgcccgcgatggaccgcaccggagacgctccggactcgtcgccgcaggtcagtgctccccgcgcccccgcgggcgccccgccgcgcacagagcccctttctgcgtccccatcggtgcccacgccatgtcctcccgggcgcgcgctggggtgtgtgtgtgtgtgtgtgtgtgtgtgtgtgtgtgcgctgcgcgcgctgggggcagctggaaagggggccgagaaccgagctcgggctgggaggcgctgctgccgaggggctgcgaaacaaaacccggcacagcctgccctcgtcgaccgggattaggggaagagctggttctcagcagcttctaacaatcggcccgggctctcagtcgtcagttcccggccccctcagcaggtggtttctggtggccggatgaggagtcaggggtcagtcgtcccccacctccccacccctgctgcccaacagcgctctctggatcgctctctggctcctgggcactgccaagttaactctcttgagggggcccgagctctgcggggcgcgctgagggacccaggggtagcaagggtggcaaagggcccttgggaccttcggtgtagcaaggaggaaggaggcgcgaccagttcaccaccctcccatctgcacctgggctcaggtctgaggtcccaatccctccaaagtcagagcacacaacttccagaaaaaggaggctgagagttgaggcaggaaatagagaaggaagccaccaggtccgacagtgccagggtaaggaggtgacagccccgtaccaagcagctaaggtcaagaaccacccccacatgcacacacatgggagccttggccaacttccctgtccccttcctcccccagccaggcctagctgcatggattcttgtagaagctggagctgaaggactctggacatacaggaaggggacctttactgacagttgctagcccagtgcatgggcacctgcataggtggggtgcccaatggggcctagagcttgggctgtgtagcacgcactgttgaaaatgttggggtacggatgtcgtagggcctagcactgtgcaatgcctggatgtgtttgtgtggaaatgggaggcacatcactccctaagttactagggctgtggggcatgtggctgcacaggactgttgttctagggttttctaagatttgtcttctgtgcttatgtcgccctacctctgctggtagccactgcagagactgagacatttcctcccagagtctgctcagttggtgaccattaatggccttactggaccaaacatcaagccttccctttcttcccatggggtgaagaccctttcccagggtcttcagacagacttctcactctgcccagtccatgcccagcactgccaaaggttccagagcttagagacattttccctcttccccttttcatggaagcagaaatacttgctaaggttaatgggactgggagagttaatgcatctgtgccccattcagcactggagccaggagctcgctgttcctgtttctgtgcctgaccccaggatgcttggggatcactccaggtccaggtgagctggaagcttgcaggcgctgtgttgaatatgtgtgtgtaggtttctggttgggcagttactcactgttccaccagaagcagggggcaggtaaatcactgaggagataagctccagcaacaggattggagcccgtggcggagaccaaggagcttcacaggaggatgccctggggcaagcccagttcctcagcttcggcttctggggagacctgaaggttctcttagtggtttctcggggataaggggaccaagtcagatatacttttcctaggtgtggagcacagggtgatgaggccggccaggagctgggagtgtgagatggggaagaggatgcaccaaccgaaaggctgagcggacaggagcatggtgctccattgtttctggaagagagggatgagtgttcctctctgatgagaatggagaggaggagaggaacgggctcaggaggaggaggaatccgagagagagcctgactgaggcagagaaagaggcagtgagacaagagacaaaggcacggaggcgcactggcggacagcagagggaggcacacaggcagaagtcagggcctccctgactgagtggtgagttggggcaggctgggggcctccccctgttcccctacatcgacctcagcaattgtccacccctgcaggaggcccctcactagagcagttggacattctactgaggaaggtgctttcctgtggctctcaggaatgtgagggtcttttagacagaagcccaaaggcagagggaggccaggctatgaggtcaagcacatcaagagcttgcagggactttcagggacacccttcacccctgagcatctcacaatgctgagggctcctctccatcttctggccctgccccagccctcctggtcctggaatgcagggcagtggggaaggatgtggggtctggggaaacctggcactcaggagaagaagagaagtcatgcaccccctccccaggcccccaggcaaaaagacctttggggaccctactgaagactagccaggggacatggaagaagtgcagtggggacaggcccttggccaggctgtctgaggtccagtctcatctccatctgtggctagccgagtagactttgaaaaaaacagagctctctaagccccggcttcctggcagtctataaattgggaaactgtcatctcaccagtttttagaagaaatactagatgaattttaatttaatctatttattttatacaccctcacccccttgcttccaggatgaggatggctctagaatttggagtagcagcgtcaggccagccctggagccaatcccactggaatcggtgcaggctgtcccacctccctcctcaccccactggaataggtggaggctatcccacctccctcctcaccccactggaatcggtgcaggctgtcccacctccctcctcaccccactggaataggtgcaggctgtcccacctccctcctcaccccactggagtcggtgcaggctgtcccacctccctcctcaccccactggaataggtgcaggctgtcccacctccctcctcaccccactggaatcggtgcaggctgtcccacctccctcctcaccccactggaataggtgcaggctatcccacctccctcctcaccccactggaatcggtgcaggctgtcccacctccctcctcaccccactggaataggtgcaggctgtcccacctccctcctcaccccactggaataggtgcaggctatcccacctccctcctcaccccactggaatcggtgcaggctgtcccacctccctcctcaccccactggaatcggtgcaggctgtcccacctccctcctcaccccactggagtcggtgcaggctgtcccacctccctcctcaccccactggaatcggtggaggctgtcccacctccctcctcaccccactggaatcggtgcaggctgtcccacctccctcctcaccccactggaatcggtgcaggctgtcccacctccctcctcaccccactggaatcggtgcaggctgtcccacctccctcttcaccccactagaataggtgcaggctgtcccacctccctcctcaccccactggaatcggtgcaggctgtcccacctccctcctcacccgcttgagtcctcacacctccagactctgggctggacccacccttccttatcccaacccaaagaacccagagcccgccttggctcagagttcgtccttgccaaacacaaaataatactttcgtgtctaattattgttaaatgtaatccttccaatttatcagcaaatggtcgtctaaaaaaaaaaatcttgacaccaaaattccagatctgtgagcccttcttatccatgctgaaaggtgacagggtggtcagagagcccccaaaattcagttcacttgcaccaacactgaccaagcacttacggtgttggaggctctgcaccaggtgctgggaacgtgaaacatcaaataatccaaaagtccaaatctagtgttttctgtttagctttggaagggttatgtgggttgctttttttttttttgcagctacagcaaatttacttttctaatgaggtttagctccagccaatattaaaatgagcctgcgctccctgcgcacacaccagctgacagcagggcaggaggcagcctccgcgccaagtgcctggcagggattaaggctttacctctgataagcgcaaaagtggagagtatgagtctggatcaagagttgactggatttgaggactaaccttgcccagggggctgtggattccacggctcagtcttctgagccatggcaggagctctctcttctcatacgtgggaaatgtgagccagctctctgctcacaggaagaagacctagagggatgggggagtggagacatgacggcacggcgtggggagtgccaatggcactgtagttggaggcctggctctgcccgtcctctctggctggctatgtgggctggggtcctctccttcccctctgcccatcttgcttcctctgtctgtggcaggtgagcaatctggcctctgaggccatgagtctctctttgaaccctgggctactcatttgtccattgttcagaaactgttagagccccacactgggcatggggggctgcatccgtccccaccctgagcagctcctcagtcacaccagccacatttcaagtgggcaacagccacatgtggctagaggctgccatcttgggcggtacagatacagaacgttcccggcagcacggaaagttctagtgggcagagtgttgtggacctgagcctgcacaggtgttttgggcacggaaagttctagtgggcagagtgttgtggacctgagcctgcacaggtgttttgggcacggaaagttctagtgggcagagtgttgtggaccggagcctgcacaggtgttttggcagggtggctaagtgccaggtcctactggctggattcaggtcctagttctgccacttagtagctgtgtggcctcaggacgttgcttaacctctctgtgcctcagacttctcacttttaaaatgagggtaataataggatgtttctgaggaggaaatgagtcattacagttaatcatgctaatcactcagagcatgcaacagcaagagcttttttattttttatttgaaaatagaaagccatttttattattcatttatttaacaattcacttaaaggcttattgaaaagcccactctgccaggccgcccccccacccacccaatcaacacaagtcctggctacctctgtgacccttcctgagcctccacctcctcccctaggatgggattattcctgactgagtgctcactgaagcccagggagctagaatgagatgaggaaagcaaccttgctttgtgcagacgcagccagatagaggggctgatgctttttggaggtgagtgccactgaaattctgttttgtcactaaaaagcatctgctaagcccccacactttcagaataagagcagcaaaggaggcatggttagctgccaccagccagcaccatgtcgagcagggatggaggaagggatgtgagaggcccctgcctgggctcacccctccctggtctggagggcgagagcccagaggctgctgtgggcttagtggagggagcagagcctggaggtctcagaggccaactgtgctgccacgagccccccgggcgctggtcccagctgcgtctgcaactcactgtgccacagacactggtggggcctcagtttcctcgtctaagacaggagggacagggctgcatgagcgtttcctcacctggaaaaatcacttccacagagcgacccaagccggaggccagagggagggaccctgcccaccaagccaccaggggtggaaggtgagggctggcctgaggggcaggagctggccattggtagccaggctggtgctggacaccccaggctacctggctgccagccttctcccagaagttggattgtgcaaccctgggctactcccttcttttcacagatgaggggacagacacccagagcagccctgctcctgtctaggggccacagagcaatttcacacaaggcagaggctgcatgccccagtgccctcccgggcagattgttggtactactggcaggcagatgtgtggggctgggggctgccacccccggggtcggggcgcaacgctgagactcccagggcccctcacctcctctcttctccctcagacggctggacccaggaaaaccaacctcaactatccctgacagagccctggggaaggtcagctccttcaggccacaggcggcaaattaaaaatacagacaaactaatgaaacccgtgaattgctagcctgccagagtgtgtctacgcaccctgaccacaggacctcaccaggcgggtgaccatcagtggaccctccgtggcttcagacctgggtttggggctgcccggtgcctacctagcccggacctgaagccctctgggtccccgtagctgatggggggtccccttgggggcgtcttccgaagcctaaggaggtcaccactgctctgacacccttgaagataagtcctgacccccaaggagtgccggtgctgggtccctctgaggcagggctgtggcaaatgccacccccgtggagttgctggcaggccgtaggtgcatatcaacaatatcgtcacccccccagccctgcttgcctgccccagcccttcttcttccctcctcttccctcatccacagaccacagagtgggagagacggccgctcgtggcacggggaggacactgagcccagagaggccaagggaccggccagttgcacccacactgcagctgaccgacacaggcccggcccagctctgccagcctgcctgggctgaagtacagcctccgggcgagctgctttcctcacggtcagagagtttctgcgtggtagctgaagtattactctcctaactcatcgcctgtcgatattagcttcttctcccacacataaatctctctctcagaacaagtgctccagcactgtgtctctgcggctccccaggcctgaggacagcgaggcggttgcaggctgtcagtggggcgtgcacactcttccgagtggcgtacctggagccttggaggggggcctcccgcaggcatacctggtgcctgtcaccccgtgattcccaggaaggtgcatgcttgagatcacacacagacacccaacccagccgtgaatgctcactgaagcccagggtgcaggctccgaggagtgtgctgtccttgactgtgtctaaacggatgttctggatgaatgacagactcgttttcattgttatttaaaaaacacataacataaaacttaccatcttagccattttcaagtgcacagttcagcagtgctgagtatatttacattgttgtgaaacagatctccagatctgtctcatctcggccattggaaactctgtacccattctggaaaccatcattctcagcaaactgtcgcaaggacaaaaaaccaaacaccgcatgttctcactcataggtgggaattgaacaatgagaacacttggacacaggaaggggaacatcacacaccggggcctgtcgtgggatagcgggagaggggagggatagcattaggagatattgctaatgctaaatgatgagttaatgggtgcagcacaccaacatggcacatgtatacatatgtaacaaacctgcacattgtgcacatgtaccctagaacttaacgtataataaatatatatatatatatatatatatatatatatatatatatatatataaagaaagaaactctgtacccgttaaatgactcccattctccacaacatcccagcccccacaagccaccatcctagtttctgtctctatgaattttactactctggatacctcatagaaattgaatcctgtgatatttgtccttttaagactggcttatttcacttagcatagtgtcctcaagattcgtccatgtcagggcatgtgttaaaatgttctccctttttaaggctgaataatattccattgcatgtgtattccacattttctttattttctttatccagtcatctggttgacaggttatttgatgtcaggctgtggagcaaaagctcaataaatggcaattctccccacttgcccttcccactcaggagatgtctgagcagaggggccacccagcaaatacttctgcccagagggaagctatgtcacagtgtcatgggagcatcaagaaggaggcaccccattctacctggcatctggtctggcctctggggctcccttcctgcatccagggctgcccaggcaccctgtggtgcccagccctgagtgtgaagcccctgggctgagtgtacctggcctggtcctgggggccaagcaactcagcaagtggagggactatgagggagggaagcatgtcccaggcaaacgtaccggtgtgaagggatgccagcctcctgctctcatccctgctgccttcccgggaccccgagaaagaaatcggccgggtactcctagagtctacctggggatgggagcccaggagagcctggagatcccctcccccaggtatgtggaggcctgtcttgagcctgtgccttgggctacatgtcggtggtggaccgtggatccgtagccgccctggtgctcactgtgtgataggtagcctgggaaacccagagatagtatcagcacactccactgtcaggggcactgagactgaggaccgcgggatcatcgcacccacacctcctctgctgtgtagggcacacactgcccactctggttcacacatgtgctcagggggcaagtcccctacccaagccccttcgacttttttttttttttttgaaacagagtctcgctctgttgcccaggctggagtgcagtgacgcaatctcagctcactgcaaactccacctcccgggctcaagttattctcctgcctcagcctccccagtagctgggattataggcacctgccacaacacctggctaatttttgtattttcagtagagacagggtttccccatgttggccaggctggtctccaactcctgacctcaagtgatccacccacctcagcctcccaatgtgctggggttacaggcatgagtcactgtgcctgacccagttcaacattttatgttaattgtttcttcttcaggcaggggggttagctgacaccccagaggagggagggaccttaggggcagggcaggtgtaacagagggaggtgggggagccctggaagtaggaggtggtgaaaggaaagttctccaggagcctgagcctgcatcctggggagacggggcagggagtgacagtgcccagggctcgctggccctagagccccatggacaagtcagttctctgacagctctggaggcaggagaagagaagagggatggggaatctctgaaatcaccggtccttcctgagtgcctttctgggaagctgggcagagacacaggaccagactgggcagggtgacgggagggaagcagcaaccgcacactggggcatacccgcgacttgactctagctcagtgtgtcagttccaaacctcagtctccccacctgaagaagcagggtgacaggatgggtgcccacctcatctcaggtggctgcaccgaggctacagcaggaaaaggcatgagaaagtgccttgtcgcctggtccacctgtgcaggggcacgtcctccaagcaggaacagagggagccagggccacagcgccaggttccaggggccccgcctcccgacagtggtcaggctgcccgcccccccccgccccaggccacacccttttgtcacaactgcatgctggtgtgcccagtttccattgagctcaagccacagcaccgcctcgtgctggggagagaagaatgtgctggaaaggctgcccgaaggctggtcgccactgagccatgaggaaggggccaaggtgcctccttcctctgcccttcctctcccaggcacttggattcagctgagttttacttttttttaaattttttataaattcagcatttattttagattcagtggtacatgtgcaggtttgttacccgggtatattatgtgatgctgagatttgaggcataactgatcctcttacccaggtactgagcatggtaaccagtaggtagtttttcaacccttcccccctcccttcttcctccctctaggactccacagtgtctattgttcccatctctatgtccaagagtacccaatgtttagctgccatttataagtgagcagtatttggttttctgttcctgtgttacttcacttaggataatggcctccagctgcaaccatgttgctgcaaaaaaagcattatttaattcttctttatggctacgtagtattccatggtgtatgtgtaccacgtcttcgtcatccagtctactgctgatgggcaccaagcttgattccatcagttccctgttatgaatagtgctgcgataaacatgagtgtatgtgtcttcacggtaaaacgacttatattcctttgtgtagacactcaataatgggattgctgggtcaaatgttttaagttctttgaaaacctccaaaccacattccacagtggctgaactcatctacattcccaccaacaatgtacgagtgttcccttttctccacagcctggccagcatctgttgttttttggctttttagtaatagccattcggactggtgtgagatggtgtctcgtgactttgatttgcatctctctaatgatcactaatcttgagcattttttcatatttgttggccacttgtacgtcttcatttgagaagtgtctgttcatgtgttttgcccactttttaatgtgggtatttgttctttgcatttaaatggtctaaattcctggtaggttctggatgttagacctttgttggatgcagatctgtaggttgtccgttcactctgttaagagcttcttttgctgcacagaagctctttagtttaattaggtcctacttgttgatttttgtttgtattttgcagttgcttttgaggacttagccataagaattttcccaaggctgatgtccaaaatggtgttccttaggttttcttctaggattcttagatagtttgaagtcttacaacatttaaatctttggtccatcttgagttcattttcacatatggtgagaggcagaggtccagtttcattcttctgcacatggctagccatccgctgaatcttaaaacaaggtggaggtggtggtgtttgtattcaccactgtgttctatatgatctaacattcatagtgccaattgtgtgccaggccttatgctaggtgttttccgttgattccctcatttgatctgaaagtagccctgtgagagttaaaggtgaggaaactgagtcacagggatattggcatagctcctgctttgggttgggctctgggccctggtgtgggaatgcagaggtgagtaagaccaggcgcccccggaggagcttctggctcggggctagggtgcaaatgtgaaaaccggcaagcaaaaggcagggcccagggcaggaagtcccacagtgtgtgcaccttgagtgagcagatcggggcaggggcagggccagggaaggcttcagagtgggagagggaatgccaaaggcacagagcccaggagagtctcccctcgccagcacctcacccagaaccacagagacaacagcgccaagggaaactgagcagcctagggcagcatgacagcaggaaggcagtactgtggggcagttggctgctcacatcctccctctgggatgtccccaccttgctcacagcctgagaggttctgcagggctgtttcagctaacccaagccttggacactcagttccagggccagacccacctgctcacctggcttgcttatgtccaggctgtgctgggctccagcaggtaccaagtcagtcaccatgacctgtgccaggctccatgctgtggatggacacactcatccagcccatcacgagagacccttgctgcaaccggcactcagcatcccaagcagtgcaaccttgggctgggcctcctctgtagagagggtcagatgaggcgagggtcacagccctcctagcttccagggtccaggattctagggcatcccagcctttctgggttctggactgccctctgccactgctgggcagcctggcaaaaggggaggtcagtgctattagcagcagcagcttcgacggcttgcccctggaccctgccgttcactgggtagcagaatgtgcctcacactctggggccctacgggcctggcccccactgagcaggcgccctgtggtgggtgtgcgcccactggaggcagcattccacccatgggtgtcctgagcaaaccacaggcctctcctagggtgcatacattgctggctgactggggagtctctcagaacgggagcaggttggttggtgtgttaagagcgttttgctggaaccagggtccaagggcaggacccaaatcctggcgtggtctattcatagagctggaatgatgtgcacggctgattctaccccacctgtctccaacaggtgaggtgaggctggaggcgggtagggatgtggggaaacctctgaacaggagcaagtgagaacccctttgctcccatcatgcaggcgagaggagccattctggggtcaccagctcatgaaggctgcagtgagcccccccggggagggagcaaagcagagaaaccatccagcctgcaagcaggtagcagtgggctctggttggagaacccaccacccaccgcacccagaacagacctgcagttgatccattatcatatcagctcatcgccttttcaaaagcatcctggtttggatcaggaagtgtaaggtcacactagctctgatgaacaagggcagggaagtctcagctgccagccgggtgtgcagctgcagcacagaggcctgcccggagcacacagctaggaagaaacccgtatgtccccagaggccgggggccagctggccataggcaggagggggcccgggagggagccagcagtggacccagggccaggagaggtgggacagaggcacggcaaggacccctgcctggccactgctgcccagaggagtgcaaggggatggctgctttctatctggacctgggacacttgagacagtcactcaaccccctcatgcctcagtttcttcatctgtaaaacatgaacaaacctttgggattacaagggtttaaacattaaatgagataaccaacgtgcagtccttttggaagccataaatcagtactgcgtgtgagctgttgtgtttagtaggtttaggagcagcagcccccgcaaaccccagggctgcagagagagtagaactggcctcttggcctcaccccatctatgttccaggatccgaagccactgggtgccaaggacaggcacgtgagctactctcttatttgaacagggacccaattgtggatttgtcaacagggcacagagcaacactgatacccagctaagagcgtgcagacacgtgcctgtgaatacacgtgtgctgactcacggggtgccggccatgatcacacatgcacacacgcatgcacatgggtgtcaagcagcaggccagctgccctgtgaagtcactcaggcgggcagttctgtggtggccagcacagcctcgatgccctgtcagaacagaatactcaaccccaggggttttcttgagtcgaattccaagcaacgcattgaggaggacagggagcaggcagggagcaggcacctgagtcgctgtggtcagactggcgtctccccaaatcatcagcctcaagagagtgctgggcaagggggaggggacaccgggaccaaacccatgcttgctgttcctcactgcggggccccctaactgccactcaggcccaggtatacccccacacgcactgtaccctggccaagtcctggcagagaggagcaggcagggcatggaggcccaggcaagggagcagttgacagctggaaggaaacgagacaggtgctggtttgcaatggccaggcctggtttgcgcttgggcatcttgactcaacttgagaaccctctccctggctctggaccccccgcggctctgggtgggaatggggcactgccctctggcatgggaatggggcactgccctctgggtgggaatggggcactgccctctgggtgggaatggggcactgccctctggccccccctgtggctctgggtgggaatggggcactgccctctggcatgggccacgttgcatctcaccacaggacgaggaaaagcatgccatgttggaatttcagggacggaagctggcggggcagagatggccagggaacaggagagaacaggagggacatggtgggagtggtgggcgggcgcagggcaggcatccctgagtgccaggctgggtacgttgcagtcaggagtgcacaggaggatctgagcaggtcgcaggctggggttggagggtctgacagtgtgtggactctgaattgaggaggaaaggcaggcgtcagagagatcaccataagggccattgtgggtaaaaacttgacctggcccaggattaggggatggagccctaggccggggcagcagtggaaggagctgaggccccgctgatgcagggagaaggtggagtcaagggcagccctgaggttttcatgccgggaccatgacagaaagaagggggcttggatgagagctgcttccagaggaaagatggtggttggatctgaggttgtgtgttaggtcacaatgggacatgccagacaacaagaggtgtagcagctccgtgtgagagatggggaagctgaggccaagggaaatcaaaggacgccgtcaggggcctcgtgctggtgttttctcctctgacgatcccagaccctctcctctccacctgcctcttctttggaggtgacgtggggctttcaggtccgtggcttccatctgccctccagcaagcagcccggagtttggttggaaggaggcagcaggaagccaggccgagcagacccgtttcctggcccttccaggctgcaaggtcagcagtgacagcagctgctctttattggcccaactatgtggcagacggtttgcctgatttttttttttctagttatcctgacagcctagtggtaggagcagtatttttattcccgttttacagatgggaaaatgaaggcccagagaggttacctcaccagaatcccgtagcagaggcagaaagaggctggcaggtgcacagggtcgtctggctgtggggttcagaacctttctgcatcgcagggcccctccatgcatggctcttccaggacagaggagagcaaagaggtggtggcaggggggtggcagaaggctatgactgtggctgggttctgccgtcaccctcagtagctatgggactaggcagggtctgaggagctgagggccagacatggcccatctgccttggtgtgggggacagactctcaggtatccttggaagccccaccccccggtgctcatgccttcgtgcagtcctcacctttggtgtggatggcattcgtgaccagctcctagccagcagactgtgcaaaagcattgggccatcactcccaggattacactgtgctctgtaagattccatctgctagcagattggctctagatcccttccttgctggattgacgaagtaagtggccatgttggagaaaccgatgtggcaaggatctgcaagcagcccccaggagctgagggcagtcccagctaacagccagcaggaagccatggcccgcattcccaccaccacccaagtgagcttggaagcagagtcttcctcagtcagccctccagatgaggacacagccctgccaatacttcgcagccttctgagaccctggactcctgacccttaggaactgaagagagccaatgggggctgtcctctgccaagtgtgtaggaattggttagatagcaataggataggaaatgaatatacttgtcttgggagtggggacatttccttccaaaagtgggcctggcttttagaatgggcctagggcaaggatggaaaggtagcaaggaaggagggcaaaggaggttggggagcgaggacctttcaataccagacttctcccccaatcccaggctgggctccagggttctgtacaaggactacttgccagtcccacaaatcccaaagatagcatgaccctcagtaatccctatcacgcaggcaggggtcaagtggccaagtggtgctctgtgcaccatcgtccggtcatggttagcacattcctgccgaacgccttcctccactcggccaagcagaagcacccccactcccatcacccatcatgacctgctgtgggatggctcctctctggggtcttccatgggcctggctcaccattgtccagcgtcccacaatcctttatcaggtttgcttccttcagctagccttctctccagctgccgctccctctccggctgtccgtccccctgcagagcatctgtgtgcccatccccgcttccccacccgcccccgggcgtgccccagcagagagcagcagcaagtgatgtcgtcacacggtgaagccccaattcttgcttcagggcctcctgcatggaggctctggggtgagtggatgaactgctgcctgaagaccactagctacatgattcagggaacttcagtgacaccagccggggccaacagtgtattcggttgagattcctgcagttagccagaatggactttgacttgcagagtactatactaagccaaaccccagtttccattttttactgaatcataatcaaaatcaaagccaaagactatttctgaaaaaaagaaaaacaaaggaactacctaaaaaaagtcagtgaattacatttctgatgctggaagaaaaccaaagcgtgaaaatattctctgcaccaaatcagaacaaaactaatacttccttctgcccaagtccttggctgggttttcccagttagaagggaacaagatggtttgagctctggaattcacgctgcccttccatcagcagtcccaagcgtgagcctgcagtgacccaggctgggaagcagagtgcagacatcccagggcccaagcttgccactcttcctccatgagcaaggcgagggcagggtggggggagagcagcagtgccttcctgggggcactcggcccgaccactgaggtaggccatgcaggggatgaaaggtcagggggctctggccctggagcagggttgcccagtgggtgggcacgagggtgggccaggggagggtctgcagggggacgtggtgtgggcacgggtggcactggacacagaggccaaggcccgagtttgagcagctctgctgacacctaacgcagtgaccttaggccgatcactcaggttctctgagctttggtgtcctcacatgcaaaatggggacgagatctgtgtgtctgcctcatgctgtggctgctctgaacatcgagggactgggctttatggaaaagggagtcttactgtttcaatgtaagattcagagtggaatctgctatggggcccctccccagccctctgcagtcggtgaccagggcaaaggaggagcaggggcctgggaaagtggctcctatatggtgtgaggtcagtgcctgtgtcctgccccccagcagggctgtggtgggcccgggaggcggtggtgctgggggcaggagggccggggttaggttaatgaagtatggattgactgggctgggagctgattagctgtggcatcaggcgtttcctgagcagcgcctgcagaatcaatactaatccgctgatcccattaggggcacctggagatctgtgggacaaagcctgtccctccctctctttgggggcactggggttcctgggtgacagagatgatatgaacagcagctgtcttaaccagcaggttggtgtcctgcacccggtccgcacagcacactgaccggcgccgtgtgatgcctggggctccctctgctgtcaccactgagcccacgccctcaagagtcagtgacgccggttcccagcctgttcacagcactcaccgtctcgcttgctactgtcatcacagaatgtcatgtaaactgttgaaatagcgtgttgaagtaaatgtgttgtttctatgaaaatttcataaggtgagtccagaaaaaagttctccaagttaggtaaaggctggcagggaaaagtcatattctaaagggtgctacactcagactgctcaccaagtgctcctcagcccttgaatcactttgaagaaatcaaaacgagatcgcagcgggatgctgcgatgtggctgatgtcagacggtcagcacagacctccctgaccccgtgtcggctgagcggaagtgctgagagccagcaaggatgggtcgttcggatttgggaaaaattagcatgcattgtgcagtcctggggaaacatcatctatgggacaactggctctgcgagttacttacattgaaatgtatggcatgtatgtatcatttggaaagattcttcgccttaatggacttttttgatgaaccacttaactactgttcccatcttactgggtaaaaaggcctttctcgtcctccagggatgagtacctcggacagtgtctgagcttgtttgtaacctaccacgcacacgcatgcaggcctttgggaacattttgcgttcacacgtcacctgcactggagcgagctgtgtcgtctcttccgctctggactgagcaaagcttccccaccctggattgcccacagaatccaacacagtgctttgcctgctacagatgctcaattaatatttgttgagtgaaattaaataagctcctctcctcagggcctgaggcattgctgaggccttcgtttgaacacctgcaggctcagaagaaaacctttccatgcttttacaattggccagccttgaaccacccctgcacatgctccagcctcacatgttctgccccagcctgggtcaatcagagccttcccatctgagtcccagacaccccctagtccttattcacagcgcacagcaccctaaaacccatagacaaattcctctctggaggtgccatggctcatacctgtaatctcagcactttgggaagccaaagcaggaggatctgttgagcccagtaggttgagaccagctggacagcatagtgacaccctgtctctacaaaaaagaattttaaattagctggacatggtggcaggtacctgtggtcccagctacttgggaggctaaggcaggaggatcacttgagttccggaactcaagcctgcagagagctgtgatcatggcactgtactccagcctgggtgacagagtgagaccctgtctctcaaaacaaaaccaaatgccacaaattcctgcagagaggtgttcccagtatggccgatctccataggcatactggcccttaagtcaggactcagttccacgggcccttaagtcaggactcagttccatgggtgctggcccttaagtcaggactcagttccacgggtgctggcccttaagtcaggactcagttccacggaggctgttttgttggcgctcttgcctcgcctctggccctaggtgcccactgagctacactttcctcacataggacatcccttcatcttcgcagagccctatggtaacctccagttgctaaaatggcaggatcgttgaaacttccagctcaacctccctattgtaaagacgaggtcaaggagggcaatcagcatgacccaggtccccgtggagcacctgccggacacgtccaggccgccaccctcccactcccatgtgctgccccagcttctgctccccatctgggaaccaccctccactctcccacagggaagtgcttgcttccctctgaggctctgagggcacccggggagggcagggcacagccttttgtgtctctacttgccgagacgcctgagatctgaggttggtcacagatatggtgcaagtgtcaggatgggagttgtgaccacggcaggcctgggccctacactcacacacactgcccacgccgcgtcctgcctctccacgaagtcccccttgtgcctccacccatctcctcctccagcaccccattcttccccgtgcttgcctccatctcctgggctctcctgggtgtggccaagccactcctgcacctttgtgctgattcttctgcctgacccaaggtcctagaagccattctggggtccttgttagagacagcctgcgaccacagacaaacaccgccctcctccaagccccaggcagaagcagcaggctgcgagaggggaccagtgctggccaaccttgcagccccgtctcagactggggcccagagctgggggcaggtgcagcccacccgctgcctggccccaagcccctgcccagcccaggcatcacatcccacgacctgccccctgccggccagctggcgttctccaggctgggggctctctgtgttctgcttgataactgcctggtaattagctccacgattttgctactatgcttataatagcctccattaaagttatggggttttcaagccataatggcttccagagtaattaatgcacaactgggtttattgctgagtttatttttagaggttttctccctctctccccctcccttttctctcatagatgttttgaccaaaaagactggatgggagcagaaggcaccccacggcacccttgcccacaggccccatcctcccctctcttcccttcccgcccctccttcctgcttcagcctccaagcaggtgctagggccctgcagtgggggcagccattgcagaggagggtggctgtggtccaggccagaggaagcatttggcctgtgtgtgccccttacccaccctgcgcctggcccaggttcgagaggcttggaggcctgggacctcttatcctatgcccccgatgacagcatagagccagatggcctggactcaattccagctccaccatttcctaatggttgacctcaggcaagttactccccttctctggcctcgatgaacccacagggaccacagccatgcctactgcacagggctgctgtgacgttgcaggagcaggtgcatgtgaagagctgagcctcatcttcggacatctctcatgctatagggaagtttgtataaacaacagtgcaagcgggggctgagaggctgccccaaaggaaaggcagtggcccacagggactgagctggcaggacactcatcttctctccttggctttctccatcctggtattagaacctgcaccaacaccaggagcacttgagaaagctccttcgagagtctctgagaacacagaagaaatcttcctggacatttctgaagccccagccaggcccagcctccccatccttcatcagatgtggcctaagatccaaacgtgtcttggccaaagaaccaaaacgtgtcttgacacgcagccccatgcagccccagcagtggcctgggtgtggagggacaggctaaatctgggggatgtggcatgaagtcacttgcatctcagaccacaagacccagcaggcatcccgtgtggggttctaggctctgtccctcactgggccagcaaagaggagtttacgggcggacacagacacacacggcctagaatgtccactaggggaactacgtgcctgtgacgttgaaccccagtgggtcttccactccccggggaatgggtgggggagactctctggatggagtgggcctctgatggcggggtgtgggcaggggatgccggccgtcctgggaaaccacagtgctccttaatggaggggatgccggccgtcccgggaaaccacagtgctccttaatggaagacaaatcctggtcttccacaggcgtcagaactatttggagagaggacccggtgaggagaggaaaacacgctattttggaaactcaggggctaaaaaccctcctcggccatagcactcgactctgcctgaaatggtgagcacacgtgagctggggcaggagcaggcagcatggcccccaggtgaggtactgtccgtatccaacactgggcactgggacgggtgggcacagtgaggctggctgggctgcccgaggctgcctgccctccccaccacccccacgggtccctgctgcatcatgcatggtgctcagcacagaagtgaaaagggaggagaagaggatgtgacagtttccaaggcggtcaggaggtctcttcgcccagtgtccttgccatgtgagagaacggttcccagagatgctaccagtggaccctctgcaggactgaggaatcccagtggctcattctcctcacttgggccccctgctgttctcattttggaggactgtctcccctcaatgtggcagcccctgcggggacccctcttcttgctgctgcccagcccagcacctggtgctctgtcctgcacagagcggtgctccacaaggatgtcctattgacacggaagaggaaggcactctcgtacttccccccagggaccatcccagaaacatctcttctttgtcctcaaaagactgtcaccaaaatgcaaattgaaaccacagtgagatactatctcacaccagtcagaatggctattactaaaaagccaaaaaatattagatgctgatgaggctgcagagaaaaggcaacacgtatactctgttggtgggaatgtaaattagttcagccactatggaaagcaatttggagatctctcaagaacttaaaacagagctgccattctagccagcagtcccattactgggtatgtatccaaaggaaaataaagtgtttcacaaaaaaaacacctgcacctgtatgttcatcgcagcactattcccaatagcaaaggcatggaatcaatctaggtgcccatcagtggtgaactgggtaaagaaaacatggtgcatatacagcaaggaatactacacagccataaaaaaggacaaaatcatggcctttgcagcagcctggatgcagctggaggccattatcctgagcaaattgacacaggaacagaaaaccaaacacgatgcattctcacttatgagtgagagctaaacactgggtactcatgactgtaaacatgagaagaatacacactgaggactctcaaaggaagaacggctgaaaaacgccctgttgggtactatgctcatacctgggcagcgggattcatcatactccagatctcagcatcacatgcaatatgacccataacaaacctgcacatgtgcccccaaatctaaaatgttgaaattatttttaatataataattcgtggtccatatatggttaaaaaaaagaaaaaagagagagagaaaataaaacctctcacccctttatccaggctttgataagtagctggcattttagggctgcacgggagttaccctgtttaattctgagaatgaccttatgaggtagggatccacagtgccccattttatagatgggaaaactgtggcatggagaacggaaatgacttggcaaaggtcttacagcctgtgggtggcacagttgggatttaaacctggtgtctctgcagtctgtgcttctgacccctgcaccctactgactttcataaatggagcagagccatggccctgtgcctgtgggaaggacagagcccattccactctaacaggcagacaaaagaggtcctcaggtgatggacagttgaggctccattgtggaacccccgatgctgtgtgtcccagagcagggcccagccttgctggcatccattcctatacctgggtctctggctatccgcttctgctctctcttgcaggtgtccaccccccagggttcctgacccctgcccctggacagcgaccccttctcagactccagttgggccggactctccaaacctgcttccgcaatgggtgggttgtgagtgctggtaagacctgctagccaacattcagctgctctgtcctctccatgcctggccggcccggcccatgcctgttcttttctcccctgtgctgccgccgcccgtggccgcccctctcctgaacttaccgccactcaggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataagggtgagcacgcacgcatgccctgcctgcccagctgggccttggtagtgacagtgaccacagctgacacgcagggttcttgcttgcactcacttagcagctaggaggaaccacgggatcatctaggccccttcatgagtcttgcacccctttgggaatgggaagctaatggaagctacccacacagttttaagatgcctgggatggtaggttggcagacaccaagacagttgccttgaaagaagagcttgttactctcagcacccaagaggagggggcacgccctgccccctggggaagtgctgaggtcggaggtgggaagtgaagggagggggaggtgggaagtggagggagtgggagtctttagtgtggttttggtaggaaggaaagtggttttcataggaagggaagggcgaagcactgtcggcagctgagctggcccagaattgcatagtctgaagaaagtcagtgggtttaggatatgggtgtggtttctaattgtctggtatcgccctggggtggtttagggcagcggaagattggcttgggtgggagagctccataaaggtggtagtgggtatgagctctagatcaggtagtttgcatatgaaaagtgtgtttgcaggcaaggtgtgtactgtcactaggaattagctagtcccgggaggggcagtccctccccatatctgcaagtcccccaagatgtcgacgcatcttaaaatacagaaaaacttaaaaaacaaacatcattaatacacacacatacacagaaagacacgcatgtacaacttcacatgccatttcatgacatgcaaggaaagcgaccattctgaagtggatggtgggggaggaataggatttctggcctgcagtgtgttttaaaccctttcacagagagtatattgtttgcctctcttcttttcctgtgtaggaaaccctgatctagtgctacctggtggaaatagggctggagagaggaaaagtcccgtgaagaactagtggaagaactaggggtagaactcctttcccctggctctgggtcctgggtcgcctttccctctcactcccaaacctgccacgcaccccacagctggctgccccagctcttcagcactttgtctcgtgcttttctgccccctcccccacttacatgcacaggctcacgtggggtcaggcagctgttcgtttgcagcgtgcatgataccacctggcagtgtgataaacaagaaggcagcaccaagcccatgcagagagaggtggtgagtgcctgtaaccccaagatgcaggcagtgtccaaaaatcacagcctgaagtcgtgctgctcctcacagtcaaataccaagtcctgcaaacccatagctgttcctgaagcttccatgaggaagggccaagctcaacattgcggcagcccactgcccgtggctggcacttggcgcctgtcttcctgacatcatcctctcctcccgaccctagggcctcttctctgtgcttgtcagttcagaatcattgttatcttgcaaatacatcactccagaggggttaaaactactatatataaagcgacatgatatcgtgtcgattgcgttcttggcagagctccagcgctggagacgtcaggctgtttgctaagcactgatggtgctgcctgaggctggggacttggcattctgtctccccagagcatgccaagagcaagcgaatgaaagctgcagctgagtgaagttagggtcaccaggaggcctttaggacccaaaattgcagacgccctgaagccaatgggaagggcgaagcccaggagcacacgcagtagccgtgccctaatgtatggggactgtccaagggcacaggtcctctgcggccttgggatgatttgggtggcagagaggtggacaaagtggctccaaacttcctctcaaggcctcagtttccaaaacttgactgcccataggatgaattaagtcctctgtctaggtcagaaccctagacacccatcccgctttcttccacgttgctcttctcacagtttgaccccagactcctctaagcagccccctctgagcgactgcgtgtgtgctggtttcctcccccgaccctcagcaattgctgtgtgcctggtgccatttgcccatgagaactcctgaagagccacgagcaggcctcctgggtccgttcagatgagctccacgctagcgtgccacacaccccacatgctgccgatgacagtggccggagggaggcagcagaagagctgatgcccggggtcctcccctttggtgtgacttgctggttctgtccccaccgattgcctgaagccagaaggaagcagagttggccactgcccttccgcaagagaggaaactgtgcctggcggtgctctcagcccttgtggactcattaatccacataataactcgataagttcgatgctattattagctccattttacagttgctgaaattgaggcgccagaagctaagcagcttgctcaagggcacagggttcgtaacggcagaagtgggcagggtctcagcccaggcaccgggatttcttacctttaccacccgacggtaagctaggacaggagggccacaccgtcattggtgcatgagcccttccgatggaaggacagaatttggagagaagggacgcatggaaaacaagaatcccaatggccctgatttctcctcttgctaggactgctagatctacatataccttggcaactatgggcaaaacccacgagaataaaatgcggtgaaataggaagttctgcaccgagattcagagaatgccttacgtaaggccaggagggaagaggccccgcttgactggagggcttgagaactccgggagctgcctcaggctcctgcgggcccacagtgggccctggttgctgccgcagtgctgcggccctggggctttgtggcgtccacaccacagcggggcagtgccacgtgctctgctagcccagccctgcacagggcagtgtggccagctccctccagatgagtagggctagggaggggagggtcgggacgccttttcataggaaagtcagcacattcaggaactgaggatgcaatcttggaatatgggcaactgcgctcaaatagctagagggctgcaaaggtgggaaggaagaggttatgtctgtgtcatcagagctaggaccctcccagagaggattccagggctgcagatttcaaccttagagctaacaggtcaggcaaggcgggggtctgagcagcccctgcagcgggggaggaggagggtgccctggcagggtgggtggcgtcccgctctgaatccagggccgtagccggcgctctcctcccacatcgccggtctcccgactccgcagatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagaggtgagggagggcccgacagtgagcagcgggacctccggctgcggggagtggaggggcttcccgagaagggggtgtgggtgcggaggcgcgcgcagggggaacccgggaagccgggctgggagcggggcaggcagcagagagccagggaaagggatggaactgcgggctaaagcatcccccacaagttagggggaagacaggtggctctggagcccctaaaccatattcctggccctagaggtatctcctgaatgggtttgtgagtaggtcattctgcgtgactaccagaaacctcttaggtggaacagttggagctcgcctgagtatatgggctgtgttagtctcggggacaaggggagtcacttcacactctagagcggggagactgaaaggttttagacaagggagaaaacagcagcagggccacgctgagaaggggaagaccaggccgtctgagaggtcaggtgtccccggcagcccagggcaggttcttctcaggtgcccaacccatgggatgggtcctgggggcagggctgtactggacaccccctaggtggccgcggctggccatgggcatagatagaggtggctgaaggatgtcgcctcccttgggcacgcgcggccgtcctcatctgcagtgccggcgccctgactctggaccccccccttgtagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaaggtgagaccctccgcagaactgacagctgtgatgcaatgtctcaagtacatccagaccctccctacagatcgggagaaggaaacagaggcctcaaaatagcctgggctttctggaaccccctcccaggaaggcagtgtatcacctgtaaggcagcgacactgcggacaggcagggaaagggagagcaatggccactggggagttataacctcccacagaacagccgtgctccagcacctccctgctgagcactcatgcacacacacatgcctacgcgtgcacacatgtgcgcacacacacatgcagatgcacacacatgcacacatatatgcaggtgaacatgcacagacatgcacatatacacatatgcacatgaacatgcatacgtatgcacacacacacacttgggaagtcttggggcttctcttttctgtagttctagacttcccatttccagcaggtattccgaaggcatcacatgtaaaaacagcaaaaatgagggggtagtcgagagccacagaaaataaataaaaaacaattgagaaaatcttgatggaacaattgaaaaactctcgaaggaaaaggaggggcaggagaaatgtttacacagtgtgggagggagcagggaggcagcagagtgaggtcaggggcctgtcccaccatgttttgcatctctgggcacacagatcctggtgtggcacacacggacagagaagccagtgctggtgaatgagggcaagaagggcttcactgacccctcggtggagatctgagcctcaggatgcaggtatgggcatgacgagggtgggccacacactgggcagggcggcaccaggttgggccgaatcaactgtctcattcttttcctcttgggctttcactgtggaggacagggcagatgtgggcaggagtggagggcgtcgtcaccacagtccccttcccactgggccacctgaaagtatccaggcattaactttcacccacgcagctgggtccttctgccaccagactcttcagagggtgtcaccttccaaacatcttgctgatttttctgctggcagtgacgcctgcaccccacaaggcactgccattcagactctcgctggccagcgtctgtccccccaagtctgcctcttcccctgtggattccttcaccacgtggccatggtgaggactcacggactcgctgctccacagcaatgagcccacggctgtcatagtgagaggtagcgcagagtgacagcacggacccagagcccacctcagctcccaggacccctgctcttcactgtttgacctgacttgacttttctgggcctcagtttcttcatctgtgaagtaggttgctgagagcacctagaacagttcatggcacttaaatctcatcagtgtggctatttttattcaagtctttaaagccctctctggaagtaggccacaggatccacctacacttcagaagcaaagaaatgatgttgagagaagctaaatgaatgttccaaggtgacacactggcacgagtgaattgtgctgggtggttggcaaagccaggcattttcaggggcttttctgtgatcttatcctgtctcttaaaagcagctggtactcctgactccctactctaggttatgccaaacagaggttgaggcctgagacagacatttgtcctcttgccctggagctaagcaatagcttctgtattgtgtttgcccgcagaggaccacagggtgtcactcagtcaccttggccagcgccacttagaatgcatctgtaccgagcctcacttctgcctcctgccctcactgccctcactggaagcaccttccccacctgcccctcagaaaggcccccacaggacctgggggcctgggctttgcagaggtcctggtggccctgcctggccattccctccccggccccaccctcagccgacacctcactcattcctcctctcccctcacaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtc

SEQ ID NO: 38542 - DNA, 22825 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccatcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctcctcgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccggtaagagagccccgggcggcactggatcgggccccggagggtgtggggccttgaggaagccagatcccaggcctcgggggtggctttttcgcaattgtcgcacgttgtgaggcgcaggattggcgctgggtctcgggctcggggcgaggaactacggttcgggccgaggtgagggggcggtggcgctgtgccggctgtgacgtcacctcgcccgcggtggggcgggtggagcctttcgtaggctcgcgactgcgtcaggggagggccgtgtggtcatgtgaccaggggctccgctctacgatcctggggttgcttcctttcccagagttggggttttgcttttctgtcacctcggcttccgtcgttttttgtccctgtaccctcttgcgttgctcctcgcattgcctgttggagcgcagcagaggtgtgtggctacgggaacgttacttaaaatggatctttttgatcatgcgttccacagatcttgagcatctactgtatgtcagacactaaaacgctaggaagtataaagaaagttttaaaatggggccaggcgcggtagtttacgcctgtaatcccaacactttgggagaccgacgtgggcggatcaccttaggtcaggagttcgagaccagcctggccaacatggtgaaaccccgtctctactaaaaatacaaaaattaaccggacgtggtatcgggtgcctgtaatcccagctatttgggaggctgaggcaggagaagcgcatgaacccgggaggcggaggttgcagtgacccgagatcgcgccactgcactgcaccctgggcgacaaagcgagactgtgtctccgaaacaacaaaaaaaggaaagtttaaaaatggtcacggggtaaacgtttactaaagggatttccgtcttaattggtgagactgagggcgctctaccaaatttctttagactggcgttctgcaaactttacccggaataaatcatctgacgtactttttaaaagatgctaaatctcaagccctccgtgcgccctcctcacagtttaatttgatagggcccaggaatcttcattttaacgggtagcctcgtctgtgggtttttttgtttgttttttgtttttttgagacggagtcttgctttgtcgcccatgttggagggcagtggcacgttctcggctcactgcaacctcctcctcccggattcaggctgttctcttgcctcagcctcccgagtagctgggactagaggtgtgcgtcacgacacccggctaatttttgtatttctagtagagacggagtttcaccatgttggcctgggtggtcttgaacgactgacctcaagtgatacaccacgcccggcgcgctcccggcccctcgcccgtgttcttaatgggagaggtgttgatttgatgtttcactgactgttgaaccccaaaccacccaggttgtctcctcaggcattcattccacaagtatttatcaaagacacattagactgttcttggcctgattagacttactgactatagtgaggcagttctggtctaggagtatagctgtgaataaaaacatcgtcctgccctggagctcaattttagaaacaagaaaagttaaaaagataatttcagatagttctgtaaagacaattagcagtggatggcctggtgcagaggctcacgcctgtaatcccagtactttgggaggccgaggcgggaggatcacttgagcttgggagttcaagaccagcctgaccaacatggtgaaaccccatctttactaaaagtagaaaaattagttgggtgtcatggtgcacacctgtaatcccagatactcgggaggctgaggcaggagaatcatttgaatctgggaggcagaggctgcaggaggctgcagtgagcagaaatcccactactacactctaatgtgggtgacccagcaagattccgtctaaaaaaaaggaaaaaaacaattagcagtggagagtggggaagtaacttttggttgggtggtcaggataagtctgaggagaaaccatctaagctaacaccagaattgcaagaagtcactggagagaacatgtgcaggaagaaccttctaggcagttgtaactgcaggcacaatggtccttctctagagattatttaagagactagtgtagttggagctcagaaaaccaaggagagggaagcaggggccacgcaacacggggccttgtagaccatggtgaaggctttagatggtccagtaactacacaaagaaacaaatccgactcctgtttcatgatcctgattctgttcctacgaccttaattcagttatttttctatttctaaatgactcctaatccttcctctttatctttgtcttactatcattttcagtatattgttaaaatacagtcaactatttcttttcagaagtggacaaggataatttttcagtgttcaacaaataagtcacagccaggactcttgtaggaagatacttctttgtccctggaattcccacagttgtgaaggaaacagatgactgacaggcttgtcttaaacacagatgccaaggtctgtgtgtgccttcctagaagacacactgttaagggacattaaagtatgcgggtggtaccctgcattgtataaaaatcatgtttgcagaccacgcgcggtggctcacacctgtaatcccagcacttcaggaggccgaggagggcagatcacttgaggtcaggagttcgagaccagcctgggcaacatggtgaaaccatgtctctactaaagatacaaaaattagccaggcgtggtggtgcacgcctgcagtcctagctacctgggaggctgaggcaggagaatcacttgaaccaggcaggggaggttgcagtgagccgaggttgcaccactgcactccagcccgggcgacagagtgagactctatctcaaatgaaaaaaataaataaatatcatgtttgcttgcttttttgttctgtatttgaagagagagagagagatgctcactggtgtccccaaataaagtagcagacgtgagatcagctgtcaccattggctcacaacttctgccaaaggaaaatgataaaagagctcagaatcttccttccttattcctgcagccgctaggtcattcttctggagattatatcccttgcctattgataagggaggcacaccagatttggggctcaggaccttatagacaattaaggaatctcaccctcaggcatgggcaggagaagtgagggaggaaagagctctttgttcacaggcggtgcattaaaggactaagagacagcaatccactgcaccactagctcttagcatgtcctgtggagtcacagatccagctgtttattcggtatctccatttggactctcatctttatcttaatattaacagattcagaacagaattacagaattcttgagctttctcctgcctctctcgcagtcttggccgtctcagctaatagtaactttgtcttttagttccctggtaaaaaccttggtttcatctttggttcttttcttgatctaacaccccacatgtaatccatctggaaaccccgtgagttccctcttaaaagtgtatccagaacctgacctcttcccctgcctcactaacctccaacctctgccctcgcctccttacactgcgttctcagtacagtagcgagattgatcctggtagaaaagctaaacaagagcatgtcctgcctgtgctcagcaccttgcagagtgaaaacagcagtgatccccgcagtgcctttcaaggccctccatgatgactgacctcacctccttctctatgcctccttcctgtctctgctgtcccctgactggaggccacccttccctgttcctcgaaggccccaagcaggctcttgcctcaggacttttgcacatgctgttccttctgcctggaaagctcttccaccacatgactccttctcctacaaggattgcccccaagtcatgttctctatgatgcctactctctccagcactcccacgctcaactcagcctgccaaaattattccattttctccggcactcctcacttttaacatagtttgtgatttccctgttgtttctctctccccactagaatggatgtgccatactggaacagatgtttgtctttttggccaaagacatatgtatccccagtgcctagaaaagggcctggcatgcacagatcctcagtaaggggttacatgaatcagtaaatgaatgaatgatttatatatcatcaccatcaaaacatcaaaatactctagccagaaaaggagagatagcactaatttttaaactctaaaacatttaaatatacattaaggagaaaataattaaatgctcatgctaaaacactgcaaaatagctgaaaaagtgtaaacatttaggtgttggacctacaaatcaaaatcccagctaaatatgatgccgatggccaggcgcagtagctcacgcctgtaatcccagcactttggcaggttgaggcgggtggattgcttgagcctaagagttcaagaccaacgtgggcaatctagtgagaccctgtctctatttttcatatgtgtatgtgtatgtgtaaataaagacagacaagtattgtatttggttaatactttgttgtgctgtttttgttttgtaaaagtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggtaacagtgttaaaaatgatgagccttgaacagagtgctacccccttgggtttttctttcttctattccttactccaaaagagatgtaaggtagctgctaaactactagtgaagtgatgagggctatatacaactgcagtggaaaaaaacctaatttttaattgaccttttcatcttaaaagaatgcttaaaaatcaataagatggaaaaagtaaatatagtagaaaaaacagtacaaattaaaataacgagcagtatttttcgcagtatttttttaaacctatcaaattatcaaggatgaaaagacaacaacacccagatgtattggcaaacttgtaaggaaagagactctgtctttcatgtgtatttatctctttaattgcttattgttttaaaatgttttcagactatcagaaaagttgcaaatttagttcaaataattttcttattccaatatacccgtctctccttcacttttatttatttattttttatttatttttgagacagagtcttgctctgtcatccatgctggagtgcagtggcacaaactcagcttactgcaacctctgcctcccaggttctagcgattctagtgcctcagcctgctgagtagctgcgactacaggcacgcaccaccacactggctaatttttgtattttcagtagagacgaggttttgccatgttggccaggttggtgtcaaactcctgacctcaggtgatctgctcactttggcctcccaaagtgctgggattacaggtgtgagccaccatgcctggcctcctttgcttttaaataaatatactttttgacctagcaattctacttacagaaatttatgatgagaaaataataaaaaataggaggtatgtataaatattgataaatatttagttatataaatgaagatgcattgtagcattgttttaaaaacaaaacacgttcacataaagacgtgtgtactaatgttcacagcaacattattcataaaagccacaaactggaaacaacccaaatgtccatcagcaggtaaacagatgaacagattgtgatgtttccatacagtggatatactcagcagtaaaaaggaatgaagtattcatagatgctaacatatggatggatatcaaaataattgtgctgagtaaaagccagaccaaaaaaatgagtacacacttatgttaacattcatataaacctctagaaaatgcaaacaaatctgtaatgacagaaagcagatcagcgtttgccttaggactaaggcttgggaggtagagacatgggaaccaagaagagtggaaggaagtgggcggtgataagaaagggacacaagactggactcagtggctcctgcctggaatcccagcactttggaaggccaaggcaggcagatcatttgggttaggagaccagcctggccaacatggtgaaaccccttccctactaaaaatacaaaaatcagctaggcatggtggtgcacacctgtaatcccaactccttgggaggctgaggcaggagtatcacttgaaactgggagacaaaggttgcagtgagctaagattgcgcgtttgcactcctgcttgggcaatagagcaagactctgtctccaaaaaaaaaaagagacacgagaaaatctgggaggcagtgctggtggatattgtcactgtcttgattgtggtagtggttttgtgtgtatattcataagtcaaaatgtatcaaattgtatactttaaaaatatacagtttaatggatgataattatacttcaataaagttaatttttaaaaaatcaaaaagttaaaagtgataaatgaggaataaattgtgagagaaggttgtggactaagacatgaatcagaaagaatgtccattggttaacaggagaagagattggagatgggttgtcagtaaagtactgagaatgtgctaatagtctgttctaaccaatcctaaaatgtgttttaaacgggatagaaccaaacctataaccacagttactaaataatttgttttctcttttaggaaaagcgtgcaagtatcagtgatgctgccctgttagacatcatttgtaagtgtcagtgatttgtatttatacttaaccaatcagtttattagaggcaattttgtttctttctttgtgagacagggtctccctctgtcgcccaggctggagtgcagtaacgccatctcagctcaccgcgacctctgcctcctggattcaagtgattctccaacctcagcctcccgagtagctgggactatagcagtgcaccaccatgtatggctaattttttgtattttttgccacaaggttttgccgtgttgcccaggctggtctccagctcctgggctaaagtgttcctcctaccaaagtgctgggattataggtgtgaaccgctgtacttgtcccagaagcaattttgtatataacgcctcagagtctagagttcaggagaccttgtttcaaatcccagtatgtcactcagccgtatgttctttgacaagttgcatcacctttctgagcctcagacttcaagcagagataatagtacattatctacttcacggtattcttgttaggattaaatgaggtagtgcccgagaagctgttagcatggtaactggcacatcagaaacacaaagtaaatgtttggctttgtattactcaggttgccaacttacaacagctcaacttaaaaattttcaactagtatgaaagcagcagacattcaacagaaaccatactttgagttcctatacaaccattcttttctcactttcagtacagcatttagtaagttacatgaggtatgcaacagtttatgatagaagactctgttggatgattttgctcaactgtaggctaatgtaagtgctctgagcacacataaggtaggctgggctaagctaagatatatgaaggttaggtgaattattttcacctcaaggtggatttatcaggcatagccccatcataagtcaagaagcatctgtattattattaaaggatttgaaaatatctttctgaaaatttgttcctattacagtgtagcttctcacctctcctcccttccatttcattgatttttgtctagctttcctgtctgtactttttcaagatgtctgttttttttatcagaaggcagcataatataggggctgagaacacaggccctggggccagacctcttgggttcatttcatggctccgttactgcctccctgtgagccctggaggaagttggttaacatctctgtggcataccgacatctctggtattatcatttgaccaatctgtataatagtgataatatcacataaggttatggtgaggattaaataagagtacatgttaaatacttaaagcctggtattaactaattgcaatcattatgtattagctgttttctgtaagtgtaacaaaaattatctttattaatactttgctccaactcatggcatgctccaattcagctattgctgaatttggagcatctgcctctgatttagtttgtctcattttcagtggttggattctctcaagcataaaaggtggatccacaccattcccatttctcatacattgattcaaaaattcattaagcacctggctggacgcagtggctcacacctgtaatcccagcactttgggagaccaaggcaggtggatcacctgaggtcaggagttggagaccagcctggccactatggtgaaaccccatctctactaaaaatacaaaaaattagccgggcatgatggcaggtacctgtaatctgctattcgggaggctgaggcaggagaatcatttgaacccaggagacagagattgcagtcagccaagatcacaccactgcactccagcctggcgacaccgtgagactctgtctcaaaaaaaaaaaggaaaaagaaaagaaaacctggtctgaagtccagaggcacagacagaggtcagtgcagagacaattttaagccagaaggatgaagggatatggttgaacttgctaacttcctaggtccatttctactccaagacactccaagtttgtaactcctgaaaggtgttttctgtcatatacttattcattcattcgttcatcaaacatatactgaagcctggtgtggtggtgtgggacacttgggaggctgaggcaggaggattgcttgagcccgcgagttcaagtctagcccagttaacatagtgagaccctgtctcttagaaaaacaaaacaaatattgagtgcttgctttatgccacgcagttaagtttagacctgggactacaacagtgaacaggtccctcatttccatcagagtctaactggaaagacaggcagtgtacaaatgaacatctaaataaataatgtggctgggcacgatggctcacgcctgtaatcccagcactttgggaggccaaggtaggtggatcacccgaggtcaggagttcgacactaacctggccaacatggtgaaacctcatgtctactaaaaatacaaaaaattagccaggcgttgtggcaggcatgtgtaattccagtactcgggaggctgaagcaggagaatcggttgaacccgggaggcacaggttgcagtgagctgagattgcactattgcactccagcctgggcaacaagggtgaaactccatctcaaaaaataataataataaatacacacatacatacatacatacataatgtgacatcaggtagtgatgagtcctccgacaggaactgggaactaacgcagggtgtttggggtagggtgatccgggcggggactactctgagtagagagcagaatgaggtggggagtagggtgtgtaaggagctaggagaagaggctccaggcagaggaacagctggctcaaatgtgggtcctgtggggcacagcattccctgtcgtgccagattaatgtggcattctgtggaatggaataaatggaatgtggaaatggaataaatgggctaacatagaataaataccaaaactcaactgtattatctaagtcagttgaattaagtaattatgatttgctttatttatatgaagtactttaatccatataaagtttatattttgaatacaaatctgtataactcaatttgtgaattactgttactttccccagttttaaagtatagaaatatctataagcatattacttcaaagttctatgatatgctagtaataaagctttcttccctctctcagatatgcaatttcatcagcaccagaaagtttgggaagtttttcagatgagtaaaggaccaggtaatattttctgtttacaattgaatatttgatagtttggcttggactcaggaagcagaggttacagcgagctgagattgcaccactgcactccagcctgggtaacagagcaagactctatatccaaaaaaaaaaaatagcagtatgttcctcatttctttcaaaatgaggtgattatttattactcacttttggaaaatgagaaacatacttcttggtgccatgtcagaagtactagcaccatttgtgtgatttgatcattattactctggaattatacaaaatgcttagtttcatggtactttacgaatgtatttactgaagacattgtagctcccttgatttttctttatttttttttcactttggcaggtgaagatgttgacctttttgatatgaaacaatttaaaaattcgttcaagaaaattcttcagagagcattaaaaaatgtaagaataaaattcatcttttacataaaattcaatgtcatgacgtctgtgcacttaaaatttgctactatcatagtttttttttaatttgtaagaaattcagttagtaatagttcatacggttctactccatatcagaaacacactgtaaatattatgaaaacttccctttcctctctcctgtccattcagggcctgaggcttctttttccagaggagctcagtccaacagagctttctgcagtgatggaaatgctctgtattggcactgttcagttcagccacatgtagctgctgagcacttgcggctagtgtgactgagcagctgaatttttaatctttttttttttttctttccttgagacagagtcttactctgttgcccaggctggagtgcagtggcgagatctcggctcactgcaactgcctcctgggttcaagcaattcttctgcctctgcctcccgagtagctgggactacaagcacgcaccaccatgcccagctaatttttgtatttttagtagtgatggggtttctccatgttgaccaggctggtctcgaactcctaacctcagatgatctgcctgcctcggcctcccaaagtgctgggattacaggtgtgagccaccgcacccagcctgaatttttaatctttttaaacttcaatgattttttacattaaatagccacatgtagctagtagttccagtaatagtcagtgcaaacctgaagcacccttgattttacagatgtttttgcttttttaatgtaaaacaaagaagctattcagaataagacaatcttccattcaaggcagtagaggcccactgagcatgtgactgggtccaagctctatgatgctcactcaggaaagtcagacagctgtgtgccgccataccctggactggggagactttcttgtctcctgcactgagggaatttggaaaagctgctaaagaatgagcagaatttgctagtgccactgtaacaacccacttttcctagaacaagatctcagagggaggaaacagagacgtgggcaagctgagtgcatctcactcaagtccctcctttctaggctcagagctttaaagggaagctgaatcagaggggagctgataatccaggagcagcctattaaattccagaccaattggcaaccatatttaaaagtttggaaaggcctgtattttatccatgaagtggattcaaggtagtacctctggtcttgccatgtaacattcttttagaggagtttttagcttctgagctaaatgcataagagcattaggaatagtatattttcaagcccattattacatagaaatcttctttaagcccattatgacatagaaatcttctttttcttcttctttttgttttgtttttgtttttttttggaaacgtggtctcactctgttgcccaggctggaatgcactgacatgatctcggctcactatagtctagacctcccaggctcaagccatcctcccacctcagcctcttgagtagctgggactataggcacatgtcaccgtgcctggcttttttttttttttccggtagatactgagtttcactatgttgtccaggttggtctcaaaactcctgggctcaagcgatcctcctacctcagcctcccaaagtgctaggattacaggcataagccacaacacccagcctaattacatagaaatcttactgttaaagtttatagcgtgtgctaggtctgggttagatgctaagaaggcttcattataaaacaagtatctcatttgtaaggctgccttacctcataaattcttacgtaaggaggaacagttttcaggacaagcccaagaaattattgaaaaaacaatcacctctacaaaaaaaaacttttttaaaaaaattagccaggcatgatggcacgtgcctgtggtctcagctactagggaggctgagatgggattgcttgagcccaggaagttgaggctgccgtgagcaggctatgatcatgccacagcactccagcctgagcaactgagcaagacctagtctcaaaaaaaaaaaaagaactgaaaaggattttttttttttaaaatcacaaaatgttttcccaaagattctcaaaatactcatgaaaagcagaaaagactgccaggtctcaacctgcatacaagagtatagggacatcattgttcacccctaataagcacctggagttggtgccacagtgaaattttaattaggaaattaagccttttttttttttctttaataaggtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggtatggaaaaaattattacaagctataatattttattatcctatctcaaaggtctatatagattttaactgttgaataagtatttgatagagaatactaggccaggtgcagtggcatgtacctgtggtcccagctacttgggaggctgaagtgggaggattgctcgtgcccacgagtccaaggctgccgtgagctgcgatcacaagacaaagcaacaccccacctctaaaaaaacaaaaaaaagatatagaataccacatgtaattcttgttctcctaaaataagaaacagagtgttgttatctgcagatgggaacatggcataagatattagattggagctatattttattgttttttgatctagaaataatgcatacttaatataaaaaaatgcaaccgatacagaagtctctaaagataaaaagtcttcaaagcttcataccccttttccctattccgttcgttcaaaataactactgtcaaagtttgctatttcctttgacaagatggttattagaaaagccagggtaggccaggcgcggtgctcatgtctgtaatcccaatactttgggaggccgaggcaggtggatcacctgaagtcaggagtttgagaccagcctggccaacatggtaaaaccctgtctctactaaaaatacaaaaaaattagccaggcgtggtggtgggcacctgtaatcccagttacttgggaggctgaggcaggagaattgcttgaacccgggaggcagaggttgcagtgagcccatatcgcaccattgcactccagcctgggcaacgagaaagaaactccgtcttaaaaaaaaaaaaaaattaacataacatttccacgtggttacaaatgaatatacctcattactttttcataattgtataatttgcttattaatgaacattattttcatttgtaaccatttctcccacattccatacacaaggagactgctttcacataagatgtagcctctgttccgagcctgcttctctttatggttctgcctttaatatcacaggcttcctagcatctttccccaaagttagttctccctaaattggcctggcacttgctgctaccactgttagcattcacaacctcagtggcaccttcaattggttccagagctgccacatcagctggttgtaggcgagcagctccaccatcctggctgcatcatgtcctgtcactccacagcagagtggggtggaggtgcggtgtggagtaccaaggactccactgttgtgaccaggcgagccctaggtagtaaatgactacttgcttgtcatttaagttttttggtggtttattgaaatggcaaagactgctactcacttctatttccttaaaacacttctttacatttggggtctcctgctccatgatacatagtggtctttcatccacttatagccaggtgagtacaccttgccacaggtagtttaaacattaccccaaaggctaatgttctttttttttttttgagacagggtctcactctgtcacccagggtggggtgcagtggggcgatcttggctcactgcaccctccacccccaaggttcaagcgattctcctgcctcagcctcccaagtagctgggactacaagcactcaccactatgcctggctaacttatttttctatttttagtggaggtggggtttcaccatgttgcccaggctggtctcaaactcccgacttcaagtgatccacctgccttggcctgccaaagcgctgggattacagccgtgagccactgcgcggactaatgttcatttctattgtgtatcttaaggcaaacttgtctgttctctagatcaggttaaacatcttatcctatcatagtaattctgtttcagtcttcttttcccctaatgacaggaaactcttatgagctgtattcaatacacacttatttcttcagtatttgccaaaaagcatacatatctgcgtttttgtatggcaatatcattatggtattagatgactgatattcaaaaacagtaacattttgagtatttattgtttattccaaagtctgaacttgatttattagtaactcctaactttaaacaggatcgcttttctaagaaatgatacaaaagactgcatttatcagagtattaatgccattaaccactttgtttttgaagctcagtaacaggctatcagatgtttttctagacttctttttacacttacggggaaactattccctaattgcagctcttacattttactttgacaagtattataaacacagaggcagtaatcctagtaatagtcttgcaaattttcatttcaaggcgctgacaattgctagcaaacaccatcagattgtgaaaatggacctgagaagtcggtatctggactctcttaaggctattgtttttaaacagtataatcaggtgagccaatcagtgactctctttaaaggtaaatctttattttctctttgacacaggagttagaagctactgggaaaatctacctccgacaagaggagatcattttagatattaccgaaatgaagaaagcttgcaattagtgaacatgaaaggaaaataaaaattcctcacagtcatctttttataattgtattgtgttttataccactcattagtcactggagtctgtgttgtagatctcagcttccaaatcacctgatcacactagaatttgttttctctttagagaaacttcacattatcttttgaagctaaatatattattctatgaaacaacagagaagtagaattaactttttgtcccatcactcaagcaggttatacaggcactggaattaaagggaaaagcagtggttttttaaatcccaaagttcatttgttaaaataatttgaatgtaatgttcccctctaatgacaaatacagatctgtccttacagatgcaggggtgttttttcaaactatgcatggcagatgtctgcatatgtgttgacactcctgtgagtggattgttaatgctctgtgtatatctttgagccactagagatgttatacttctgtattttcatctgttctaagcagaaagaagtgacagctctctgcaagcagtccctctttaaggaaaaactaacattaagaagttatatcatgaggccaggcacagtggttcacgcctatgatcccagcactttaggaggccaaggtgggaggaatgcttgagcccaggagtttgagatgagcctgggcagcatagggagaccacatctctacaaaacaaaaaataaataatatatattttttaaacttagatcatgattttcttctctagccatcccctcctacctactaccctctcaccaaattgatataaactgttctgctataatacgacagtagtggccaggcaccatggctcatgcctgtaaccctagctctttgggaggccaagaagggcaaatcccttgagcccaggagttcaagaccagcttgggcaatatggcgaaaacccgtctctacaaaaaatacaacaaataaccaggcatgccgggcgcggtggctcacacctgtaatcccagcactttgggagtccgaggcgggcggatcacaaagtcaggagatcaagaccatccttgctaacacggcgaaaccttgtctctactaaaaatacaaaaaaattagccaggcatggtggcgggtgcctgtagtcccagctacttgggaggctgaggcaggagaatggcatgaaaccgggaggcagagcttgcagtgagtggagatagtgccactgcactccagcctgggcgacagagtgagactctgtctcaaaaaaaaaagtagccaggtgtggtgccgcatgcctatagtcccagctacctgggaggctgagttaggaggatctccaaagcccagggagactgaggctgcagtgagccatgatcatgccactcactccagcccgagcaacagactgagatattgtctaaaaaaaaaaaaaagacagtggcattcttacgaaaatccacgttgtcaagcacagaactataaaaacaatggattcagtgggtgaaggtaggagaaggggttcaagagattcagacttacagtaggaaagttatttttccaatctcagtaagttttttagggttatgaagattgagcactgacgacgctgaaataccacagtgcaaatgcttccgtagattccctgggctctgcactcaccagatccatttctatgataaagcacagagctcctcaaacagaacagtcgagttgcaggctcagcagcctccttgtcagtgtcctgctcaactcagccaactcagccaggatatggctttggatctttctgttggaaaaaaataaacatttgacatactttaatatactaaaaaaaaaattaatatctgtacttcaagatgtcaagattagtaaaatattcacttttttttccctagacctttgaaactcacaactctacgacacctctacaggaaagaagccttggactagatataaatagtacgtgtgtgttaatatgaaactgaattttggaaatgcatcattcccttatagatttctttcacttggtaaaacgtgtatagtaggatcctaatttaaaacttttattgttttcagaaaaattgaaaagtaaatatctgttgaaggaggaaagctaatctaccatagttctcctttagaatttactagaataacaataaacaacaaaacaataattacaaaaacaaaagttagctaatagttgttgagcatttcttgtgtgccaggcaccacactaagatgtttatatgtattctttccttaatcttcacagtagtcctgtgaataagcgccattcatcaggaaactgggtttcagggaggtatggtaactctctaggcaaagtcacacagctaaggagtggcaaaactgggagtaaaatccaggtacgtctggatctggagcccatgctcttaatgcgctggataaacttctagaacaatgagaatcatgactgtattgctactcacagatgtctgaagtctctcactagaaaacccaagagaaaagagtacagaactactaaagtaaatttacaaaagtggtggggtaaaataaaaattcataaaaaaatgaaaactttcctatctcttagtagagatttggcaatgaaatgaaacagtgccactgttataaactaaacacttttatgattttccagtgtcataggaactgctgttgatctcatcttaggtaaagaaatcaggatataaaattgtgtgtatcttacgattccagttttaaaaatacataggtgaggctaggaacaatgttatgcatctgtggtcccggctacttgggaggttgaggagggaagatcacgagcccaagagatccagtccagactgggcaacatagtgagaccctgtctctctttttttttttttttttttttttttttttaagacagagtctcactctatttcctaggctggaatgcagtagcatgatttcagctcactgcaacctctgcttcccaggttcaagcgattctctttcctcagcctcccaactatctgggactacaggcgcctgccaccacacctggctaatttttgtatttttagtagacatgggatttcactatgttggccaggctggtctggaacttctgacctcaagtgatcctcccgcctcagcctcctgaagtgctgggattacaggtgtgagccaccgtgcccagccgagaccccatctcttaaaaaaaatacatatataggctgggtgccatggagatatatatatatatatatgtgtgtgtgtgtgtgtgtgtatatatatgtgtgtgtatatatatatgtatatatatgtgtgtatatatatatgtatatatatatgtgtatatatatgtgtatatatatgtgtgtgtatatatatgtatatatatgtgtgtgtatatatatatacacatatatgcatctttatttttattcactgtaaaaagagctaggcaaaaatatactaaaatgctaacagtgcttatctctgggtggtagaattatgatttttattttctcttttatcaacctgtacttcactaccctaagaaacttccctacactaagaaattattacagccaagagaagaagcagtaaatattattttaaaattatacaaacaattcgaagggttaggaatgaaaggaggataatttaaggatgaaatatattcctaacggctgttttatttgaaatcttccacccatagtggattcaaggatcattcatgaaaacatagtagaaaaagagagagtccaacgaataactcaagaaacatttggagattatcctcaaccacaactagaatttgcacaatataaggtaagatgtcgtaataaatattaagtacaagatatcaacattgtttaaaaagaacaaaaaccttaagtggaaaacagatctaagaaactgttcctttttcacttgtcacttaaatttcatgtaataaatttatgaattaaatagacctctttattgtatttataagttcctctgttagcaaaagagacctttagaaattatgaatctgggctgggcgtgatggctcactgcaacctctgcctcccaggttcaagcaattctcctgcctcagcctcccgagtagctgggattacaggcacctgccacctcacctggctaatttttttttttggagttttagtagagacggggtttcatcgtgttggccagactggtctcgaacggctggcctcaggtgatccaccttgcctcggcctcccaaggtgttgggattacagacgtgagccactgcgcccagccataagttgataattattttacctgggtgatgtgcacatggggctcataccgtgctccttacttttgtatatgtttaaaatcttccataattagaagttaaaaagatatctcagttgggcacagtggctcacacctataatcccagcactttgggaggctgaggcgggcggatcccttgaacccaggagactgagaccagcctgggcgacacagcaaaaccctgtgtctacaaaaattcaaaaatacaaggtgtggtggcatgtggctgtggtcccagctacttgcactgaagcgggagaatggcttgagccagggaggtcgaggctgcaatgagccatgttcgtaccactccaacttgggcaacaaagtaagactctgtctcaaaaaagaaacaaagaaagaaatctcagtgtgactcaaaaaaaatgtggtatttttacattgaagttacagattgcaaaagatagcactaattttccattaagaatgcaaactgtaaagggcacctgagggtggaactgacagtcagtatctcccatgtagcaggcactgtgcatgctggcattttgccttggatgttgtttgatacaccagttgccctctatgttttgttttgtttttttctgagatgcagtttcactctgttgcccaggctggagtgcagtggcaccatcttggctcactgcagcctccgcctcctgggttcaagcaattctcatgccttggcctcctgggtagctggaattacaggtgcccaccaccatacccagctaattattgtatttttagttaagacggggtttcaccatgttggccaggctggtctcaaactcctaacctcaagtgatccactcgccttggcttcccaaagtgctgagattacaggcatgagccactttgcccgacctgccctctatgtttgcagttagcagattaaatggtccccacccctgttaattcctgtatttcttaatggcaagaattaatgaaacgtatcattatgatttcattatattttaccattcgtatttatacaatatgtttaatagtcatttataaatgtttgttgacagcttgaaacgaaattcaaaagtggtttaaatgggagcatcttggctgagagggaagaacccctccgatgcctaataaagttctctagcccacatcttctggaagcattgaaatccttagcaccagcgggtgagtggtcagcttactctataagctagaaaaattaacaacatgcctccattccatccttataatctgctaattacttctgagctcacccatcaccctagtctgctagcccatcctgctctctcttgcatcttctgcttctgtacttaatagggaggaggggcatctatgatccaccctctaatctcagccatttttaaactgactcaaatccatcctcctgtgatgacttttaattttctttttcccttttttttttttttaatttcaggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaactggcacatcagtt

SEQ ID NO: 38543 - DNA, 11617 bp, Homo sapiens
ggcggcgagcggaatgcagcggcccgaggctggccacgtccgcacccgggggagggggccgcggcggcaggccgggggccggcgccgcctgctcgagccggggagccctcggggctgcgggtacggagcgggcgggcgcggggatcccgggcggcgggagctgggcagggacagagcagggttagggggagcagccaactcagaactcgcgcgcccggcggctgggaactttgtgtcacccctgactggccccaggacccgggaggaaaagttcgtcccagcgccgaccggagaggaggcctgtcctgagtccgtcggcgcggggctgaagttctgggtccgtttggagtgggggtggcgggtgagttgcgattccgcggggagggtaaggagtggcctgtccgtcccagactcggctcccatcaccggtgggtgatgggcatgcttctggagtctacccgggccagggcctgggggcgcgctgatagcgcaggtccagcccggccagggatcagctggaagaaggaggctcggcccgctgtcccccccggcccaggttctgtgatacactccgactcgggctctggagcagtcagtgcatgacagaacttgggcccggaaggaccttctgcacccaacgggcacagcgcccactcggggcctgcagtggaacatctgcctgggagtggagtgggcacctgggttggcccatgtggcacagggctgggcagaaccagctgtggaccttgaggactggggttgctggggcctgaggatgtatcctagggccagcagatcccatagacacagggtgtccacctcgagtcaggggccaaacggaactctcctctccggtgtcagttgcaggaaccttccctctacaccatcaaggctgttttcatcctagataatgacgggcgccggctgctggccaaggtaacctctgaccccacccatgagggacacagttcccactcagctgacactcctgtctcaggagaaactccactgtgatctctgtgactcagggcagctcagcttagacccctccagaggtccttctcatcctcctgccttgtcaaggtgctgctccctgaaatgaggggtctcctctatttctactcatgttccctgaaatgtttccttatcatcctgctactggccagttggacctgggcatgggaaggttctgcctaatgggtcagtggagtgttgagcctgggacccaggagtcttagtccccaaacccccacacaagttcttttgttctttggggtttgtctctaaacctccacttttgttctacagcttggtaaacactaacgatttagtctaaggagtctaaggatttagaaccagatgggattttagaaactgtataatccaactctttaatttcgtagatgaagaaaatgaggggtagagaagctaagtgagttgcctgaggtcacaagtattaatatcctaacagatccaaactcaaattttatttatttacttatttaattttttcacttctcccatttcacaggtttcacaggcaaactcgggttttttgacatgaagctcaaggtggttttcactgtacccccattcaattagctgttatctatcctagcaaacatggcctgagcgaaccaaactaaaataatccaaaaataaatttctgctgtcaacacaattaattgtaggggagctatagcatctgcattagctatgaaatgcattataaggccaggtgtgatggctcatgcctgtaatcccagcactttgggaggccaaggcgggcagatcacttgaggtcaggagttcgaaaccagcctggacaacatggtgaaaccctgtctctactaaaaatacaaagaattagccaggcatggtggtgggcgcctgtaatcccagctactcgagaggctgaggcaggagaattgcttgaacctgggaggcagaggttgcagtgagccgagatcacaccattgcactccagcctgggcaacaagagcgaaactctgtctcaaaaaaaaaaaaaaaaagaaaagaaaaagaaaagaaatgtgttgtaaggccaggcgcagtggctgatgcctgtaatcccagtactttgggaggccgaggcgggtggactgcttgagcccaggagtgccagaccagcctgggcaacatggcacaccccatctctacaaaaaacaaaacaaaacaaaaacaaaaaacaaaaaaacgaaaattagccgggcgtggtggtgtgtgcctgtagtcccacctactcgggaggctgaagtgggaggattgcctgagcccgagaggttgaggctgcagtgagccatgatcgagctactgcactccaatctgggttatagagtgagaccccatcccaaaaaatagattttctgtttgtttatttggaactgaaagttttttgtttttatgaaattcaaataagcagcggccactagggagatggctaatctgcctgcggattgagtattaagtggcaaaatccacatccagaaaattgaaaactgagctgaccacaccttgccccagcagatggtcagaggtggatcagcaaggccaaaggcttttcctccctacagattaagaaactgagtcagagagagaggctcaccattcccaaacaaaaaacattaatttagttatgggatatgtgtgaggaattgtttcttagatatttaatcttcactataaccctgtctgcagtcagaccgtccttagtggtcaaacccagctttggcctcacaactgtgagatgttggggaagttacctgacttcttttttttttgagacggagtctccctctgctgcccacgctgaagttcagtggcgcgatctcagctcactgcaacctccgcctcccgggttcaagcgattctcctgcctcaccctcccaagtagctgggattacaggcacccgccaccatgcccagctaatttattttgtataattagtagagatggggtttcaccatgttggcaaagctggtctggaacgcctgacctcaggtgatccacccgcctcggcctcccaaagtgctgagattacaggcatgagccaccatgccaggccattacctgacttcttgatgcctcggtttccccatccgtgtaatggggataataaagtagctgttgttattatcattattattgtttaagaaggactcctggttttgccgtctttcctgtagagactcagggtgctgtagaattagtgtgccctcgtgaccatgccaatccttagcaccctgcacatctgctgaatgtacaagatcctccaagaaaccaggaggggactccaaaagcaggcctcaatatccctctactttttgggactttctttgctcagaatttgttttggagggggccaagcacagtggctcatgcctgtaatcccagcactttgggaggccaaggtgggcagatcacctgaggtcgggagttcgagaccagcctgaccaacatggagaaaccctgtctactaaaaatacaaaattagctgggcgtggtggcgcatgcctgtaatcccagctactcaggaggctgaggcaggagaattgcttgaacccgggaggtggaggttgtggtgagccgagatcgtgccactgcactccagcctgtgcagtaagagcaaaactccatctaaaaaagaataatttgttttggaggaagtaatgagcctgcaggcctagggtgcagtaatggagagatggggcagggaagcaggatcccgcttgcccagcgcctactctttcctgccccccaatctagggaggatccaggctgtgtggaaagctatggtcctttctccttccctttctcatagtattatgatgacacattcccctccatgaaggagcagatggttttcgagaaaaatgtcttcaacaagaccagccggactgagagtaagtgtccccctcttcctccagcagactatcagatgcacactgtcatcttctccatctggacacatctgtccccatcagccttgcacacccacaggccatttccctttcttcagaggctttttgtcctctccttccctgctgttctccactcccttcctccagggaacctccactccctgtcactctccagttcccccaactacccaaccccccagcatccccaggcctctctctagctgaggaggccaactgtgttgtggtcccaacctggatctggtcccaaggtgctgcacagggtgggagcgtgggcaggaggtaaacgggtcaacaactgggcttgttgactccttggcctgaggcagtccctagaaatagagtagcagataaggggaaggacacggggctgcctgatggtagtgtccctagtgctggtctttccaagggttctccagaaaggggagaaggaaataggagagtcacagagtcatacatgaggaggaggggctaggctaggaccaggcaaggtggccaggactgaaagctccctccacttctaggtgagattgcattttttgggggtatgaccatcgtctacaagaacagcattgacctcttcctatacgtggtgggctcatcctacgagaatgaggtgaattcaggaggttggggcagtaagaagggtctgtctatggggaaatgttgttatttggaatctgggcttgaggctgggacctggaggctcaccattggaccccttcttttaggctccatggggtagaggagggcagccagaagggttctttctgggacaatgtgtatcttcgatgccccttagtttccttgggaaccaggaatgaagtaatcacttcatcttcaagggaggctttgtccttcttaaacataactagagaaggatacactcaatgtctcccagtggagaactccagtttcccagcccagacacatggaagttccctctaatgtcacaccgcagtcagtctccagcccaggcctctgaaactctccattgctgcccgcacaggtgggctccaagtgcttcttttgaccttctcaatctcaaactctccttttcctcctcccgtatctgcccatcccagctgatgctcatgtctgttctcacctgcctgtttgagtctctgaaccacatgttaaggtgagtgaggttctctgccctccgaggccccatccccctggccctgatatgtcacaggacccttcctccctgtttttctcctgaagtccccacaagactaagataatccaaaaagaaaagttcacagtcgacacaatgaacgaaagtagggctgtgctatagcatctaacctagttgtgaaacgcatctggggtcctgtggtgggtgccagggtgtcaaggcccaaagtatgggaggttggacaaggtagggtgtaaggaagcagaactgccctttgctcagaaatgccttgcatgggctctgtgctcactgcccttcacattctccttcccagtccttgtttggtgaggggtgaatgaggcagtctttggagagtggggtcagcctcacctaggcagggactcagttcctcccagccacagggaggctcaggagcttgtgtccaccttcaggaagaacgtggagaagcgctggttgctggagaacatggacggagccttcttggtgctggacgagattgtggatggcgggtgaggaggggacagtcagggacactcacagcaggagtgcctttgataatcatcagccccagatggcacccagcatggctagaactctgaccaacttctcactcccttcccccagcatattcccagggatcccattcccctagcccttccccttactagcgccccactcatgaagatagaagttgatttcaatgttagccaaagtcaagccaaacaagagactaacctgatgtcaaactatgggagactgttgaataggcagggtttggggaaaatccagtttggtctccaatgcccaggggaagcactggcacagatgctggccctctctggaaggacttcagacagtcccaccagccccacatgtcctgctcttagggctcaattccaacacaagctagatgcgtgacctgggtcaattactgaccctccccgaggcttactttctccatctttaggatggaggtaataagggattgtggggattaaatacatgtgtgagaagatacatgtgaagcttgtggttctcattcaatagatgttgcctcctattggtatgctagtatattcttaggaagctaggagctcttttgagaaaagttggcttgtgaatttccatcaggggatcaatattcagagagaaaaagaagttctggctctggggcaaaggataataaaaatttcttttttttttttttttgagacagagtctcgctctgtcacccaggctggtgtgcagtaagtggcgtgatctcggctcactgcaagctccacctcccgggttcacaccattctcctgcttcagcctcctgagtagctgggactacaggcacccaccaccacaccaagctaattttttgtatttttagtagagacggggtttcaccatgttagccaggatggtctcgatctcctgacctcgtgatccgcccacctcagcctcccaaagtgctgggattacaggtgtgagccaccatccccggccaatagaaatttcttgagctccttaaaaacatacatccctctatcattacatcattttatacattaggaaacaggctcaaagtttcaagtgacacgccggaggtctctcacacagctagggagtggcagggccaagatctaaaaccatgtgaatagttccagaggccatgctgtttctatggcactgtactggactgcctggggcactaaggaatgcctcctgcagatttctgggacccaaaagggagtggggtaacgccaggttttggggagccagaagcatatacaatttggtgaaccctcttgaaggaaaactttacacaaacacacacaaaactataaatgcaaaacaagatgcagggctctggatggctgtgcaaaggaggatgcctgaggtgtaagcttcacaagcttcccgtctctgcctctgaggaactcagtttcctgccaagaaaaactggggaagcgccagtcgggaggcaacgcctaaactggagccttggcctgggatgctctttctttatggattacaggacccctggttagggagcttgggacagggggtgctcagcccaaggatggggactggaagaggctcccaagaaatgtttgtcatttccagtgatttagtaacaaagagaaacaaagcttctgccttggaggagtctcagtgggtaaggaggtacactcagatcctgtcatctttgtcctgccgcagtgacaggccctcacgcccatgtaccctgtacataaccccaaggcctcacgaaggagcgcctgctctctgagaaaagctacaatatttgggtctatcaaaagggaatttttttgtttgtttctttgtgtgtgtgtgtgtgtgtgtgtgtgtgtgtgtgtgtgtgttttgagatggagtctcactctgtcgcccaggctggagtgcagtggcgtgatcttggctcactgcaacctctgcctcctgggttcaagcaattctcctgcctcagcctcccgagtagctgggattataggcgtgcgccaccattaccggctaattttttttgtattttcagtaaagacggggtttcaccatattggccaggctggtctcgaactcttcaccttgtgatcctcccaccttagcctcccaaagtgctaggattgcaggcgtgagccactgtgcctggcctaaaagggaagatttaaaaaaaaaattttttttttttagacagagtctcactgtgatgcccaggctggagtgcagtggcgcaatcttggctcactgcaacctctgcctcccgggttgaagcgattctcctgcctcaccctcccaattagctggaattacaatgtgtgccaccatgcctggctgatttttgtacttttactagagacagggtttcgccatgttggccaggctggtctggaactcctgacctcaggtgatccacccgcctcggcctcccaaagtgctgggattacaggcatgagccaccgtgcccagccttaaaaaaaaaaaaaaagggaggaagtaggggagaaggtagatgctgatttttggagtttcatttcttttatgcagggcatgaccccatgccataaaataacagtgcaacaagataagaacccccagggcctctcttcctaactcttttcacagggaatccaatcctatacccagaaagtgaagtgaactttcaagagctctgagttttgagagtccctgcttttgacaacctgatcatcctagaccagactgttcttatccagtttcaaagattttgcccagggatgacaaagcatgtggaccactgggttgaagcatcaaagaatcagagctgagggctctccatgctgagggagagttctgacttgagggctatcagtgggaagggacctggaaggtggagatgttgcaggatgccttcggagagggaagaggcttggcaaggagaaggggcggaggggaggattgtgccactgatttgcctcctggtttttcctctcatcttgtagtgtgattctggagagtgacccccagcaagtgatccagaaggtgaattttagggtaagagtcttcctggacacctcctcttttaggctgcccttcctgtcctccctgggaatagggctgctagggcctagatggtagaagcccaagctcctctagcagaagccaaccactgggctgacacacttgttaggggtgagatgagcagcagtttctgggtgggatgccagttaatggaagaaatcttcctgtcctctccccggctaggagcacaagtacctcacctctttcctggtaggaagtatagactggggaaataaatacatcttcaaagaggcactaggtggctgccttggccttgaggttgggggtcaggggtatggatagaacctccctgccttgtttggctttctcatgtctggatgaaacctttcttcccatctttcttcccatcttccctcaccctccacgcaccatagcacaatcccagaggtcctggcttccaaatgacaggctgcaggacttctattaaccagtgacacaggtgcagctctgaatcaccctaaccactgcaccacctcacccatacccccaagcccctttccttcacctccctgacccaggaccctcatgctggccctaccccaccccttgactctgcttccttacaggcagatgatggcggcttgactgaacagagtgtggcccaggtaggcccccctgcatctgccttggctagaaatggtctagagagatacggggagcagagcatcctagagcatcctagggggacccagtgaagttatcaagtctgaaaaatcaggggtgagaagggaagggatgaggcagtgacaggtcatatcttggaaagactcactggaggcctccgggctctccaactcaggggagctgggtactaatggatggatgggcatgttaccatcagcccacctcatctcctggcttggtttagttggattgaaactaggatgagctgcctaccttggagatggctgggtcacttgtgcaccccaaaaatctgggaactcaggcctctgatgcgccctctaccgaaacctggaaagggtaccaaataggagtttggctcttaacccctgtccttgccacttagggtgcacactgggattgttaagggactctcaaacccatgataggatctgactttccccactcatcacttgtcaccttacccctgagtgacctggctatggaagaacctgccacaaccctgcatggtcttatctggaggtgcttgcagagcgtaaggccagggggaggttcctggctctgaagcctgatcagttccccagctgcacaaacttcctgctagttcaggacgactgtcttgacctctcttctgtccacctgcaggtctctctgctcagactaatcctgcttgtatggaacttcccgccctggcgctaactcctcgtgctgtggtggccctaccgagatgagcctgtgctgtctcgtgtggagtcccaggtgtggcgcccattttcctgcactgcccttagcgctcactctgcttcgccctcccctctgattccccatgtttcctcataccatgctggaatgaatgcagctgcaaggcaatttttagagtggaaagagggtagggagtaataagcagagcagataagaacacaggtgctcatgggagtcatcccagggtacgtgttctaccttaccacctaaagctgggtgacctagggcaagttactcaacctctctgggcctcacataataacaggaccctcttcatggagttatgagaattcaatgagccaatgcgtgacaagctcttagtagggctccaagccagttaacacatgctgaataaccatcagtatttctccaaagggagaaagaatgaaaacatagcatttttgatggaattcttgagtaaaaacaaaggaagctacaggtagccaatgggggataaaatgaggacaaagttagattctggctaggagaatcaggggaaccctaagccactgtccccaagagaggagggagactgtgcaggaggaggagacacagcgttccctccttctctagaggggaataaggctgagtggctggagggacaatctgagggacacacctgagtcctgtccccctctcctgctttggtattgtgcatgcacgtgtgcacttatatggatttgtgtaagcactgggctgagactttccaccaggcatcccaccgcagggtctggctggccaccctttgccagctatgccacatcagcagtgggttgcggtggggtgttgaggacacattgccagccatggccagagctaggggtttgctgaggcgtctgagcacagggagtgtcaggcctgggccccgtctccgcctggacgtggcactgtgggcgggaactctcatggcatgacagcggggagacaggctgctgccacacccacgctgcagatgcaggagccagaggtctgggcaggcttgggcctgaggtgggagctggctgcagccggtttggtctgcgctttctgacttggagggttggccgcgtttaagccaagtggagacaagctgctgccacctagtgaccggtggttgcaggggcgcttcggcaaggtgggctgtggacctccccatgactgtgtatggaggcatttgacattctcaattctctctcaacctcccccaccccaccccaggttcttcagtctgccaaggaacaaattaaatggtcgttattgaaatgaaggctgtggattcaaggctccctgccccccagatcatttccccaatcctggcaaaagcccaaagatcccagggtcaggagagacccctctgtatccccaggtccctcccagaactgactcctaaggtctccagccagggcttctgagatgcaaaggtttggcctcaggagagtcaccttttctcacggccctggccttaactcatatcttaggcattcctggccccagggccctaataaacctgcttttgtcttctgc

SEQ ID NO: 38544 - DNA, 10990 bp, Homo sapiens
aagttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggtgcgacgcgcctggcgctaaaggggttttataactgtaaaagctgacatttacgatggtagaaataactaacacataaagcgtttaccacgttccaggttctctgctgagcgctttattaatccatttaaacctcacaacagccttcgagataggtactgttattccttttttatcttttttgagacggagtctcgccctgtcgccaggctggagtgcagtggcgagatctcggctcgctgcaacctacctctgcctcctgggttcaagcgattctcctgcctcagcctcctgagtagcagggaccataggcgcgcgccaccacgcccagctaatttttttggatttttagtagagacggggtttcagcatgttggctgggatggtctcgatcttttgatgtcgtgatctgtccgcctcggcctcccaaagcgctgggattacaggcataatccactgcgcccagccctgttatttccattttacatatgagcaagtcaagacagagattagtgacgtccaaggacacagctaggaggtttcgaattcagaactggttacccagaagcacgtccctccctcgaagggcagttgtgggcacaaagaaaaaggattcatgcaaagctcttattatcgggtctgacacagttaacattataggtgtgagctgaatatatgtgcacatttatatacttattttatacgaaagcgtggaccggaggtcatctgcttcaaaacttccattgacgggaaggtgacaaggaaatcctcgcatttgagggcatcagatatcaaaaagtctctccatttggatggctggatgtggtggctcagcctgtaatcccagcactttgggagcctgaggcttgaacccaggagttcgagagcagcctggccaacatggcaaaaccctgtctctataaaataaaaaattagctggtcgtggtggcgtgcgcctgtagtcccaggtacacaggaggttgaggtgggggggtcagttgggcccgggagattgaggctgcagtgagccatgattgtgccaccgcactccagtttgggaggtcgaggctgcggtgggctgtgattgtgccactgcattccagactgggtgacaaagtgaaactctcttaaaaaaagaaaaaaaggctgggtgcggtggctcacacctgtaatcccagcactttgagaggccaaggcaggcggatcacgaggtcaagagatcgaggccatcctggctaacatgctgaaacccccatgtctactaaaaatacaattagctgggcgtggtggcacgcgcttgtagtcccagctactcgggaggctgaggcaggagaattacttgaacctgagaagcggaggttgcagtgagccaagatgatgcgtgccactgcactccagcctggtgacagagcaagactccgtctcaaaaaaaaaaaaaaaagtcctttgtgagtcatattctgtctccattatccctagttctgccttccagcctttcatgattaaagtttaatttttcttttgagcctttggatatttgacagcagcttttgtacccttccatgctccagaatagataggggacttgataaagcaggtctctgcaaatatggagaagtgttgaaagtagactgtggcaggaactatggttgaacattagcataggagaagatgaagacctgaggggaaagattgtggattctaggcagttagtgcttcattttgaaaataatgatagctactgttaaatatttaactgtgtctcttttactatttttactttgacgcattcgctctgtttcaagttctatgttaaatgcttcacacacatcatctcatttagttcttacacccttatgaggagggtcctatatactttttttttttttttttttgagacggagtcttgctttgttggccaggctgcagtgcagtggcgccatctctgctcaccgcaacctccacctcctgggttcaagtgattctcctgcctcagcctcctgagtagctgggactacaggcgcgcaccaccatgcctggctaattttttgtatttttagtagagatggggtttcacttgaactcctggcctcaagtgatccgcccacctcagcctcccaaagtgctgggattacaggcgtgagccactgcgcctggccctatataccgttttactaatgaggaaataggttcagagaggccaagtaccttgccacagccagcaagtggcatatctggatctccatctgttagatttattaattgtatgtttttggacaagttgcttaacctctctgggattaaaaatttcctcaattgtaataatacttaccttataggtggggtgtgaggaataaatcagatagatcatccagcccaatgttcatagcaggtacttggtaactgtagctaaggtttgggtacagagcagtgaaggatcaacattcttctgattattactaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccaggtagccaccttgcccagagaggactcaaagtaatgttcttgtaatcatttattctgtggtcaggactgaagctttaggtagaaactcttgcatgtttcacatcagtttctgccagccaggtatgcctgaacagaaaacattcatttattcaaaatacatattaatcatgtgccaagcactgctctatatgctggggatacagtgtgaataaagtggtcctggctctcatgcagcttacgtgctaatgggaagtctgataattgacaaagaaatgatatcatttcagatagtggtgtctgaagaaaaaaacagggaatggggtaagggagtctagggtaggtttctttaggtagggtgatcaagaaggactcttctagggaggtaacatttaagctgagacctaaatgagaaggaggtgccagcccacaaagatctggggagagagcaaaccagaaagtgtgaagaacaagtagagagggctgaagtgggcagaaattgaggtgtttaagggatacagaggcagccagggttaatggattgtagcagcgggagagcactaggaagcaggtgaagatggagagccaggtagggccaccagtgtaagtcccaacaagtggttggaattttcttgattgcagtgggaagtcactggaggattttaagcttttttttttttcttttttttttttgagacagagtctcgctctgtcccccaggctggagtgcagtggtgcgaccttggctcactgcaacctttatctcccgggttcaagtgattctcctgcctctgcctcccgagtaaccgggattacaggcctgcaccaccacacccacctgatttttatatttttagtagagacgaggtttcacatgttggccagattggtctcaaactcctgacctcaagtgacctgcctgcccacggtgctgggattacaggtttgagccactgcacctggccaggttttaagctttttaagcaagagagttaactaacctgatctttgttggtgaacctacaggcatcagctttaggaaattacttcacatttcaggaaagccatgggaatgttggtctgcagtcttcagagttaggggaatgggttctagagagcatccttcccagcgcagtgtgactctctctgtgtattgtcagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtgagcacattctgttggttttctgctaccctgggccttctctggtaatgggtggccagatttttgtaataaacccgtctatttgacggtgtctgctgacatggagaggtctagtgtggttttggaggttctcctgattgagaagctctggccagttgcccttcatgggacctaggacagtccatgaagtgatttgcctatagtaacaattcggtaatacacgtattagctttctagtgctgcataacaaatttccacaaacttagtagcttccagcaacacatttattaccttccagttttggtgggtcaggagtccaggcacagcacaaccgggtcctctctgctcagggtcttacagggttgccatcaaggtgttggctggactatggcctcatctggaggttggggctccatttcagactcatgcaagttggcaggggtcagttctttgcaattgcagaactgaagcctcagctcctagaggctgtccactccataggcagctgacaacatggctgtttgcttcctcaaggccagcaggagagctactctcttgagtctcttcttttaggtacctccttttaaaaacttcatttgattaagtcagatgattagggactttaattacatctacaaaaccctttacctttagcatattcttttatttttattgttaaaagtgttttattttacagagagatagtgtctccctatgttgcctaggctggtctcaaactcctggactcaagtgatcctcctgctacagaccctcaaagtgtgggattacaggtgtgagtcacttgaacttgggaagtccagcatcagagtctgtgttcttaccctgtcgctatgccacatatctgtagtgtcagctaggctgctctgttggttttgaaacttctctttcctagctgttttcttacagttttccagtggttctagctttctgaaacctcggggcttagtagaaagcttgtatagttttgcttcattttcctggatccagcacagttctggttggtcctccgtggaagttaagaaccatgtattgggccgggcgcagtggctcacgcctgtaatgccaacactttgggaggctgaggtaggaggatctcttgaagccaggggctccagaccagcctgggcaacaaagcaagaccctgtctctacaaaaaattttaaaacttagccagacgtgatggtgcacgcctgtagtcccagctacttgggaggctaaggtgggagtatcccttgagcccaggagtttgaagctacagtgagctgattgtgccgctacactccagcttaggtgacagagcaaaatcctgtctctaaaaaaaaaaaaaaaaaaaccaaaaccatgtattctctctatagttttatgacactcctccactggaaccggaaactatacccgtaatgtaacaagttgggtctgaacttcacattaataaagtgacacaattgtggacaatgaccataattctgagtttaaatgagacagtaaaataatgtactgttaaattactttgttcaggaaaactggaggggcatacatttttttgcctagtttcatgcactgctgtcccagtggtgataggctgtcccagtaattgacggtgcccttgtctcttaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggtaagagaatgaaaattctgtaaactgccttactgatgtgtaattcacatactaaataattcatccatttgtgtaagtcagtgttttttagtaaatatgaatccaattttagaatatttccatcactccaaaaagatccttcatgcacgtttgtagtcattcctcgacagcatccttagtccctggcaacctactttctgttgccatagatttgcctcttctggacatttcataaaaatggaatcatacattatgtggctgtatctggctaagcggaagaagccagtcacaaaagaactacatacgtatgattccatttatgtgaaatatctagagaaatggtttttacagtcttttttttttttgaggcggagtctcgctgtgttgccaggctggagtgcagtggcacagtcttggctcactgcaacctccacctcccgggttcaagcaattctcctgcctcagcctcccgagtagctgggactacagactcgcaccaccacgcccagctaatttttgtgttttagtagagacggggtttcaccatgttggccaggatggtctctatctcttgacctgtgatccgcccacctcggcctcccaaagtgctcggattacaggcgtgagccaccacgcccgtcctaaagtcttttttccaattcactttcacgtccttgtccctttgtggtaggagaggggcttggttgaggcacagcttcccaaagggcaatgggtcagtgcatcacacgtgcaaagcctggctgccctctgctttttccctggtgctgcctgaggtctgggttcctgctgcaggcaccctacactgctgttccgttacgttctgcttcacagtatagcttcccattccctgtaacaaaggtggtttttgctgtattaaaacatagtaattgatggctgggcgcagtggctcatgcctgtaatcccagcactttgggaggccgaggcggatggatcacctgaggttgggagtttgagaccagcctggccaacatagtaactccgtctctactaaaaatacaaaaattagcctggcatggtggcgggcgcctgtaatcccagctaccacggaggctgaggcatgagaactgtttgaacctgggaggcagaggttgcagtgagcagcaatcacgccactgcactccagcctgggcgacagagcgagactgtctcaaaaaaaaaaatagtaatggctcgttttttttcccttaaatttccttttttttttttttttttttttttgagacggagttttgctcttgtggcccaggctggagtgcaatggcgcgatctcggctaactgcaatctccacctcctaggttcaagcgattctcctgccttagccttcccaagtagctgggattacaggcctgcgccaccaagcccggctaatgttgtatttttaagagagatgggatttctccgtgtgggtcaggctggtctcgaattcctgacctcaggtgatccgcccccccctccccggcctcccaaagtgctgggattacaggcgtgagccaccgcgcccggcctcccttaaatttctatattgagttttattagtaactgttttccattttgctttccccacgtctgggttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcggtgcgtgaggttcccggcgcggggtggccaggactgcctcgccctggaaggtccggggcgggttcgggaggcgggaaggcgctcccgggaggagagcggaagggggcggtgctcactgccagtctaagcaggaaggcggggatccagtcgcggcttcgctgtgtgctggccgacggcgcttcccggcgtgccccgcgctgcggccggaaggggcgggccgggtcactgttaagggggccgccatggcccggctgtggggcgcgctgagtctttggccactgtgggcggccgtgccgtggggcggggcggcagccgtcggtgtccgggcttgcagctccacggccgccccggacggcgtcgagggcccggcgctgcggcgctcctattggcgccacctgaggcgtctggtgctgggtcctcccgaaccgccgttctcgcacgtgtgccaagtcggggacccggtgctgcgcggcgtggcggccccggtggagcgggcgcagctaggcgggcccgagctgcagcggctgacgcaacggctggtccaggtgatgcggcggcggcgctgcgtgggcctaagcgcgccgcagctgggggtgccgcggcaggtgctggcgctggagctccccgaggcgctgtgtcgggagtgcccgccccgccagcgcgcgctccgccaaatggagcccttccccctgcgcgtgttcgtgaaccccagcctgcgagtgcttgacagccgcctggtcacctttcccgagggctgcgagagcgtcgccggcttcctggcctgcgtgccccgcttccaggcggtgcagatctcaggtgcgggcggcggggaccggggctgctggagcagcgcgcgcgtctcttctgcccgactccgcgagagcgcagaagtggtcgcggttcatacgccggacctcccgcaggagcgaagtgggatgcgggagcggagaggcctcaggacggatagaagctcctgtggggtagagcccgctcagataggacgcaggggcgaggagaggtcccctagttccgctgttacctgacagcctggcgtctgctttctgctcccttgctctctgaggcaaacacgctcttcggccccagttagatccgccacggtggagttggagaagtgggggttagcccccgccagcctgacccagcccagggggctaggccattcccccgtggtaccacaggatgcctcgcggaatgcgggctctgctggggtcggggtgattgttcctgcacagcaagcccgtcggttcaagatggtcagaaaaacaagtggggtctcaagctgcagaacctctgttaggagttgggagcccacaggtacctcagaagtgggaggagtgttcggaagggtcgcaccgtagaaagatgatttctcatctcagctctacagtgagctcgataacctaattaccagagttgggaaccaggttgaacgcttggtaatggaccgagatgagggacgttttccagttagaagaggagctgctgtctacatttgccatctgctgttgcctcttgtcaatgggaacagccaggaccgggggcaggggtagggaggttgaggatgatgcagttcagctgttcccactcaccagggctgtaacttcctttgcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 38545 - DNA, 103133 bp, Homo sapiens
gctgtgtcgttggtggggaagaggggcaagtgggtggggttcctattctggaaggcacaggtgcaccgcccgcctcttggctgcccctcaggtgacggtgcggtcccttgctagcgggaagagtgtctgctaaggacagtttgcaccctgaggctcatgttccctttgagtctagggacacatgctgggttaaaaaataaaaataaattcaaacaggacccaaccttggaaacctcaagttggtgattgttttcctggttggttttttgcatagttagaaaagcttgtggagctcaatggggctgctggctgtcggaaaaccctggggacggtgttttggggactcatcactggtcttttatttgtccccattgagctggcttggagctgaactgtattcccagagcacgttgctgtaggagtttggctttttattttttaatatttatttatttatttatttattttgagagggagtcttgccctgtcacccaggctggaatgcagtctcgcgatcttggctcactgcagcctccgcctcccgggttcaagcgattctcctgcctcagcctcctgtgtagctaggattacaagctcgtgccaccacgcgcggctgatttttgtatttttagtagagatggggtttcagcatgttagccaggatggtctcgaactcctgacctcgtgatccgcccacctcggcctcccaaagggctggaattacaggcgtgagcccccttgcctggctgagtttcgctttttaaattttttgtcacggcgatttaaactttgggtggcctggtagtgcctgctcagtttatagaagtaggatttggaagttgactactctgtgtgtaagtcaacctttgtaataaaaaagtacggcccggccccatgactcacgcctttaatcccagcactttgggaggcccaggcgggcagatcacctgaggtcagaagttcaagaccagcctggccaacaaggtgaattcccgtctctcctaaaaatacaaaaattagccgggcatggtggtgggcgcctataatcgaagctacttgggaggctgaggcaggagaatcgcttaaacccaggaagtggaagttgcagtgagccgagatcagccactgcactccagcctgaacgacagagcgagacttcgtctcaaaaaacaaaacaaaacttggtttcccccctccgaaccgtttgtcttgtaaacaactccctggtctaggctcccatgtgtgggagggaggttgtgccagcctgtgcagcacatcagaggttggagagctgatgcctgtggtgaataatcatggaaccgtttgcagtttgggttaggccataggcgtttgatacaggaatggttctatgtgcttttctttcgctgtagtgcacaaaccagtgcccatgaagtaaaaagtggaggaggaagataaagtagtaagactccaggctcagcaccaaacttaactagtgaccaaatgataatagctgccttaataagcattttcactgagcacaaccattagttttattcttagtctttaaaatgggttgcaaactcaaaccctataggggccagaggtaacataaatgagcaaaggaggaggaaagaaaggtaatggcttctgaactacagagtatgtgcctctttgaaaggagcagccactagctgattgttgctcagcaaaaatgtgggcccagagtcggtggatctttgacttgcttctaaactggctatctctattttgatggatctcctgacttttaaatgtagcattaaaaaaattttaaacactatagaccaaatgtaacatgtctttaatgttggattcaacctgaaggctagtttggaatctgtcttaaaacatccgttttggatttccccgctgttttgcagaaaaggaaacaggctttagaaatcaagtcacaaggctgttaagtgatggaattgtgtgaacctaggtccttctggtgccgtagcccagcctattatgtgtgttctgttatgtcaaaggatcaaggggttattggtggcgtacattctagaaaaaaggtggtggtctgggagctggtcacatttataggcaaagtgaaccttaactgcattggcaggaatcccagttgctgtagaagtcagtgtgggtcttctgagtgttagtacagcagtgctgatgttaggaggaatgtgctgtgtctatcattccacaatgtatgtcagagcagttagctgatcctgagagccggaggtctggggaaggcaggctcctcccactgtgggggtgaccctcccaaccctctgcacaaaaggctcctttttttcaggacagttaaaatttcagtactaactttttctgtctgaggcaaggcaaatttgaaattatataattgttttaagacctgtaaaagtaacatggagcttactaaatctcaccttgtctgtcttagctaagattcccataatgctgtctcttagatttccaggaagaattaataaaggttaaaaaaaatttttttaaagcagtctgtggtaaaatctgagataagctcccggggcataaaatagccctgccccagaaatgaggggctggggtttcaattctggataaaacttagaatcccagcattgtacacagccacacttacggatgtaaaggggtatgtacattttttttttcctatatttcattttcaaggattttttttttttgagatggagactctgttgcccaagctggagtgcagtggcacaatctcggctcactgcaacctccgcctctggggttcaagcaattcttctgcctcagcctcccaagtagtggggactataggcacgcgccaccacgcccggctaatttttgtatttttactaagatggggtttcaccatattggccaggctggtctcgaactcctgacctcgtgatctgtccgcctcagcctcccacagtgctgggattacaggtgtgagccaccgtgcccagcctcattcccaaggatttaaaggagtaaaaagcatattcagagcttttgccaaagaatttttttctgtgagaatgtaaactcagacacaagctagatagctttcttacctgtatcctggaaagtttttggaaagatgaaaactttaaaatgttacctgcctctagctgcttcttagcaacctttaccagcaaggcactcagctatgagttcagtgtttgtggatttgggggtgtggagtgtgctggggaggggaagggtgaggtgactaaagtagctctctgctggtgttatttttgcatttataacgttaggtgttgtctgtgcaggctttctcattcattggtttcaggtcccttagctaaatgattattttctaaagttatgtttattttaagggaaaattagagtattagtacttttggcttacagtttgagacagaaatgcacaccaaacctaaatattaatgtttacactgtttttagtagctagtattggaggcagtaaaagaatcatgggatcaaataacaaattattttctctgctatggagaagttgtgctaatctcatcctgttctgcaaatgtgcttttcctaggcggtatataaactgtactgactctggggagaatttgccagaaagcccctgaggctaaagggtaggacgtggtttgcacctagaagttatggtagagggggttatgtaagaattttgcttctcttgtttgaattaagacccagaagcactgattgcaccctttaccgtttcttaagccttttaagattttattattaaggttttttttgagacaaggtctcactgtgtcacccaggctggcgggcagtggtgcaatcacagcttactgcagcctcaaagctccctggcttaagggatccttcagcctcagcctccgaagtagctaggactacagccattcaacatgtttggctactttttaaaaaattttttctttgagatggggtttcactatgttggccaggcttatcctcggctcaagccatcctcctgcctcagcctcccagagtattgggattacaggtatgagccaccatgcaggctcttaaagctttttggtcaccatgaactttgcttcctttgcacccaacattgcagttttggaaatgcccttagttttttcctgccgttgttgcagcctgctttagagcgtctcatcttctgtgagcacagattccgtagaaagtttttatgttgaagataggacctgccccaacagtgcatttctcaattatagtaaactagctgaaaaagattgaactaaaacatgtatgatgtaatatttcatattttcataggaaaattatctgacttgctgtaaaaagttagtatccaaatttcagagtgctaaattcacattgtagatgtaatttccaatgaattttattaggtgtcattttaaagcccaatgttagggattattttgccaccctaatatataatgtggttttgattaacttggacctgggaggattcctgactgactggggttgagctttactttcagtagttcaggagaacacttaggcatggataacctttgaattctttttttttttttttgtattcttgaatggtggaacagtccttttaaattatagtgagttaacactctttgttttgatttatttaaggcattcgtgatgagttcccctgaggtaacaggagaatccccagagggcaggtctaaaggttggtttgtatgctaaaaacgggtcttggttgcaagtagctattgattttaggagtaacttgactaagagtgttacttgtttctttattcttggccagcataatatgctgctttatgtaccatcctgacagatttagccccacttcctacaatcccctttgataaaagtgtgggagtagctctcctctgttggaagagaacagttactgtgaagggcaggttggtttttttgtgtctttttacagaacacttaatctcttactacttaacacctgtgctctctgcattctggctttgtgctcctgggttctggccctgacaccatctgtctgtctcccatgtgtctgccctttctcctgaggctttttgtttttgtttttgtttttttttaaagctgtaatcttggaattgttgtgaagctcaaaaggtgttagagacctgtctcctacatataacttggagttgacaccaaagccagatataatctctgacatcctcttttcatggactaggagaattaagtttagaatggaaagtgattaccctaattttatactgtgagcagggaatagagacagaacttgaacccacgttttctcatttctagactagtactatttgtaaaattcatacactcttacctctgctgtgttggtctcttattgtacttgaaatgtccatttggtttgtaagactatggcttccttttttttttttttccttatctgatcaatcttgtcttgtcttggtacttgcaggcttccttttctccccaaatgccgcattcttcacagttcaaccctgttggatcattcctgtctccttatatatacaggagacccatgtgttcctatagaagcaccagttgactgttgtgtgcccaagttttagattgagctctttagccttggttgttctgaagacttatacttctgattggactaccgaatgcgtgtatctatctgaggtatgttaaacccagcagatataaaaacagaaccaatttcttccttttcctcatcagaaataacatcagaagtaggcaggtaaaagatttaaaggttattgccaaaacaggcatagtgtagggagtgggaaggacattctaggcaaaaggaacaacatgtataaggacaaggagatatgaaacagggctgtttttaggcaactagaagtacagtattgctagaattttaagcgcaaggggtactagcttatgacctggtagtccacttgtgttcctatgtgcaagagaaatgagcacatatgagtataaaaaggcatgcacaagaatattcacagcagttttattcataatattcaaaatctgaagaaaaagcaagctagttgtggcacctgtagtaccagctaccggggaggctgaggcaggagaatcccttgagcctaggagttcaattctggtctggaccacatatccagaccctgtccctaaaaataggacaaaacaacaaacgcctgttatgtctggtcccccaagacagtgcctaaattagatgattgactaggaagattcacaggagtcagcatatagtggttctcatagctaagcttacagctaaaggatatggagaaaaaccatcaaagggaaaaggcacgtggggtgaaatctggtacaagcttccaatgttcttttcccgggagagttaaacaggacatagtttaattcccctacaactgacaacatatgtaaaatgttgccagccagaatagcttgttagaatctgggcacccagagagagagagagagagagagtgtttgcgcgtgtgtgtctgaggactggttgaataggtagcctctgcctgaaatgtaccaaaatttcagactccaggaggaaagccgatgttcagcataaaccatattgtttgttcctttgggtatagtaagtcactcagttctgggaatggtgggaactcaaaatttaggttcccagatggtagctaaaagacaccagtcagacctgttactttaaatcttttctgtacacccttgagcaggaatatggataaatacatatatccacatctattaatatgtagcacagtgataaaaaccactgttctatactttaatgtgtagacatgtcagatactaagttaagtggggaaaaaaaaaaagccagacccaaaagaatacccacatgattgcatttataagaggttcaaaaatgggcaaaactaactggtaacaacagaagcctgaatagtaaactctttgggggatagtgtgggaaagggcacaggggaaccttatagagtgttggaaatgttctgtgtcttgctgtgtgtggtggttgctccggtatgtacagataagtgaatgttgatcaagatacacacttataactattgtccttttattgagagggaacacacaacagaataaagtaggaatagaccaggagggacttaacttggccactaagctgaaggcggaccatgaagggttttatatgctattgataaggaacttggcctttactctgtggcagcagttctccaagctaggtccatgcctgcctagtggtcaccaaaaccctttaagaggctataaagtcagaagtatttttataattctaagacgtggttgatttctgctcccccaccccactgtgttgacatttgtaccgatagtgcaaaagcaatgggggtgagtaaaacagctggcacttacttagcaggaatcagggcaatgccattaaactgtagtagcagtcattgtattcttcatggtacacattcccagaaaagccagtgtcacttacaaatgtccttgaggaagcagtaaaattaatttcattacatctcagcccttgaatatatgcctttaatattctgtgtgacaaatgagaagtcagtataaagtacttttgcttcatatccaagtatgatgattgtctcaaggaaatgtgactgagtttcaagaataagcctctttttttcctttgaaaaccttttttttctttaccagaagaacaactaacaaactatggttattcaactttgggtatttggcagacattttcttgaaaatcaaccaagtaagtcagtcacttcataagaaatagctcactttatttgttgccagtgatacaatttgagcactgaagaaaaaaataagaattttggaagacctttatctgccaccacatgagcttgacacttgccccaatacttgaagtcccctggtgagattggtggtactatttactattaactagtgtgtcaacgtttgttatatttgcataattcaagccaatatttgtcaaatgactaacagataggagtaaaagatccatccaaaatgcaagattgacccatgtgttttaatgtaacagcatatgaagagtacatatggtttcagattccatattgtaactaatctttaagaagttaccatttgttgggaattttggtgtagtattaatagccacagttgtctgacaatgatattaaaatactcctttttccaactatgtatctgtgtgaggctggattttcttcatatacttcaaccagaataacacatgacaacacattaaatacagaaacagaccagaaaatcccgctatcttatattaaaccagatactaaagagatctgcaaaaatgtcaatgccactccataaattttttttgtcttggaaaatcattgtgttaatatgtaataggtttttttaatggttaataaatctacccctttttaatttctaatgggtgaatattcatatgacctacttacacaaaaagctcttgagtaattaaaagtacttaaaattacctcagtaatttttaagagtataaaggagtcctcagaccaaaaagtttgtggaccactgccctctggagtaggtgattagatttgtactttccagagatcctgtaagaatatccaggcaggaatgaagacgtcttaaaaggctcaggaaatgtccataggatttgataaggcacagtgaacttggtttgaaaaaaagtgtttcagaatagcatgtgtggaaagggagagaagcatctgatgcttgccttcgagggttaaagagatgagtaaaggccgtagagatggggtactccgtacggagggctgatggggatgctagggaaagacaggctggctactagagggaagagcagggttaagaaaagttctaaacatgggagagacctgatgatgtttacaaaggtgtgagagctgtggcaggtataaccaagaggccctgtgggtatgagaaaaaatggactccaaaattgctttttaaataggaagaaggataccttgtcagtaagtgcagaaaaaggatagtaatggaagctgtgtcaaattggtgagggcaagagtagggtcatgtagaccaactgtccagagcctttagtttcttttattcctcaggagaatttatgagactctgtcattctcacattacaaataaaaagacctgcttagagaaattgaaaatcttggtcaaagttccctagttaatggagcactggggcttaaatcagaatcccagactccaagttccctcttctgcatcaaggcagccagagaagcattatatggagaggtgatggagaccaggtccaagaacagctctgagacaactctggagcctttgtttttttattgatgaagaatggtctgtggtccaaacctaaaaccccaaatcccaaaatgactttagtggctgagaattttgacagggagaagaggtagaattgatgaatatttctcttgatgtatctaaaatcttaagaaaggagtcactaccatttatgaaggttatgagtgaggtggtaaaaatacctatgacaggagtgtgatacgggtctgcctttcatgtggtatctgtattgagtgcctgcaaatgcagcagatactattctggggcagtgctgagatacaggttgtgagggacctttatagtttatcagattggtgagcttacagtccatacagttagcagtgtgacaggtaagtgatgagagttaaaattatagtgaccatgtgctttcaatattcttgaggtgttttggtatgaaatattctctaatgttctcataaacctgtcctggaaattgtagtatttcctcttccacactgagttaagagagcaaaaagaacattggacaatagatgtaccctatgaaaaatgaagaataaccagagatggaaagggagagccaggagaaagtgattcctgacttgagtggagaatagctgaagggtcagatcctacaaagatgcagggtaagatagacttgaagtatcagttggatttggcagctatgaaggcattaatttgggagcagttgtttagtgtctttttggggaaggggagagatcagtgctggcaggacattgtggattgagaggatgaacaggaagttaaataaagatcatatattttcaagaaggttgatagtatagcagaagaaattggcaatgaattgggaggatattttaaatcaaggaaggtgtggtggttttttaaggtgaaagagtcttgaacatactgacaaactgaaggggagccagtggagaagagaggaaagtcaggtgatgcagggagaggagatcttgtatctgttgatggatttatctttccgacacaggaaggaggttaggacctgtagctttatctcgtttattcctggtgagccttcctgtccagccctgttggactactttgttttcttgaatttactgtgttctgtatcctctctgtgcttgttctctgtgtgttaatgctttttctcatgcctgcttattgaaattctgcattttcattattctctagccaaaacatctgagttgtgaaaccattttagataccctactttattcctctcttctatagcattttatgcttgatctccacttagctaactagatttgtttctttttcctacctgaataattctcctgagggcaaggagtatgttttatatatacatatctgtaatctcaacatctaacctagtgggttgtcagcatttacgaaataatattaggttgaactatgtgaaattgccattttgttggttgaaaaaggtaaaatactgacaatttcatatggaccaacctgataaatttttattcctgacattgttgcatagaagacttgaggtaggaccaaggagaaatttaaacacagagaagcatctctcagcaaactatagagtcattaaagtagagccaaaatctggctttgagtgagctggtgactaaagcaaatagagaaatttggctagaagacttacattcttccataaggaaaatgtattcttcatgggaatctgtagcatttcctgatctgtggtctgaatgacatttctctaaatgagtgttcatataagggctcttcaaaatcgtaatagaatatgcctaaaatcctgagtatccgtgctatagaaattttgtttagctttattattggtataaaactaaaggcaggccaggcatgtggctcatgcctgtaatcccagcactttgggaggctgaggcgggcggatcacctgaggtcaggagtttgagaccagcctggccaacatggcgaaaccccatctctactaaaaatataaaaaattagctgggtgtggtgacacatgcctgtagtcccagctactcaggaggcataggcaccagaattgcttgaacccaggaggtggaggttgtggtgagccgaaattgtaccactgcactcctgggcgacagagcgagactctgtttcaaaaataaaaatagaaaaataaaggcaaattgccagagtacgtctcagcagaaccagttatttgggacatctaagtatattactttctgctactctggcttaattaaaaaagtctaaatgttcaagaccaatgcatttaaaaaccatctgattaaatggaggaaaaatacttcagaaaaatttttagtgtgaacacatttttgtcaggaggattactacattccaatccatgggaccccagttttagaactctctctggaggactgagtaaaccttgggcccttcaaacagtcttctataaatttctcaactggctattaatccattgtacatgattaatagtaatagtcttgaagggtcttcagcattggtattatgttgtccattaaaggcaaactgaataaaaatcaacccagagatgatagttggcattcatttacgacaggtgagtatccccaagtaaagattttgagctgccagaatggccatcctatcacaatgctgggtctggggagtatgatatttaaaggcagggccaaggtttccaaattagacaattgttcatttcttctatacaaataaatataaaatttggggatctttagcaaacatatctacaaagtgtggttcagatttttaaagaaaaagttatgagtgatacttctgaaccatagatggaaaaaaaaaaaaaccagttatatgctaaaacaagtaaataagcttcttgatgaacttggctaggatgaataagttgaaaccatacctctgagtaacagtgatataatttaataactggtgtgtaattggacatctgccactaaaagtatttattgagcatatccatgtactttatgtatttctgactactacgaagtctgcaaagtaggtgctaccctcttttttttttttttatacctttaggtaaccaaggctcagagtgatacctaagtggtagacctggtgtttgtattgcaaagcctgtgttctttctgcttttcaaaacaatgattcccacttttaaggaggaggaggaggattttcctttgtggaggagggaaatgcttttcttcagaccatttccctcacctttgttgtcctagttgatgatcatggctataggaaaacagtttcatgataggagtgtcagctcttatctattggagaggagaaaattgaggcctgatctaaaataacttggattagggccaggcactgtggctcatgcctataatcccagcgctttgggaggctgaggcaggcagatcacctgaggtcaggagtttgagaccagcctggccaacatggtgaaaccctgtctctaccaaaagtacaaaaattagccaggcgtggtggcacatgcctgtaatcccagctactcgggaggctgaggcaggagaatcacttgaacccgggaggcagaggttacagagagcggagattgagccattgcgctccagcgtgggcgacaagagcaaaactctgtctcaaataaaataacttgtattaggtgagtttcctcaaaagccattctttctaacaataggtagataggtagaactagttttatcttgagggtatttgtgtctatatcattagcattaaacaattgtttttaaattaattttttaattaaagaattgtttttgttttacagcattgccaagtaattcttcctgttgactcctgattttcggtagtattaaggtttgcactctattaagtctctgatttatcttaaagccttctttcccgttgacagtagaagaccaactaaaggtcaaaaaaaagctacaagtgacctcactttatggcaaaatatgctgaaaataagggcaggaactgtcaggcaatagtagaataaccaagagaaaaacattttttatcatggtaaaacattggtctgaatgcagatctatacattgatgaaagttcagatggactacacaaagtaaatgggtctgtgagtatggggtggatagtaggtttctgttttgaaaatgaggaactatgaattcatataactggacggtttaaaaggatcagtattggctagatgtggtagctcatgcctgtaatcccagcactttgagaggctgaggcaggagcagcgcttgagcccgggaattcaagaccagcctggacaacatagcgagaccttttctctgaggggaaaaaaaaaagttaaaaaaaaaaattagctgggcatggtggcgcctgtctgtagtccagctacttgggacgctgaggcaggaagattgcttgagcccaggagatcaaggctgcagtgagctgtgattgcagcactgtgctccaacctaggggacagaacaagaccccatctcttaaaaaatgtgtgtgtgtgtgtgtgaatatacacagtacacatgtcgagcagccctaatctgaaatgctccaaaatctgaaacttttggaacaccagtatgtcacaagtagaaattagacacctgaattcatgatgggtgacagttaaaacacagtcaaaatttaatttcatgtacagaattactaaaaatattgtataaaattaacttcaggctatgtgtatgaagtatatataaaaaataaatgaatttggctgggcgcagtggctcacgcctgtaatcccagcactttgggaggccaaggtgggcggatcatgaggtcaggagatcaagaccatcctgactaatgtggtgaaaccccatctctactaaaaatacaaaaaaatgagccgggcgtggtggcgggcgtatgtagtcccagctactccagaggctgaggcgagagaatcctgtgaacccgggaggcggagcttgcagtgagccgagatcacaccattgcactccagcctgggcgacagaacgagactccgtctcaaaaaaaaaaaaaaaaagagaaaaaaataaatgaattctgtgtttagacttgggccctatccctaagataggtcattatgtatatgcaaatgttccagcttccaaaaaaaaaaaaatccaaatctgaaacacttcttggtcatctcagcatttctgatgagagatactgaacctgtagtggattcagcccttaggtctatttgaatcatatctcttgccttttaattaagcattttaagtcaaatgattaagaggaagagttagggggtaccaggaatagaagggcctggagtcttcagagaaatagttgccataggtctttggttcacttaatgagccaatagatccttcctcaaggatccctgtggtggcctctgaataataataatgatacgactgatagacagtattcgttggttcagcacataattacatgtcaggccctatgctaagtactttatgtgcattaattcacaaaaagccttatgagatagtattacttttatccctattgtacacaaaggagagtagtagatctgttcgccatctgacagtcctggctttgattttttttttttccttccaaattggttaaggcaaacattggtaattataagatgaaacagtttggaatatacattgaacacctcattcacttttattataatgtcatcttaagctagagctctggcttgatgtatgtgagagaaggggagggaggcatgtcagatatcatttgccttgatttgggaaggtgtgtatgttcctaacaggattaggagtggggcagggtgaccagacacattcctaaattagatttttttttcagactccttgaaatagtaagatttccttcctctcctaaggaatacctttctcccagactcccaagtctgcatctgttccctagactactgtggtactttctcactaatccttctgccacttatctgtcatgtagttgctggtggtctccttctaagactcactttgttatttacttgcctttagatgtggccaggatctggaatccatgtagtccatatatatatagtacttttattacagtaattaaaagctaggttaatttttgtgtattgaaaagacacaattttgtgtattgaaagacaatgctgactccttaatttggcatatgaggcttttccaattttctctcctatacctaatgctgtaccacactggaccacttttgataatgcctctctactctcttgtgttctttagaacttcctctttacccccatttccaggcacattctgtccctccaggccaccttggcttggaggacaatgtacatttacagcacgttgtagtctgtgttgtggatgtttacaggatcgggtcttagttctttttctttctttttttttttgagacagggtcttgctctgtcacccatgctggagtgtggtggcacaatctctgctcactgcaacctctgcctcctgggttcaagcattcctcctacctcagcttcctgagtagctgggactacaggcatgtaccaccatacctgtctaatgttttgtattttttgtagaaacagggtttcgccatgttgcccaggctggttttgagctcctgcctgccaaaagttcttttccagacttcaaaactttattttggtttagtctgtgtctaatctgctgccccttggggtgctcactatagagagcaggcagtcggctaatgtttattaggcagtgaagaatgaagcatgtagccttaagataatgcagattgtgctaggcaatggcacgtgcctgtagtctcagctactcaggaggccaaggtgggaggagcacttgagcccaggagtttcaagttcagcctgggcaacacagcgagacctcctctctgcaggttataaatctttgcatcttagccttcatgaagttgccttcctgaaattgagaatcagcttagaaatctacagttgtgaaaagggccttgtgtgtcactggatttaacagttctcaatggcaccactctagagagcttgggaaaacaaccttgtaggattgtgtattttggtcgtcttcacagtttgcagagggtaccaatcttcaagaacttgaggctgacgtgaggctcaagtttgtccctttaaggtcatcctgcagagttggtaaaactgtaaatgctcttggtcattctcatgctcacttggattttagtaggccaaacaaaatgacattgggcctcttcttgttttgttttgatgtgaccagcttatgagatattaagtgccagtttcattacttggtctgtttttgttttccgcaagataattgaggataatagaactgatgaggcaggctccccttaaaaaactcaatctgtcaaccaatatttcattgcttcttatgttgggcattggctgtggagagtgagggagaccggagtgaagaatggtacctacatttctgctttgggcatctggtggatggtggtgttatttaccgagatagggaataccaaaagaatagtttttgtgtaagggttcatgattttttatatatatatataggagttcttttttcattcggtaatgtcttacccatcttctcatgccagttaataaagttgtatgtactaataatgaccacatagagttgtataacttaatcagtttgggtggttttaccactgttggtacttacctctcttgtattcaataattagtgtttgcagatacaaattagcagctactgtatgccatgcaaaatgctttacatatgtcatcaaaaagttggtatcctttttccatttcacaaatggggaaactgagggatagaggttaagtaactgtgatatcacacagccaataaatggcagaatgaaaatttttaaacagctgtattgacataaaatctacataccctaaagttcacctttaatgtacagttcattggtttttagtccagttgactcttggacagtgtgggagttaggaggaccaacccccacagtcaaatatctatgtataactttgactcccccaaaacttgactaatagcctgctgttgaccggaagccttaccgataacataaacagttgatcacatgttttgtatgttacatgtattttataccgtattcttacgataaagtaggctagagaaaaaatgttactagaaaatcataagagaaaatatatttactgttcattaagtggaagtgaatcataaagatcttcatatttactgttttcacattgagcaggccgaggaagaggaaggattgattggtcttgctctctcaggggtggcaaaggtggaaggatgtggagcggatgtaaggagaagcaggcacagtcagtgtaactttacagaaataatttctgtctgactttttgctttttcatttctgtaaaaatgtttctatgtggtaccaatcctaattccaccatttgcgttagtttcagtgcctgtgtaatagaagggtctgtattgtaaaagaagtcaaaagcagccttgaataatcggaacccttttgccagatcatctaatgtcaatatgttttctggcattgctacttcaacatcgtcttccatgtctggcactggtttggagcactcatctctatcagattgtcttctgctaattcctctggtatgttaactcttggatttctccaaggtccatgtcttggaaatcttcactcccaacctttttttgtcatatctacagtttctttcatgatttcctgtattggctctgtggtaaatctgtgaagtcatgtacaacatctggaaacagtttttttaagcaggaatttattattttgggcatgatggctttcatggatttttctgtaacaatgatggcattgtcactggtgtaattcttctagactttcatgaccttctctctattggggttctcttccacagcattaacaatcctttctgtagagtagcatgtgtaatgagccttaaaggtctttatgaccccttgatctggaggctgacttagagatgttgtatttgggggcatgtatacctctttgttgttgaattcatggcattctgggtggccaggggcattgtccagtattaaaagaacttctgagtaccttgttcatcataaacactcattaagtgttttaatatattaaaaaaagtcctttactggcaaggtactttctgactccaggaacaaaatatcaattgaaccaattctgaaaaagagttcttgtccagaccttcttgttgtacaaccaaaagactggcagctggtgtttaccttttcccttaaggcccagaggttagcagctttatagataaaggcaatcctaatcataaacctgactatatttgtagaaaactagtagagttagcctacccctttttgccttaaatcctggtgcttgattctcttccttaatagtatcctttgtggaaatttttccacaaattggccaagaatattttggtatttttttcttacagttccgagtacttagctcatagtaaacactcattaagtgttttaatgtataaagaagatacttaagtccttcctactttatctaattcgtaatgtggagagaaagggggtcataaaggagtgtagaaaacctaaatatctttttttttctgtgtctaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccaggtgatttaggtttgaaaacttgaacgtggtaggcatctgtacagatctgcttctaagtagtgcatgtaagaggtcttccttggaaagcttgtgaagaacaatgttgagttgctggcaatacttgcctttttgtggtttagtttatggattgaatccctctctgggtgaagactgcctttgattaggatgtgtaaacctactttatgatacacagaaaggttggggaaaaaagaaaaggtcacagattacacaagtatttatataaagagatataatgtggatcacatatgttacagattttctggtagccatgttaaaattaagatacagatgaaattaatattttatttaacccaatatattataatatgacaacatttaatatgaaaactattaatgagattttttttattagtactacgacttcaaaatccagtgtggattttacaagcatatctcaacatggacatttcaggtgtttagtggctactgcactggacagtgtagctctcgaatgttttaacagcttttaaacatgagtcagcacgcatttagtttctgtatctattggatactccaaggaatagtggagatagagggcagcatcccctgaagttgactctttccaagaggtgtggatgtcctaatggtgtttaattttgtgggagttgcaacccattataagaatgttgaagtgttctgggtttgagttatttattttattttatattttctttttctttctttctttttgttttttgggacggagtctcactctgttgccaggttggagtgcagtggtgtgatctcggctcactgcaacctccaactccctggttcaagcggttatcctgcctcagcctccctagtagctgggattacaggcacgcgccaccacacccagctaatttttgtatttttagtagagatggggtttcaccatgttggccaggatggtctcgatgtcctgaccttgtgatctgcgtgccttggcctcccaaagtgctgggattataggtgtgagccactgcacccggcctttattttatattttgtttttctttcttttttttgagacagagtctagctctttcgcccaggttggaatgcagtggtgcgatctcagctcactgtaacctctgcctcctgggttcaagcaattctcctgcctcagtctcccaagtagctgggattacaggcacccgccaccacacctggctaattttttgtatttttagtagagatggggtttcgccatgttggccaggctggtctcaaactcctgacgtcaggtgatccacccacctcggcctcccaaagtgctgggattacaggcacgagccactgtgcctggcctgtttcagttgttttagatgaaagaatatatgtttaatttttaaaaatggaccttgaaaacaattagccacaatggggattctcaaaacaaggactgataattacagtcaacccttgagcaacactacgttggactgtgcaggtccacttacatgcagatgtttttcaaccaaagctggaaaatgtggtattcaagggatgtaaaacccacacgtatggagggctgacttttctggtataggtgggttcctcaggaccaactgcaagacttgagtatgtgcggattttggtatactctgggggtcctggaaccaattccctacatataccaaaggacaactactgtttttagttgtaaattcttttatttatttttttaacttggcgttagaaataattcccacaaaaatgcaggagtatgtgagcagtaaatagcgtaatgtttgagggagaggcatattaagggagtgactaacttgtggcatttgcttctgtcgtacaggaaggcaaatgagagaagggcatacttgggggtgggggtggtttttgtctcttctgacttgtacaaaagaaaaatgtaagtcatgagctagcccaattctcttttagtttacgctgagttaaaagttcagggagtcatctttcttagttctaatacatgttctgtttttctcctttgagaaaattgcatgtattatgtcccagtaagaatgacaggccaggcatggtgacttaagcctgtaattaaggctggagcaggtggatcacttgaagccaggagtttgagaccagcctgggcaacatggtgaaaccccgtttacaaaaaaatagaaaaattagccagatgtggggtgtgcacctagttgcagctacttggagggtgaagtgggaggatcacttgagcctgggaggtcgagactgcggtgaactgtggttgtggcactgtactacagcctgggtgacagagcaggacccctgcccacctctgccaaaaaaaaaaaaagtatgacactcaacaattcaacaatgacttaaacctcactgggttgtttcagagatgctggaaacttttctagtttacaggaaaatatttttcagctaatactaggtgttggacttcagggaaaggacccatgattgatgggagaggagctttccagagtgtatgtttgcagctgtccagggagcccagtgacttcactggtaagatgccagggtctggtgacgatgttgttaccattatactctgcccagggtcagtagccgaagtacaagttaaagacttctcgggctcttcagctccttctcagcctcttagaacattctaagagaagcaggaggaagatcttgaggaaattgggaaacctgggttctaagcttgaccctgggcagtgagataaagaggtcagttttctcagctgcaggacagaatggtacctgctcaacctgcctcacaggtttcttatggggctcagatgttaagacaatactgcagatttaagggaactcaaggaattctaggaaaggtttctgtcaaaggtagctgatgttcttgagcctttcacgtatacccagcccctcccatgtgtggtgaactctctctgctttccacttgtgattcagctcagggctgtgggcctgtattctcgaatggtgaaacaaggatgcctggcctacagcagagagcattttttctgtggtcaccagcaaaaataccaaccttgtgattaatgagaaagtaaactaggatatatatttttctatgaagaaccttaagaaataacccaaacttgtagcttctgatcaaaagtaattttgttccttgaaggaaataatcagaattatgaaaacctaagattgtttatggacagcattataactagggacaatttggcaacagaatgttaagtaaatgataggagagctataccatggaatatcatgtaccataaaatataatgtttatagaagactacttaatggcaaagaaagataactacagtgtctgaaatgaaaaaaagcgaagtgtaaaacaggtgtaaaaaaaagtgtaaaaagaatggccttaaatatatatgcatagaaaaacactggaatgatataaatgtgacagtgaaggtaggtaatagcagaaaaaaattatgggtaatttttttttcctgagacggagtcccgctctgttgtccaggctggagtgcagtggcgtgatctcggctcactgcaacctccaactcccgggtccaagtgagtctcctgcctcagtctcctgagtaactgggattacgggtatgccccaccacgcctggctaatttttgtattagtagagatgggggtttcaccacattggccaggctggtcttgaactcctgacctcaagtgatccacctgccttggcctcccaaactgctgggattacaggcgtgagccaccgcacctggctgggtaatttttttctgtatgcttttccccactagttcttctaaaacaaacattttgtaataaattttcaaatggtgtgtttcctaacacagtgtttcacattgctagttgcatgcataacccagttgataaagcatcattggaaaagtgctgtgatagggtcaggaagaggttggtttggtttgagaactaggaaacacttctggttaaagcagcatttgaaataggctttgaagagaattaaaattactttagtcttaactggatgttgagtagattattttttttctgttgctccagaattggccattagggcccaaagctgagactaaagagctgttaaatgacctgtggtgtaatgagaatccctaagaggtgggaccagatacctcccgccagggcttaccaaaaggtcacagagctgtccctcctaccacaaacattagctcaacccttccctggcttataaagaggatcacataaggaggggggtagcatttgaagtgattccgtccccgtccgtggaggagggtggggtaggatgtggctttgtcatttaagccaagcaagagggtcttccaagagaagtatttgtatagatggagaatgcttccaagaaagaagacaaggttgaacccctggttagacagctgacttgctgtctatccctgactgaatagaaattaatgaagaagagatgtgggctgggtgcagtgactcatgcctgtagtaatctcagcactttgggaggccgaggtgggcagatcacttgaggtcaggagtttgagaccagcctgaccaacatggcgaaaccttgtctctattaaaaatagaaaaattaaccgggcatgatggtgcgtgcctgtagtccgggaggctgaggcaggagaattgcttgaaccggggagtcggaggttgcagtgagccgaggttgcactctgtattccagcctgggtgatagagtgcgactctggagagagatgtggcggggcagggaaagagtagctggagcatctgaattccccgtttatatacaagaaagttatgacttgctgtggtttaagagggttttgcaaaggcctgagcttttgggctagtaccccaccaagaaggcccttgttgcatgatgggtggtaggagctagggtggggctggaaggtcaggccagagctggatttcctaccccaacaactgtctagtggagatgacagggatgtctgccacctagagggccctctccacattccctagtcctttaagccatagaccttttggaatctgtgaggaatggagaaaatgggctgcaaatggacatgtgatttaagcattaatgtgttgagttgttagtaacggtgtctgtaaagatgtgaaaagtggtgaaacatcattaagggatgtcttaactgctatatgggtagggagacttaatatttaggatggaggcaatgattggaggagcagtttcatattaattcactgagatgccatttctcaataatcagttaaaatagcttggaggtttagaaaggaattgactagccaaagcagtcctaagtaaggtttagcactgatatgtttatttaacagtttttaaaaactgaaatataatacacatacaggaaagtacatgctgtatcataggcgaagagctccaactttcccaaactgaacacaaccatgtaaccagctctcagacctaaatagactgctgacttttaatgtaggaccaaagaattgtatagttgtagcctgatgttagattttttttttttttttctgagatggagtttcactcttgtttcccaggctggagtgcaatggcgggatcttggctcaccgcaacctctgcccgggttcaagtgagtctcctgcctcagcctcctgagtagctggtattacaggcatgtgccaccacccctggctaattttgtatttttagtagagacggggtttctccatattggtcaggctggtcttgaactcctggcctcaggtgatccgcctgcctcggcctcccaaagtgctgggattacaggcgtgagccactgcacctggcctggattttttttttttttttaagagacatggtgtcactgtgttgcccaggctggtctcagactcctggcctcaagccatcctcctgcctcagcctcccaagttgctgggattactggcatgactaatgttgaatttttgactgagatggtttcacttcttattgtactggatcataaaccgtatcgtcactaaattgtctgaaaagctattccaaaacaaagtttaatacattcagtcccatcttgcaggaaatgattgaaattactctcatgaagtcttgtttcccacaaaataaacttttatggaaccttactgtgtggctgtaacagttaagtggcaacgatttaacttgtgttgttgaagttaacttacagaaaagtatgagtgtactattcactgaatttttatatactgaacacatcttgtataactagtcacatgtagaggcaaaaattaagaatacaccaaaattccccttgcagtcctttcagtctctagtttacaaagggcacttgttatgctaaatttttatttttctgagatggggtatcactgtcacccaggctgcagcacagttgtatgatcatagctcactgcagccttgaactcctgggctcaagtgatcctcttgcctcagccttctgagtagatgggactgcaatcatgcgccaccatgcccaactaatttttttttttaagtttttgtagagacagaatcttgctgtgttgaccaggctggtcttggactcttgggcttaagcaaattccttgccttggcttccgaaagtgttgggattataggcatgagccaccacacccagttcatgctgacttttaattgcatagataaattgtacctgattttgaatttacataaatggaatcacagatatgtacactttttttttctttttgagacagagtcttgctctgtcgcccagactacagtgcagtggtgtgatcttggctccctgcatcctccgcctcccaggttcaagggattcttctccctcagcctcccaagtagctgggactacaggcacatgccaccacacccggctaatttttgtatttttagtagagacatagtagagacatactggccatattcaccatattggcaaggctggtctcaaactcctgacctcgtgatccgcctgccttggcttcccaaagtgctgagattataggggtgagcaaccacacccggcccagatatgtactctttagctgtgagtttcatccatgttgcaactggttgtgggtcattgattcctgttgctttacagtattccattgtatgaatgtaccagtgcttattcattatactgttaataggcatttgagttgtttccagtttggggccattgcgaatagtgctgctattatcttttggtgaattaatttcccttggttatcttcctaggagagggattgttgggtcatagggtatacgtatgtttatctttgagatgctgccagtttttctcagtggttataccagtttacacttccagtggtgtacgatggtttgggttgtttcatatcctcatcaataattgtattgtctttcattttagccattttggggtgtatgtagcagtatctgttgtggttttaatgttcatgtccttagtgactgatgaagttgagcacattttcatgtttactggcctttggatatcctttttcttgaagtgtctcttcaggccttatactcatttttcttagggttatctacctttttcttgtttacttgtagcagttctttatataggccacatatgagttctttgtctgaaatatgtattaaaattattttctttgagtctgtgatttgtctttgtactcttaattggcgtcttttgaataacagaaaacttaaattgtaatgaagtataatttactgactttattccattgtgtttaatgcttgtggcctgtttaagaaatatttgcctattccaaggtcatgaaggtagtatatgtttcttttctaaagttgttttacctttcacacttagatttgcaacccatctggaattttgttttgtacatggtataagaaggggaagattaattttgttctgtgtggatagccagttgactcagcatcattttggtgaaagaaaattcttttaaattgtattgccatgttgcctttctcataaatcaggcatccatagtatatgtacagatccgtttctggatactctcttctcttccattgatctatttatctgtccttgtgtcttaattattgtagctttataataggctttgatagttggtagtgaagtccttcaactttgtctttttggattcttggcttttcttggatcttcacatttctatataaattatagattcagctcatcagtccaagctccaccccctgccccacatacacaaagttctactgggattttgattgggattgcgttgaacctatgaatcaagttctggataatggatatgttgacaagtcttccaattcaagaagttgatatatccctttgcttatctggtctttaaaaattttcttagtgtttgtagatgtcttgcagattctttaagtttatctctaggttttgatggtatttaatgctattgtaaaggagttttttgtttgtttgttttttagtgccattttctgtttgtttgctgctgtgacagccctatctagtgttggctccagaagtagatatttcaggttttggacatttgagtccttcttatgtgcaaattgtttgaggtaacctgtctcccaaatagtctatagttttgagatgtgagttttattgcttttgttcatctgtgagttttagaggatatatggagagatttggatctaggcaactgccagtttgctataggaaccaggaagtctgattttgctgatcttgtttgaagaatatacatattctgtctcatatatacatacatacgtattgtgcatttgtcaaagtgtatatgagagagaatatacatatgtgtatttatgtgtgttttcaatatatatgttgacaaaatatacacaaaaagtgtttttgcctcttagaatgtctaaaattgagaagactgaccttaccaagaattggcagggatgttgaataactgaaactgtcaaactgctggtaggaatgcaaaatggtacaactatttggaaaacagtttggcaggttcctaaaaggttaaatgtttacctaccataagacccagtggttccactctttttttttttaataagcttacattttagaatagctttcaattaatagaaaagttacaaagaagttacaaaagttaataaaattaaaaactttacctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgagaggcggagcttgcagtgagccgagatcccgccactgcactccagcctgggcgacagagcgagactccgtctcaaaaaaaaaaaaaaaaaaaaaaaaaaactttaatagaattaataacaattaatagaaaagttacaaagctagcatagagaattcctgtatatcctgtacctaatttcccctattttgctaacaacttacattattattgtgcatttgtcacacctagtgaagcaatattgatactgtagtctgtattttatttggattttcttagtttttacctaatgtgctttttctgtaccaggatcccacccaggatatcacattattcatcatgtgggctcctccagactgtggcagtttctcagacttcccttattttcgattatgttgacagttttgagtagtgttggtcacactcaagagaaatgaaaccatttaccgtatacaaacttaacacaaatgttcatagcctctttatatataatagccaaaacctggaaacaacccagatgtccatcaatagatgaatggataaacaaatgcaaaggagtactgctcagcagtaaagaggaataaactattgttgctactacaacatggatgaatttcaggataattatgttcagtgaaagaagccagacaaaagagtatataccacataattctgttggcacagaattctatcaaatgccaactaacctccagtgacagcagggagatcggtggttgcctgggcaagaggactcagaggtaggtaggaaaggatttcaaaagggtattaaacttttggggcagaacttgacgataagtggtcaaataatgaaataaataaacttttggggaagatggatatgtttattaccttgacttttggtgatggtttcgtgggtatgtatacataggttgaaacatatcaaattctacactttgaatacatgcagtttatatgtcagttatgtctcaaagctgttaacctttgtaaacatagttatctctgaatggtaggatttaaatgcatatatttgcttttatagggttttttgcttttaaaaattttaaccagcctggccaacatggtgaaaccctgtctctactaaaaatacaaaaattagccaggcgtggtgccatgcacctgtaatcccagctacttgggaggctgaggcaggataatcacttgaacccgggaggtggaggctgcagtgagctgagatcatgccactgcactccagtctgggcgatgacaagaacgaaactccgtctcaaaaaaaaaaaaaaaaaaatttaaaaagaggaatgtaaaataatgtatttaccaccgatctttaacaaatgttaagattttgatatgtttgattcagacctttattcagacaatataaacatcaaataaaagttttgcacttaagtgtactcttttcctcattttcctagagataactctcctgaagttggtatatttccttcccatccgtgtttttatacttctctgtgtatgtccataaacatcgttttacatttttatgtaaataaaacatacactgaggaaaatgcacagtttaaagtatataactgggtaaattgtcacaaaacaaatacactcatgctctcaagctcaaatcaagaaatagaatgatataagcaactaagaagacccctcatgccgcctcctgattgtcatatgttttaaatctttatgcaaagaatatgacattatcttcctggcatttgcttttctccatgtgtcatatttataatgtgtacatattgatagttatttgtaagtaaaatcaatacattttaattgctttgtagtaatattttacataaatatatacaatattcctcttggtaaatgtttaggtgtatattttttgctgtatttaggtaaatatatattttttgctattataaacagtattttggtgaacatccttgtttaagtctcctgtgcccacatcacaagagcttccttgagtatgtacctagaagttaattgcagagtttggtatattgtcttcacacttcaagttgctgggtactttttcaaagtgcatttaccagtttataatcctgctaggatttcatgagttttcagtcacattccatgtagactctagatgttgtcatacttcaaaattccagttgatatagctgtaaatccaacttgattttgttttctttatattataaaatattttctgaagttaaaataatacgtgtagcatatatgatctggcatcaacccagagtaagtttctagaattgtgtcccagggttctttccctttatgccattctgtctgctgtttcttgacattccatgcatattatataattaaaatcactgacagatgaagttgtgcaatgaatgctcttctgctacatagttgacaactaaattgactgtcttcctagaaaaaattattttattcaaagttggcttggttgtcacttcagaaactttataacactgtcctgcctccaatgttctgtagtctgtcaatctgtgagatgaagcaaggtccttcttggctcttcgtgtttatttgtggatccatcatgtggtggtgtaaacatatacattcttaaaatgggaggatagggtacagttttgaaaaaacattgtccgtttcataataaacccaaacaaagatagggtacaggctctgaatgcagatgacctgagaacaaattctggtcgtgctacttacttgctgtgaccttggcttacactctgagtttaaatttcctctttagacacataggtagaaatagtacccatttgtaggggttttgtgaagcttaaataagatttgtattgaatactatctacaatgatgcacataactgcacttactaaatggtgatagtgattgtgatagtgtgggtatataaagatgcagttgtgagagcgttggctgaggtcatatatatatatacacacacacacacacacacacacacacacacttatattttaaagagttgaactaggttttctgtttatactgtaagtctcttgaagaatgtgtaaggactaggtcttaaatatccttgggtttcgtttcgtttctttctttcttttttttaaagatcttttgaaatccttggatttctaatcctcagtattgggcctggtgcatgttaggtaacattatacaattgcttaatgaatacattctctcaaactgggtgcctaagctgaaaaaggccctcattttgtgttcaaattgtactcccccccacatttggtactgataatatctaggaatttacttgcagttttgtgtgtatgtatgtgttcacaatcagtatttatttagacttcagtaatttttagtgattacttagattatcattgtgttttgtttaattcttggactagtttgatggacttttccaaattgttaaacatagaatatatggaaacttgcataaaacacctgtatattttaatcagttatacagcagacacccacataaccactacccaggtcaagaaatagaatattacagctgggtgcagtggctcgtgcctgtaatcccagcactttgggaggttaaggtgagagggtcacttgagcccaggagttcgaggcttcagtgagctgtgataatgctgctgcactccagcctgggagcaagacccatatttttatgtggttaggagtgacgaagaggacgctgggagcctcccgaggaggccagtccctttccagcagcccctggggccgtcccagggtagggagtcttagagccccagggtcccacccagggtgtgtgtctctctcccggtgggcttccccaggcatcagcaaggccactgcttggcggaggcttgccggcagggactcagaagcagcgaggctgaagaggatcctgggagcctcccaaggaggccagtcccttcctggcagcctcccgggctgtcccaggggggcattgaggggggagcggggcggggtggtagagttccaggctcccatccagggtgagtgtctctctccccggggggagcttgtttccagtcttaggggaggggttgtgagtgaacttcttagcatttctcctttaaatatgctgaagttgtgaatgttttttatctgattaagaaagttcttttcagactttgccaagaggcttttaaaaaaagaaaatctgcaggatgcagtggctcatgtctataatcccagcacttggggaggttgaggtggttagagaccagcctgggcaatgtagtgaaaccccatctgtacaaaagtatgaaaagccgggtgtggtggcacgtacctgtagtcccagttacttggggctgaggtgggaggatcgcttgagctcaggaggtggagattgcagtgagccaagatcgtgccgctgcactccagcctgggtgacacagccagacactgtctccaaaaaaacaaaacaaaacaaaaaaacccccaagaaaacaaacataaaatcatgaatgttattaaattatatcagcttttctgcatctattcatttaacctttctcctttattctatagatgtaggaataacattcaggaaagaataccaaagtaaagccaacttcgcattcctggaattaactcaagttgttcataatatattttatttagtatattgtttggatttcatttgtaaatgttgtcttcaggatttttgtattcatgcacataagagataagcttgtaattttctttccttaaaatatccctggtgtcagagtcgttagcttcttgaagcaaatcattagcttcttgaaaagtttttttttttcctcgctgttcttgagaagagcttgtgtgaaatttataatagtcttccttaaattttgatataattcattgctgaagccacttgggcctggagtgtgtttttgtttgtttttgtttttttgaggaacagtttttaaaatgtggattcagttttttgtttgtttgttttgtttgtttgtttgtttgtttgttcttttttttgagacagagtctcactatgttgcccaggctggagtgcagtggtgcagtcttggcttactgcaacctccgccccccaggttcaagcgattctcctgcctcagcctcctgagtagctgggattacaggcgcctgccacctgcccagctaatttttgtatttttaatagagatggggtttcaccatcttggccaggctgatcttgaacttctgacctcatgacccacccgccttggactcccaaagtgctgggattacaggtgtgagccaccttgcctgacccagtttttaaaatacaattattcaaatttctgtgtttttttttttgtttttttttttttggacagactctcgctctgttacccaggctggaatgcaatagtgtgatctcagctcactacaacctctgcctcccgggctcaagcgattctcctgcctcagcctcccaagtagctgggactacaggggtgctccaccatggctggctaatttttgtatttttagtagagatggggtttcaccatgttaggcaggctggtctcgaactcctgacctcaggcaatccacccgcctcagctttccaaagtgctgggattataggcatgagccaccgcacctggctcaaatttctattccgtcttctaagttttgctaagttgtgtttttctaggaatttctctgtttcatttaaattttcaaattcattggcataaatgtttatgtaaaagcttcttctgatgttttagaatttccagtttttattttatcttatttttttgtatttttttttagtggagacagggtttcaccgtgttagccaggatggtctcgatctcctgacctcatgatctgcccacctcggcttcccaaagtgctgggattacaaaatttccagtatttcttaacattacgtttgcttttttttgtctgtgttactaatcttttttttaaaataaacttttggctttgatccctccctcccccgattctgttatacatttcttttatgtgtcatttattttttttcctattgttttctttgggtttgatttactgtgtgttttttttaaacttattgagatgaaaattattagatcatcgtgtttttgttttttggggttttcttttttttgagacgtgatttcttgggctcaagtgatcttcctgcctcagcctcttgagtatcagggactgcaggtgtgtgccaccgtggctgctggctaatttttatttttatttttttgtagagatggggtcttgctatgttggccaggctggtcttgaactcctggtctcaaagggtcctcctgcctcagcctcccaaagcgttgagattataagcatgagccactgtgcctggcctactattgccatcttaacaatattaagtcttctaatgcatgaattggggattttttttgttttaatttatttcagtgatttcttacagttttcagtgtccaagtcttgcaatttattcataagtatatttatttttcatgctattgtaagtcaaactgttaattttattttcagattgttcattgctagtgtatagaaatagagctggtttttgtacatggatttttgtgtgtgtgatttcttaggattttttacatctaagatcatgccttctgggtgtatcatctataaagatagttttacttttttttccatctagatgccttttgtttcattttccttcctaattgtgctggctaaaatcttcagtacagttttgaatagaagtgaagagagcagacttcattcaccattaaatatgatgttagatgtgggtgtttttgtaggagccctttatcaagttgaggatttttttttctttttttctttttttttttttttttttttttttttttttgagactggagtctcactctgtccccaaggctgaagtgcagtggcgtgatcttggctcactacaacctctgcctcccgggttcaagcaattctcctgcctcagcctccagagtagctgggattacaggtgtgcgccaccatgccaggctaatttttgtatttttagtagagatgggatttcatgatgttggtcagcctggactccaactcctgacctcaggtgatccaccggccttggcctcccaaagtgctgggattacaggcgtgagtgaccgggcccggcctgaggatgtttttttctattcctagtttattgaatatttttatcatgaaagggtattggattttcatcaaatacttgtctgtgtccattgagatgatcatgtgatttttttttacttttgttctattaatattatattttattgattttttttcttataatgaaccaaccttgtcttcttaggataaaccccatttggtcatagtgtgtaatccatcttagatgccactgcatttagattaataaacagataggtctatgattttgttttcttgtggtctctgcctgattttggtatcagggaaatacttgcttcatgactgagttgtaaagtgttccctcctcgtctgctttttggaaaagtacatgtgaataattggtatttattcttttttaggtttttggtagaattcaccagcgaagctttcttgtcttggactattctctgggaagtttgttgatgactaatacaggctttttgttcattaaaagcgtatgcagattgtctgtttctttgagttagttttggtaatttctggctgtagaatttatttcacctatgttttctaatttgcaggcatataattattcatagtaattttttttttttttttttgccacggaggtttgctcttgttgcctaggctggagtgcagtggggtgatctcggctcaccgcaacctccacctcccaggttcaagcgattctcccgcctcagcctcccaagtagctgatattacaggcatgcgccaccatgcctggctaattttgtatttttagtagagacggagtttttctatgttgattgggctgatctcaaactcccaacctcaggtgatccacccacttcagcctcccaaagtgctgggattacaggcatgagccattgcagccagcccatagtaatttatattcttttttactttctgtaaggttggtagtattgtacccactttcatttcttcttggttaatctagctcaaggtttatcagttttgcagatgtttttcaaagaaccaacttctgttttttttttttatagtttttctagacattatttcgactttaatctttgttgcttcctctacttgctttgtgtttattttttctagtttctttaggtagaatgttaggttattgatatttaattactattgttattatttttttttttctgagacaggctctcgctctgttgcccaggctggagtgcagtggcgtgatcacagctcactgcagccgcgacctcccaggctcaaacaatcctcccacctcagcctcttgagcagctgggactacagttgtgcaccaccatgcctagctaatttatattttttttgtagaggcagggtctctcactatgttgcctgggctgtctcaaactcctgggctcaagtgatcctcctacctcagcctcctaaagttctgggattacaggtgtgagctacgacattcagcataatctttaacataggattttacaactttccaagtattattttcattgcatgccgtaagttttagtatggtgtgtttctttatctcaaagtattttctcattgccctgtgatttcttcttcgatccattgatgaagagtatgttgtttaatttccacgttttgagaattttccagttttccttctgttactgacttctaattctgttcttttgtggttgcagaatgtactttgtatgatttcagccatttcacatttattgagacttcatggcctaactaacatatggtctgtcctggagaatatttcatatacacttaagattgtgtattcttcttttgtagattgaaatatcttgtgtctgttctagttgttttatagtgttcaagtatacagtttccttcctgatactgtcatcttgttctatacattaaataaataaatgaaaataaaatcaatgatcagggtaatattagtgaaatggcagaataaggacctctgaaattcttcctacataaaaaccaatgagaacactagcaaaaaattgtcacaataaactttgtcagaactctggaaattaaaccaaaagcttgcagaaatctggggagtatttgtttaaaaactaaaaacaagatagctgaatcttggtaagaacaacattctttgtggccttttaatttgtattattttcataccttcctccctagctctactacaaccctgaaaaccagcaacctgcatcacagcaaaaattagcagcctggaagccactgaaaggacaaaacagttggagctcaagccccatcctcaacgaattgtcattacttgaccttttacatggttacacacaaggccccacttatgtggttgtatttgacctacctccgagctcaccaagtacagccagccatttcccatttcccagggaaagtttgtttaaaaaaaaaaatcagaggcaattattaaatatcccaggtgcctgaggcattaggcaacagtttaggaactcaacaggctaaccaaaaaagcttaaaaggctggggaatgaaatatgaggctttataaaaaactcaatatattcctgggaatctaggctaacctgcatgcttgaaagaaagcattagattagaaggccctaagctctctctcctggttaaccttgaggctctgtacaaacaagaagtgaagaatactgcagagttgtaaactgtctggctcagtgtggagggcatactgggccccttgtcaaagactgggaaacttactggttctaagcatgtaaggcagtttctgtccatcattgctgaaagtgagctattgatgtttccagcaatagtgttactgttgaagtatctgtttctcctatcatttctgtcagtttttgttgcatatattttggtggtctgtgttaggttcattggtgtttataattgttaaattttttttgatagattaacccttttattataaaatgtcctcctttatctctagtaacaatttttgtcttaatgtctgttttgtctggtaataggcacagttattctacctctcatttggttattatttgcagggtatacttttttccatcctttcaacctatttgtgtcttttgtgtctttgtttttttccttgagacttgagtctcgctctgtcatccaggctggagtgcagtggtgtgatcttggctcactgcaacttctgcttcccagttcaagcaattctcctgtctcagcctcccgagtagctgagactacaggcacacaccaccacacctgggtaatttttgtatttttagtagagacggggtttcaccatgttggccaggctggtctcgaactcctgacctcaggtgatccacctgcctcagcctcccaaaatgctgggattacaggcgtgagccaccgtgcccagccctatttgtgtctttgagtcttaaagtgtatctcctgttgtgcagtatatatttggatcatgcttttaaaaagtccattctgtcagtctgtcatttattcaagagtttgatccatctacatttaatataattactgataagatatacacctgccatttttctgtttgttttccatatgtcttgtgtcttttccccctattcttccattactgctttcttttgtgttaagatattttctagtataaaatcctatgacattttaatttccttgtttctttaatttccttgtctctttaatttccttgtcattcttatatatatgtttcttgttttttttaaagagacaaagtcttgctctgtcacccaggctggtgtcaaactcctggccttaagtgatcttcccaccttggcttcccaaagtgctgggattgcaggcatgagctactatgcctggcctcttttactatgtattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccttactatgtatttttaagttattttcttagcgcatgtgctgagaactagctttttttttttttttttgagacggagtatccctgtgtcacccaggttggagtgcagtggtgccatctcgggtcactgtaacccctcagctcctgggttcaagcagttctccctcagcctcctgagtagctgggataccaggtacccatcaccatgcccggctaatttttttggtatttttagttagagacaaggtttcgccatgttggccaggctggtctcaaacccctgaactcaagtgatccgcctgcctcggcctcccaaagtgctgggattacaggcgtgagccaccatgcccagctggaactagcatcttaatttatattaacaatctaggtcaaataataaccaattttattttcagtagtatacagaaactttgcaccagtatcgctttattttctcctcctcttgtgctgttaatgtattacaaatatgtctttttttttgaggtggagttttgctgttgttgcccaggctggagtacaatggcgcgatctcgcctcaccacaacctctgcctcctgggttcaagcgattctcctctcccagcctcccgggtaacggggattacagacatgcggcatcacacctggctaattttgtatttttagtagagacagggattcttcatgttggtcaggctggtctcgaactcccgacctcaggtgatccgcccacctcagcctcccaaagtgctaggattacaggcatgagccactgtgcccggccacaaataggtgtttatacatggtgtgcctatcaatacagatttataattaactttagctatcttttgtcttcttcctagctttaagatataattgacaaatgagaactttatggtgtacagtgtgatgttctgatatatgtatacgctgtgaaatgattaaagctaatatattcattacctcacatacttatatttttgtggtgagaacatctaaaatctcagcaagtacaactatagaatacattgtatagttgtatacaactatacaactatagttaccgtcattctatacaatggctcttcagaacttttttatcctggtcaaaactttgtacccttttaccaataccttcttatcccgcccccatttggttatcttttaaatctgataggagaaaaaaaagacaaaaatatactctctattatatttacctatgtagttatcttttttggtcttctttattacttcatgtggattaaagtaactgtctagcattctttcacttcactgggaaagatgctctttagtatttgttgtaggggaggtctgctagtgacaaactccctttttgtctaggaatgtcttaatttctccattcttgaaggatcgtgttggtgataaaaaattcttggttgagtttcttcttttaactccctcagtatgtcatcctactgccttctggctccacaatttctggtaagaaatcagctattaatgttattgaaaatcccttgtatgtcatatatgatgattgcttctctcttgcagttttgccctttctatgtctccggcttttgaccatttaatgtgtcttggtgtaggtctctttgagcttatcctacttgcagttcattggattttttgaatatgtagattaatgtttttcatcaacgttttctgccattatttcttcacatattctgtctctttccctcatctgctttgggacttctaatatgtgtatcttggtatacttgactgtatcccagatgtctctgtggctctgtagtttcttgtcctcagactggataatctccatgtctgtatcttcagccttgctgattgtttttctttttaaatctgctgttgagcccctgtagtgaatttttcattgcagttattatacctttcagctctagaatttctaattggttcttttttatatgtaatttctgtctctttagtaatattctctatttggtgagacattattctcatactttagttccttggatatggtttcttgtttctgtctttttttttttttttgagatggagtcttgctctgtcacccaggctggagtgtagtggcgcgatcaatctcggctcactgcaagctccgcctcctgggttctcaccattctcctgcatcagcctcctgagtagctgggactacaggtgcccactaccatgcccagctaattttttgtattttagtagagacagggtttcaccctgttagccaggatgctctcaatctcctgaccttgtgatccgcctgcctcggcctcccaaagtgctgggattacaggtgtgagccactgcacctggcccgttgttttgttttttgtagcaatggagccttgctatgttgcccaggcttggcttgaactcctggcctcaagtgatccttcgttctgggcctctcaaagtgctgggattacagagccattgtccacagccagatatgctatcctttagctcttcatacatattgaaaatagctagagtctttgtctaatacatgtaatgtctgccctttgtcagggaccatttttagtgattttttcccccatgaatgggccatacttgtttctttgaatgtcttataaattttgtcttgaaaattggacattggaaataatgtagcaagtctggaaatcgggttatccgtcctccacaggctgaagggttcttgtttgttgttgttcatttagtggctcttctcagctagttctgtaaacttcgcattttttaaatatgtggccactgaagtctctgcttggttatcttagtagtcggctaatgatggacagaaactgccttacatgcttagaaccagtaagtttcccagtctttgacaaggggcccagtatgccctccacactgagccagacagtttacaactctgcagtattcttgtattcttcacttgctgtttgtacagagcctcaaggttaaccaggagagagagcttagggccttctaatgctttctttcaagcatgcaggttagcctagattcccaggaatatattgagttttttataaagcctcatatttcattccccagccttttaagcttttttggttagcctgttgagttcctaaactgttgcctaatgcctcaggcacctgggatatttaataattgcctctgattttttttttttaaataaactttccctgggaaatgggaaatggctggctgtacttggtgagctcggaggtaggtcaaatacaaccacataagtgggaccttgtgtgtaaccatgtaaaaggtcaagtaatgacaattcattgaggatggggcttgagctccaactgttttgtcctttcagtggcttccaggctgctaatttttgctgtgatgcaggttgctggttttcagggttgtagtagagctagagaggaaggtatgaaaataatacaaattaaaaggccacaaagaatgttgttcttaccaagattcagctatcttgtttttattttttaaacaaatactccccagatttctgcaagcttttggtttaatttccagagttctgacaaagtttattgtgacaattttttgctagtgttctcattggtttttatgtaggaagaattgtcagaggtccttattcgccatttcactaatattaccctgatcattgattttattttatttatttttatttatttagtttttgagatgaagggttgctctgtcgcccaggctggagtgccatgcatgatctcggctcactgtaacctccgcctcccgggttcaagcgattcttctgtctcagcctcctgagtagctgggattacaggcacttgccaccatgcccagctaatttttgtgtttttagtagagacgggttttcaccatgttggccaggctggtctcaaactcctgacctcaagtgatccattcgcctcggcctcccaaagtgctgggattagaggtgtgagccaccgcgcccggccgattttatatacatatatttctggatgcaggatcttgccctgtcactaaggtagtggcacaatcataccttactgtaacctcaaactcctgggctcaagtgatcctcccatctgagcctcccaaagcacttgtataacaggcatgagtcaccattcttggcccatggtttttaatctttttaatacattaccaaagactataaatttcccgctcagcatggatttaagtgcattttatgagttgtgaagtctttttaattatcatttagttgactattttctaatttccattggatgtcttgttggtccctgaggaagtctgtagtacagctttcaggtatttgggactttctagttgtctttttgttatgaatttttatcttaattccactatggtcatagaacatcctctaacataattttagtcttcaaatttgttgaggcttgctttatagtctaacatatgctctactttgttaaatgttctagatatacttataaagacagtgtactgagcagatgttggatgcagtgttctgtttatgtctgttaggtcaaatttactaatttgatgtttcagattttctatattcttttttgcagggggaatatatgcttattctatcaattactaagagaaatgtgttaaaatctctagctttcgttatctcaattatctctccttttagggttgttgtttggctttattgatttttgtatgcttttattaagttttagaattatatcttctttgtagattgatctctcgatacttatgaaatgcatttctttctcatgtttttgccttaaagtttactttgatacctatttggttacaacagcatttttggtgcttgaatggcatatcttttctcatgtttttcaacctgtcaatcagtgaccttatattgtaagacatgaccctggaaagcagcatatagttgggatattggtttttaatccattctgcaaatctttatttatagttctgaaatagaaaaaaaatttttttgttgggtggaggggacagggtgtcactctgttgcccaggctggagtgcagtggcgtgatctcaggtcactgcaacctccgcctcctggtttcaagcgattgtcctgtctcagactcctgagtagctgggattacaggcgcctgccaccatgcctggctaatttttgtatttttagtagaaacggggtttagtcatgttggcctggctggtcttggactcctgacctcaggtgatccacccgccttggcctcccaaagtgctgggattacaggcgtgagccaccgtgcccagtgtaaaaatctttttttttttaagaaaaccacattagaagtgacaagttgtacccccaagcacggtgactcatgcctgtaaacccagcactttgggaggtcgaggtgggggcggatcacctgaggccaggagttcgagaccagcctgaccaacgtgacgaaaccctgtctctactaaaaaatacaaaaattagctcggtgtggtggcacgcacctgtaatcccagctactcgggaggctgagggtggagaattgcttgaactcgggaggtggaggttgcagtgagcggaggttgcgccactgcactctagcctgggcaatagagcaaaactttgtctccaaaaaaaaaaaaaaaaaaaaaaagacaagttctgggttctttaaaaaagtagtttatgatgagagaggatgaagaacccacccaacctccccctgtccaaacccatgtcgttttgttatgcttaaacctatcatctttactgagtcttctttgttcttcacgttctattcctttttctttcttccatggcctcttgggcaaacatatatttactgatctttttgtggctacacctagggattacaacatgttatcattgacttactagcgtctaagaaattagtgctttcatcacgtcctagaaaatgcaaggaccttacagaacttgttatcctgtccccacttcttttgtgctgttgctgctatacatttcaattgtgtgtatatttgaaccccagaagaaagtatcttatatagtcattgtttacttagacttagatgtgtcctcttttcattgttttttttttctctgaatttctcttccatgtgggttcactttccttctgctcaaggagcatatttaatgttaaagatgaatatttttattgtgagtctgctggcagtgaatgatctttatcttccttgaaaatctctttctcacgttcatttcttaggatgtatttggtggttacacaattcttgattggcatttatcatttcactctccatatactgaacatgttcaggcttcaatggttttcaaaagtcggtcactctcctttgaaacctttttctctcttttgttccttgtttgttttaattatccctttgctttctgatgtttcactcttagtttaaatatggttatcttttttcttccttgggagttcttgggtttcttgtatgtatagactggtatctttcattactcaatttacaaccattatctcctcatatatttcctgtgcctcatttttctttctcttcttttgggactctgtaattaaatatttattctactttctcattctatcttttgtgtctttgatattttctacttttttgtgtctcccttatgtattgtatacattttggttctatattctagttcactgcttttcccctattgtacctcatttggctgttaaactccatctttgaggttttaaattttagagatcacagcaggagattttgggccctggttttattctggttgtaggtactctggggggtcccagcttaatgtggatagactatcctattcatttcccttcttgggtatgttttgaacattgacttcttttcctttgcttcttggggccatagaaccatctttgctgagatgggcaaagagattccatcatagactaaaaatgacttttgtgttctggtattttgcttttttgaggtggggagagggtttcctggtttccgcttgttgttgtttgtttttgttttaaagaatttggactagtagttctatcctgtaagatttcagatgcttttaagatgatgtccctctttattgttagcattttttttcaggaagaaggttagtttgaataactttgccagcctttattggaggtggaactcaaatagtttaaaattctgttgtatttcaatatttcagtattttaattatcctctagtactagtacctatcgtgaagggttgctgtaaagattagtgtgatggtatgagtgaagagcctaggaacgtgtccagttgagtagtagtgaggagtgtttccaatcttcttgtatttttcaacgtttttattctcctgcataatattttaagagaactgctttttctttccacctcattattaagtttttcatttgtgaacattctaccaatcagaccatttgtcagctttatttaatcaaattttaacttccaaggtctccaatggatcgtctggtatctttgggggaattattatttattttaaaactttgttctcttggctttattatccttcatttcctcagatataagagttaaaatttttttacttttaatttttatgggtacacagtaggtgtatatatttatgggaaaggtataggttttatgttaaggttgctgccacattgaatctcttggttttctgaaaatatttggtcaatattggttgtaatttgtatttttaaatggcctttggtttttttgtttgtttttgtttttcagatggagtctcgctctgtcacccagactggagtgcagtggcatgatcttgggtcactgtaacctccacctcctgggttcaaaagattctcctgcctcagcctcccaagtagttgggattacgggcacccaccaccacgcccagctaatttttgtgtttttagtagagacagggtttcaccatgttggtcaggctggtctcaaactcctgacctcaggcgatccacccacctccgcctcccaaaatactgagattataggcgtgaaccactgcgcccagcctgttttgtttttttgagacagagttttgctctgtcactcaggctggagtggtgcaatctcagctcactgcaacctctgcgtcccacgttcaagcgattctcctgcttcagcctccctagtagctgggattacaggtgtgcgccaccatgcccgggtaatttttgtatttttagtagagatgaggtttcaccatgttggccaggctagttttgaattcctgacctcaggtgatccacccacctcaggtgatccacccacctcagcctcccaaagtactaggattacaggcgtgagccaccgcacctagcctaaatgacatttgtttttgaaatgcctgagaaatcttgtgtgcaaatgctgtgtaggtttatgctagcctgctctcaggatgggaaattacaagggagagatgtaatagtagctaaacttctggatatgtagtctcatcatgccacctggatgtcatcaggttcctggttcacaggtgaagtagtagaaccagcctgtctgcttctactgggctcctccaactcagtcattgtcaatagtcctataggtaactccttttatacacctctcaagctttgtaatatctggagcagctctcctattttgttaagtcttctttcaacatctcctccttccactttgaatccatctgtcttgctggtttttgttttttgagacagggtctcattcttgtcatgcaggctggagtcgagtggtgttggaacaggaattaaaagaaattaaaaaatgttaagcagaaactcagttgtatgtaagaaaacccaattccccctgaaaaagagaaagagctggagttctttaaaaattaactgcctgtttttctgtggctagtgagccttgtctctcctcctttcccaagcattgtgaagaccctgtttctctatctgtgcagctgaaagttcactagacagataaactcaagctgtaaaacatgtttttccttggaaagtaagaaatgatttaatgcatgtctcaattaattaaataactgtctttgtttctcgcttctgtaatatgcttccccctgcacagatctcccctgccccacgaaatgcttaaaaggtaacttaactctttgttcagggctcagtcctttggatgtaaatccaactgggccggtgcacctaattaataaatatactcctaaaccccatcagtctctctgattccttaagaaatcctgctacattttgatcactgctcattgcagcctcgaccttccaggcccaattgatcctcccactttagtgtcccaagtagctgggactacaagcatgtgccactacaccctcttaactttttcatttttttgtagagatagggtctccctgtgttgcccagtctgagcttgaactcctgggctcaagcgatcccacctgcctcagcctccaaaagcactgggattacaggcgtgagccaacgtgcccagcctatatttcttgtttttaggattctttgtgattttggcacaccaaggatatccttttttgttttctaatatggttacagattctttaaaattggcatttcagcattggaggatgaaggggaagctatagcatgtattcatcctggtatcttaagcctgtcatgagtatttttgcttgttgctagattgtcttccatattaatgacttaaatatgtcaagaggatgtatcaaaactacttaacagttcatatcctcttcttgccatgtaaacaaaactacatgcttcttgggtatcttcttgctataaataatactgtaatgaactttttttttttttttttttttgagacagagtctccctctgttgcccaggttggagtgcagtggcataatctctgctcactgtaacctctgcctccggggttcaagtgattctcatgcctcagcctcccgagtagctgggattacaggtgtgagccaccatgcccagctaattttttgtattttagtagagacggggttttgccatgttggagtttcaactcctggcctcaagtgatctgcctgcctcagtctcccaaagtgctgggattacatgtgtgagctgcagcgcctgtcctgtaatgaacattttaatgaactttttagtacatatgttttccaaattgggcttttttttctcagatggaaagcttattaatacttgcatttgcaagttaaatcttctcatgtcagaagtttatttgcaagtgaattcggtcagaatattatgccatcaagagaataaatcagttcaagtttcaccacatgcttgtcttaactgctttatttttcgtgagctttagtaaaaattagacctaattgtgttttgaatcctttaggaatagcattgtgattctgtgattgttaggattgtgattatgtctcaagttgcttttaggctaggattgctttcttcatctgccctctgctataaattttttgagaaaagtaggtcatgtgttctatggaattatctgcagtacagattttactgactgcattcccatggcagtacttcacatgtccctcggccccctctagtttctgttaattggtgattatagctagagacttgagcagacttaggtttgactttcttagcaagaatacttagtaggtgatactgagtacttcttttctagtgatatcatcaggcattgatggtcactacctagatacattagaggttgccaaatagcagttttctaattctctgtttttcgtttattagttgatatgctttttaaaaaataaacttaatttcatgaactatttggtaaaccagaagagaacgtttcttcaaataatcaagcacaattaaatgcttattttactttactttctttcataatattgagctgattgtctagcattctccaaagttgaccagtaagttgttttttagtatcattgtgaactcatagatttaatgtgtttgatgtgtcttgatccattgcagttacccttttttgtttagatggtccaatctttgaacagtggagcctctttacacctggtaggatgcctgtagcaaaaaggcagtaacaattgttgatcaggatgtagaaaaagtgaaactcttatacattgctaatgtgaaatgttgcagctgttttggaaaacaatttggcggttactcaaggttaatcaccatgtgacccagaaattcactccttaagagaaatgaaaacgaatgttcatacaaaaacttataggtgggcatttgtaacagtgtcgttcataatatcccaaatgtggaaacaatccaaatgtctattaactggtgatgaatggatgaacagaatgtagtacaggcatacctcatattattgtgctttattttatcacacctcacagatacagcgttttatacaaattgaaggtttgtggtaatcctgtgttgaacaagtctgttggtgccatttttcaaaaagtatgtgcttacttcatgtttctgtgccacattctggtaattcttccaatatttccaacttattttactgttgctttgctgctattgtaattgttttggcatgccacaaaccattcccatgtaagatggtgaacttaattgataaactttgtgtatgctgtgactgctccaccagtcggccgttctcctgtctctctcccactttcttgggcctccctctttcctgacacacaacaaaattgaaattaggaaaattaataaccctacaatggcctctaagtgttcaagtgaagggaagagtcacatgtgtctcagtttacatcaaaaactagaaatgatgaagcttagtgaggaagacatgtcgaaagctgtggtaggccgaaagttaggcctcttgttccaaatagtcaagctgtgaatgcaaggcacaagttcctgcagtaaactaaaagggctactcaggtaagcacatgaatgataagaaagcaagacaggctttttgctgatatgggaaagtttgagtagtcgagatagaagatcagatcagccacaacattcccttatgccaaaacttaatccagaggaaggccctaacactcttctgagaaggctgagagaggtgaggaagctgcacaagaaaatttggaagctagcagaggttggttcatgaggtttttctttttcttttcttttcttttctttttttttggttcatgaggtttaagggaagaagctgtctccgtaacataaatgtgcaagatgaagcagcaagtgctgatggagaagctgcagcaagttacccagaagatctagctaagatcattggtaagatggctacactcaacaacagattctcaatgtagatgaaaacagccttctcttggaagaagatgccatctaggactttcctagctagagaggaaaagtcagtttctggcttcaaagctttgaagaacaggctgattctcttgttacaggctaatgaaactggtaactttaaagttgaggccagtgcttaccgaccattctgaagattctagggcccttaagaaacatgctaaatctactctgcctgtgctctataaatggaacaataaagtcatgacagcacatctgtttgcactatggctaactgaatgtttaaagcccactgttgagacttactgtacagacaagaagggattcctttcataatattactgctcattaacaatgcacttggtcactcgagctttgatggagatgtacaaggagattaatgatttcatgcctgctgacacaagatcagttttgcagcctatggatcaaggagtaatttttactttcaagtcttattatttaagaaatacatttcataaggctagagctgccattgatagttattcctttgatggatctgggaaaaccttctggaaaggattcattattctagatactgttaagaacatttgtgatgcatgggaggaggtaaaaatattaacatgaataggaatttggaagaagttgattccaaacttcatagatgactttgaggggttctcactgcttcagtggaggaagtaactacacacgtggtggaaatagcaagagaagtaggattaaaagtggagcctgaagatgtgactgaatttgctgcaatctcatgataaaacttgggatgaattgcttcttacagatgaatggtttattgatagaatctactcctggtgcagatgctgtgaacatttttgttgaagacaacaaaggatttagaatttccacataaagttagttgataaagcagaggcagagtttgagaggattgactccaattttgaaagttctcctatggtaggtaaaatgttatcaaacagcatcacatgatacagagaaatctttcatgaaaggaagaatcgaactatgcggcaaacatcatggttgtcttaagaaattgccgcagttaacccagccttcagcaaccaccacccttatgtcagcagccatgcacattgaggcaagacccctccaccagcaataagattatgactcactgaagtctctgataattattaagtttcttttttctttttttgagacggagtatcgctctgttgtccaggatggagtgtagcagcgcaatcttggctcactgcaacctccgcctcccaggttcaggtgattctcctgcctcagcctcccgagtagctgggaccacaggcatgtgccaccatgcccggctaatttttttgtatttttagtagagacagggtttcaccatgttagcccggatggtctcgatctcctgaccttgtaatctgcccacctcggcactttggccaccttccaaagtgctcggattacaggcgtgaaccaccgcgcccggcccaattgttaggattctttagcaatgaagtgttttaaaattatgatatgtacttcttaaaaagacatcaatgctattacacatttaatagactataatacaaaaattaactttttttttttttttttgagacaatatctggctctgtcatccaggctggagtgcagtagtgtaatcttggctcactgcaacctctgcctcccaggctcaagccatccttccacctcaagctcctaggtagctgggattacaggcatgccgtaccagtccctgtatttttggtagagatggggtttcaccatgtagcctaggctggtctcaaactcatgagctcaagtgatccgcccatctctgcctcccaaagtgctaggaatacaggcgtgagccaccatgcctggcctaaaaacaacttccatgtgcactgggaaaccaaaaaggttgtgactctattgtagtattcactttgaggtggtctgcaactgaacctgcagtgtctccagggtatacccatatatatatccattcaataaaatgttatttggcaataaaaataactgaagttctggctgggcgtggtggctcctgcttgtaatccaagcactttgggaggctgaggcgggcggatcaattgagccagagttcgagaccagcctgggaaatatggcaaaaccctatctctacaaaaaatacaaaaattagctggatgtggtggcacacgcctgtagcttcagctaattagaagggtgaggtgggaggatggcttgaacctgggaagtggaggttgcagtgagccaagatagtgccacttgcactccagcctgggtgacagattaagaccctgtcttaaaaaaaaaaaaaaaaaagttctgatacaaactaaaacaatgatgaatcttaaaaacatgctaagtgaaaaaatttttaaatattgtatgatctaatttatgtgcaatatccagaataggtaaatctgtagagacagaaaatagattcatggttgcttaggggtgggagaggttagagggaaatgatagtgtcctgaaaaggacatgaatagacacttttcaaaagaagacatacatgtggacaacaagcatatgaaaaaagctttataactgatcattggagagagaaaatcaagctgggcacagtgactcatgcctacaatcccagcactttgggaggccgaggtgggcggatcacctgaggtcaggagtttgagaccagcctggccaaacatagtgaagccctgtctctactaaaaattacaaaaattagctgggcatggtggcaggcgcccgtagtaatttcagctactcgggaggctgaggcatgagaatcatttgaacctgggaggcagaggttgcggtgagccgagattgtgccactgcactcaagtctgggtgacagagcaagacttcgtgtcacaacacaacaaaacaaaaaacaaatgaaaatcaaaaccacagtaagttactacctcacaccagtcaggatggctacaattaaaaagttaaataatagatgctggtaagattgtggcgggggggaaaagggaacgcttacacactgttggtgggaatgtaaattagttcagccattgtggaaaatagtgtagtgattcttcaaagagctaaaaacacaacttccattcaacccagcaatcccattgctgagtatgtaccaaaaggaatataaatcgttttaccataaaaacacatgcacacatatgttcattgcagtgctattcacaatagcaaaaacatggaatcaacctaaatgcctgtcaatgataggctggataaagaaaatgtagtatgtatacaccatggaatactacacacagccgtgaagaaggagatcatgtcctttgcaggaacatgggtggagctggaggccataatccttagcaaactaacacaggatcacaaaatcaaataccacatgttctcacaactgggagctaaatgataaggacatatggacacaaagaagggaacaatagacactggtgcccatttgagggtgttgggtgcccatttgaggatgttgggtgggagaagggagaggatcagaaaaaacaagcattgggtactggacttgacacctgggtgataaaataatctgtacaacaaattcacgagtttactcatataacaaacctgcacatcgctgaacttaaaaaaaaatccccagagagtgactgctgaaaggatacaggtttctgtctatagccataccaccctgagtgtgcctgatcttgtctgaaaggatacaggtttcttttggggatgatggaatgctctaaaattgtaacaattgcagaattctagatgtattaaaaaccattgaattatataatttaaatatgtgaccaaggaggaaaaaatatgtgtaatgggtaacagaaggttaactttcttgaattacagagttttcttaggaattaatgagactaacaactgttttttttttttttttttttttttttttttgtcaaagggatgaggggacacataggaaaagactattctgcacttcttttagtcaacactaataaactcttctagatgttgtgaatacagatgtgaaaagtgcagatactgtgtctgctctcctgtagaaaagctatgaagaaatacggtggagtagaagcaaaagttgtccctagttatctttagggaatccaggacctcctgtgcataacccaaatccacaaatgccgaagtccctgatgtaaaatggtacagtatttgcatctaacccatgcatgtcctcctttatatatactttatctctagattacttatacctaatgcagtgtaaatagttatactgtattgtttcgggaatactgacaaatctgtacatgtttaatatggacacattttaaaaaatacttttgatctgcggttggttgaatccaaagatgtggaacccacaggtagggagtgccgactgtaatacaattttttttttttttggagttggagtcttgctctgttgcccaggctggagtacagtggtgcaatctcggctcactgcaacctctcctgcctcagcctcccgagtagctgggactatgggcatgtgccactatgtctggttaatttttgtatttttggtagagacagggtttcaccatgttggccgggctggtcctaaactcctgacttcaagtgatccacccgcctctgcctcccaaagtgctaggattacaggcagtagctaccatgcctggccacaatttcaaattatactcagcaatatgaagactgagcaatgggatgtgataaggaatgattaggatgggggcaggggttagtgattaaattgccgccccacatacaattgaggtctctctctcagaaagtagcatttaagctgaagactgaataacaagtagtcagccatgtagagaaactggtttaaggccagagcaggagtattaagcagaacaaacagcagggccttggcgtgggcctgaacttgggatgtttaagaggtacagggctttccagggggtgggaagtgttgaatggtaaagcacagataacataggggaggctattgcagtagttcaggtgagaagtgtgttggcttggactagtatggtaataatagagacaaaataagtggacagattttgtgtaaatttcaaggttaggttcaacaagacgattgcggggaatgggggagagaggagtcattttgtcttgcacactaatgtggatctgttttctaagatggggaacatgatggggaaaagagggacaattaacatgaaagatactcaatcttaagaacatatggtagactccttgtccttcagctcagaatcccatcattgatttaaacaatgggttctattgtttacctgtcaggttcataaaaagtaaaatttggtaagggtacaaagaaatagttctcatatcgttgggaatttaaatgggtgtggttcttgggtcaattttgaccaacagctatcaattttaaatgtactggattgtaaggtgtatgcatttaacaagtatgcttgcccaagtaagtcaagatcaatgttgagggatgttcattgccttatttgtagaagaaataaaaactactagaagcagcctgaatgctcatcagtagagaaatggttagatacatcatgttcatggaatggactgccatgctgccataaaataatgaagctgatttctttatacagatatggaaagaactcttaaaatacttgaaaaaagatgtgaaatggtatatttgaccatttgtgcatatattttttaaaagctatgtgtatacatgcttgtatacataaaaatctttgaaaggtatctctggggtagggaattaggtggagataattcttcatatcctccttgtttgaagttgtacatgctattattttattaactcttaatgtggggatgaacttccacattaagaaaacctttgggctggatgcggtcactcacacctgtaatcccacactttgggaggccaaggcaggtggatctcttgagcccaggagttcgagaccagcctgggcaatatgacgaaaccctgtttctacaaaaaaaaaatacaaaaacaaaaaacaaacaaaaaaaaacctagttggatgtggtggcatgtgcctgtagtcctggctgctccaggggctgaggtgggaggatcgcttgagcctgggaggcagagggtgcagtgagatgagatcacaccactgcattccagcctgtgtgacagagccagagcctgtctcaaaacaaaaacaaaaacaaaacaaaacaaaatttggccgttatcctcatagtagaatcttagaagtactgaactacttctcaatgtttgtacttaggtataaacatactcttaaaacatatgaccagatagcatcccagaaaggttttttactgaattattttcttaggacagctcatctttctttaaatatactattttaaatatatattgtgaatttctctgtcagagagccatacctagattttaatttcttaaaattatctgaatttttttgagtagtttacatttgctataaacaatttgaaaatttcagtaaagattcatacgtgctactacctgtagtctacttcagttgtttttgatgactttgagttctctccgtatttctgaatatcttcatgcagctgtcgtcttgtatacaacttactctctttccccagccacttaagtgttctcctttgtcatatgctgaggtatgtattttaatggctaagttcgtagtccattttgacagaatagttattttcagttttcgcaattgattgcattgtgacaggcatctttgtaggtaaatctttcttagcatttatgagtatttagagagattcttataatacagttaccaagttaaagagttttgatactttaaaaattcttgatggttaaattctcgatggagatactgtccttctgtgattgtctcagcagttggagagtcctgtctcaccatatacatagagaagaaaaaattacctaaatggctcatcaccattgaatattgtaactgtaatttttcagttttggtaagcagaattctcattttaattcccattttctttataagtagaacagttattttttctgttagtcttttaaatcttttcctatgttgaatttcctgataatcttttttacaactagggggtggcaactattgaaactgtcttaaagacaattgcaattccttctctgttgcaaagttgtatgtagtgtgttaattcattgtcatctagttcctaatgaataaaatcccttggggaaaatgctataagtcaggcttagggcagcagacatccttactagcaacttttaactctttaaaatgttaacaaaggctaggaatagtaatcgtcttgaattcacacctgtgcaattccatgtcgctaagtatagaggggagtgtatgtgcactgtatgtgtgaatctaaatttagaatagctgtgaaaccagcctgaacctacaacttctttagattctttcccgatgaacacagaaatacaaactaactgtaggtggtctactcattttcatgcagattgattgaagttagtttttaccagcaatctggctgacctggacaaaaatgtagcttaggtaacttttggttctgaccaaaaacgcagagaaggagagatcaaatttattttatgtaattttttttaaaggggaataacatttaaaactagaggcctctgtaaatagtctagagtttaaagcacttttaacatagtgcttagaaaagtataacaaaattatttttagagtattctttcttttagggtatttctctttctagaggacaataagtactggcttattgatgtaaaggaaaagccacagtataagaactcattcttaaagagggcaaaggatataaactgaaaattgatagctagtggcttttttttttttttgtatctgaaaaaaatgcttcaaccttccaatcaaattagattaacattccaaatgaggttaacaaatatctgaaaggcatacttacccaaggaaattctaactactgttcccctattaggccagaaaccaccttacatacttttgtatcctgatgtctgtttccttcctagcaccttgctcacaattatactttatcacttacaccattatcaggtttttctctaccactacaatagtaaacccaaaaagacaagagctgtaacttttttttttttcttcacttatatcctggttgcctagctagtgcctgacactcaagattctcatttattaagtagtgtattttttaacctatcatattggcagaacttaaagttgaatagtaccagtgttggtaacagtgttcacaaatgcataggaaatggtacaaaaggaatatctcaaactgttcattcagagaagagagtaggattgaggacaaggaacgctgccgagatgtgaaagtgatcatcttttacttattacttgcatgctattttaaaaaacaaaatggaattttacaatataattgtataaagggcatggtgggggaagggctcgggttttgaatgagatgagtgcttagcttggtcaaattgcttcacctgttttgtgccatggctttaatgcttgtaaaagggatataatgcctgtcttctccatggggttgttttgaggaatgtggtgatagttgtaagttgcctagttcttcctggacttcaaaaataagttttctgctctttttctcccttgaaaagtgagaatgtgatgtttcatttaaattttgaaagtcttattctgcatggtaccacccccatctgctggaatgtccagactttgccgctgaaagcttaactgttggttgtgtcttgatcacagtctgtattacttccactttggagaatgtggtctagtttccaaacgtagatatgttgcatcattttgtctggagaataaatgagtacatttatgggggtagagggaactatgcagagatcagcacttaaggcttctggaattagtactggggggagggtcttcctactgtgaaataaagggcttccgctaaatgccctccaaagtcactcttatttttaatgttttgtggcttatttaaatttatgatcctaatatcattttgtcattgaactcctgatgtcaaatttgaaatctaatatgggcttttatctgcaaaaactactcaagtttatttaggggatgttgtcaccttacccagtttaatagcttgcattttttttcttgttacaatgtgttcactgtaaaaaaaaaaaaaaaaaaaagcaaattaggaaaaaaaaattatgtcatcttactactgagaaataactattgttaacattttggtgtatctctccagttttttttttcaaacgtgtatattaaatattttgaacacactatttgcctcttttatctttgtgttaattttttatatcccttttcaaggctacatagcattttactgtgtagatagatgcattatgggatttttttttttttttttttgatggagtctcgctctgtcttgcccaggctggagtgcagtggcgtgatcttggctcactgtaacctcctcctcccaggttcaagcgattctcctgcctcagcctctagagtagctgagattacaggtgcccaccaccacgcctggctaatttttgtatttttagtagagatggggtttcaccatgttggccaggctggtcttgaactcctgacctcaagtgatccacctacctttgcctcccaaagtgctgggattacaggtgtgagccaccgcacccagcctgcattatgggattcttaacctgggtacatggatagaattcagggggtccaataatttagacaggtaaaaacttgtatcttcacgttcagtgatgtttaactgaaacgtagctttttttttttttttttttttttttgagacggagtctcgctgtgtcacccaggctggagtgcagtggtgcgatctccactcactgcaagctctgcctgccgggttcatgccattctcctgcctcagcttcctgagtagctgggactgcaggcgcccaccgccatgcctggctaattttttgtatttttaatagagactgggtttcacattgttagccaggatggtttctgtctcctgaccttgtgatccacctgcctcgacctcccaaagtgctgggattacaggtgtgagccaccaagcccagctgcatttcttttaactgtaagtttaggcaacaagtcacaatattagcaggacctaataatttggtatcaataggatgatcagacaattcatattgattcctttacaggcattgtacataccttgacatttatttactatttcaatattattactattttatatgttttgaaacatttttcttagaaggtttattggttttagcagactgccaaatggttcatgatacaaaaaaggttaacctctggcattcagttttcgtattttggagtttgtttaaataggtgcctattttatacacttataagaagtacctgaagttaaagcttttgcctgcatctgtgattatttggacataggataaatttctaaaagtagtatttctttatcaaagaataaatcttttgaagctttcaatgtttttgtcagattgctctccagaatgttgtaccaatttaccctctatatggaaataccctgccttcctgttttaaataactggcttttatattatgtagatgcagtcgtgattggcactgtaaagggtctccaatttgatgtactgtttaaggaacttctgcagaccccaatttgaacagtgtagtgtcaggtaaagtaatgtttcattgtgttttggttatactagttttactaaaactagttgttacctacaacctagatggcatgttgtattcaaggactctgaaccagagtcttcaggatggcgtgcttcagaactcccccataccataagcagtagattggatgatgctagccttgaatcagcagtcgtcttttttgctctccatgggtaagaagtaaaattatcgcctttgaaaataatatatgcacatagcagcgaaatcttagaaacacccgaatgtgaaattgactttctgctgaataagtagcagattgtggagagagtagtggggagggtgagggagttagtgttaagaattaaactcctacagcactttgggaggctgaggcgggcggatcacaaggtcaggagatcaagaccatcctggttaacatgatgaaaccccatctctactaaaaatacaaaaaattagctgtcgtggtggccagtgtctgttgtccgagctactcagggaggctgaggcaggagaatggcgtgaacccgggaggcggagcttgcggtgagtccagatcacgccactgcactccagccggggcaacagagtgagactgtgtctcaaaaaaaaaaaaaaaaaaaaaagaactcctagtatgatgggataggtttagtacacagtatggggacctgagtgcagaaaagggatcctttgctaacttaatgataaaacaggtctgagtagggttattatgtatgagtgtagacctgggtctagaaagtgtcccattgtgggagagaggtcaggggatcagttagtccctgtatttgagaccaacaaatcgagatttggatcttctgccttttagtagctttgtcgcttatggccatctctgagccttgtgtgctttctagtaaaaaaagacgggatggcgaggaatttgacaaggtggtctttaagcttctttcctgctttcttttgtggctgactttcttagctggtgccaggatattaagggcttttgtcccagagatttttatcctgcatgcagtagttacttgtttggtctatccttgctaaagggcctgaattacgcagaacactcccgtttgtaaaaaatcaaacaccaaattagaacttactttagtaaaatgtggggtatgttggaacgctgttgatacaaagctcatagaataggaaggaatcactggaaagctagggatactgaatctgtggcctccaattttgtctatttctgtctttcctctgctcatttcccagtgtgagtttcattatctccttttgcagagttgccagttatgagaaagggtatatgctcacatcctttggcatcatggacaatcaggaaatagttctttttccattatatacagttagaaaaatctcaaggaaagatacccagctagcttggcttaagtcatacccatacctggactggtctctgtagtcatgggaatgggtaattcttgcccagcttgagtcagatacttacctatgggaccatcactgtaaccagtgaggtagaatgctgcaagaagatgccattgtctttaggaccacttggatggcaattcaacaaaagcaattcaacaaaaacctggtgtcggggagatttttaaaaacattggggattcatgaattaggcaacagcaatcttcaaacatttgggtacaacctaatttttaaaaaaaatgtacaccgcaatgagataccagtttacacttgttaggatggccattattaaaatgtaaattgtcggcaaggatatggagaaattagaacatttgtgcattgctggtgggaatgtaaaatggtactgctgctggggaaaagagtgtggtgcttccaaaaaaaattaaacatagtgttaccatatgatccagcaattctccttctaggtatacacacaaaagaattgaaagcgaggacttgaacacatatttgtatgctagtgttcataacagtactatttacaatagtcaaaaggtagaaacaggaaacaacccaggtgtccatcagtggatgaattggatggatgaacaaaatgttgtgtacgatgcaaaattaggagctttaaaaaggaaacctagcacagtagtgcacacctgtagtcccagctactcgagagggtgaggcaaggaaggatcatttgagcccaggagtttggggccagcctggacaacatagcaaaatcctatcagtgaatgaatgaatgcatgcatgccaggcattggctcatgcctgtaattccagcactttgggaggcctaggtgggtggatcacttgagcccagaggttcagcaacagcctgggcaacatggggagacttccatctctaaaaatttagccaggctggtgacatgcacctgtggtcccatctactttagaggctgaggtgggaggactgcttgatcctgggaggctgaggctgtagtgagccattattgcgtcattgcatcccaacctgggtgacagaaggagaccctgtctcaaaaaaagaaaaaaaaaaaagaaattggggacgtactgcaacatggaggaaccttgaagacattatgctaagtaaaataagcctgatacaaaggaaaaatattgtataattccacttacaaggtccctacaatagtcaaattcatagagacaaagtaaaataatggtaaccaggggctaggaggagagggtagtggggaattagtgtctaatggtacaaaattttagcttagcgtaaaaaaagctctagaggtgaagagtagtgatgcttgcacaaaaatatgaatgtactaatgcctctgaattgtatgctcaaaaatggttagagtggtaaatttcatgtatattttaccacaataaaatttttagtacagggtaccccttgcatatttaacttggtatctacatttttattataagtgaaactgtagatttacaatagtagagagatttgagacctattatctattttaaaatatttaaaccagttctttaacagggggaaacttttcattatttcttttttcttcttcttctttttttttttttttaagacagagtcttgctctgtctccaggctggagtgcagtggcatgatctcagctcactgcaacctccgcctcccagtttcaagcgattcttctgcctcagcctctcgagcaactgggactacaggcacgtggcaccatgcccagctaatttttagtatttttagtagagaaggggtttcaccatgttggccaggatggtctcgatctcttgacctcattatccgcctgccttggcctcccaatgtgctgggattacaggtgtgagccaccgcgcctggcccattatttcttttctcctagtatttgtagtccacttctcccgctgagttttatcttaatgtaatattttgtgcttgagagtcttttttttttttttttttttttttttttttttttttttgagacggagtctcactctgtcgcccaggccggactgcagactgcagtggcgcaatgtcggctcactgcaagctccgcttcccgggttcacgccattctcctgcctcagcctcccgagtagctgggactacaggcacccgccactgcgcccggctaattttttgtatttttagtagagacggggtttcaccttgttagccaggatggtctcgatctcctgacctcatgatccacccgtctcggcctcccaaagtgctgggattacaggcgtgagccaccgcgcccggccgtgcttgagagtcttttgttgatcacatgtcatccttctctgtaacaacaaaagtacataaactgaaattttaaattatttcctgtgtctcaaaggtgataatgatgattgttagggcaattaaggcaatctaaatgttataaatcttgataaagttttattctttaataattgtttattggaaatgcttgttttgttttttgtttgagacaaggtacctgtcgcctaagccagagtgcagtggcgcaatcatggttcatcgtagcctcaacctcctcagtagctgggaccacagacaaacaccaccatgtccagctatttgtcttactttttgtagaaacggggtctccctgtgttgcccaggcagtcttgaactcctgggctcaagtgatcttcctgctttagccccctaaagtgttgggattacagatgtgagccaccacacctagcctggaaatagtttttaatgacataaattgaggtcttttaaaatctcatgtaattttaaggctgggcatggtggttcatgcctgtgatcctagcactttgggaggccgaggtgggtagatcacatgaggtcaggagttcaagaccagcctggccaacatggtgaaaccctgtctctactaaagttcaaaaattagctgggcgtggtggtgcatgtgtataatcccagctactcgggaggctggagcaggagaattttctgagcctaggacgtggaggttgtagtaagccaagattttgccattgcagtcaggacgacagagtgagactctctcaaaaaacaaaacaaaacaaaaaaacatgtaattttgtatgactgacttattgctggaatgacttggggttttttttgtttgtttgtttttttgagacagaatcttgctttgttgcccaggctggagtgcagtggcatgatcttggctcactgcaacctccgcctcttgggttcaagtgattctcctgcctcagcctcctgagtagctgggactacaggtgcacgccaccacacccggctaatttttgtattttttagttgagatggggtttcgccatgtctggtctcgagctcctgaactccagtgatccacctgcctcggcttcccaaagtgctgggattacaggtgtgaaccactgtgcccaccaacttggaattttcaacactgtatatatacattttgtttccataggtttgtgccctgagtaaacttgttcacataaaataagtagatggggaatgaactagttcatacaattctttgatttagttctgtgcaaaaaattagtcatgtattattatttttagtcatctactggctgatagttgcgttcattcctccttcatattggttgaaaagaaagaacggaaaaccagctaatttgtgaaaagacgttttacctagtcataccagacatggaattactcagtttcctaactataccaataatgctttatcaatgtagcttttttattttttatttttttttgagacggagtctcgctctgttgcccaggctggagtgcagtggcacgatctcggctcactgcaaactccgcctcctgggttcacgccattcttctgcctcagcctcccgattagctgggactgcaggcacctgccaccatgcccggctaattttttgtatttttattagagacggggtttcaccgtgttagccaggatggtctcgatctcctgacctcgtgatccacctgcctcggcctcccaaagtgctgggattacaggcgtgagccaccgtgcctggcccaatatagctttatcaatgctatatttttcagatgaggctgaatgcagtggctcacacctgtaatcccagcactttgtgaggctggggcaggcagatcacttgagctcaagagtctgagaacagcttgggcaacatagcaagaccctgtctttacaaaaatatacttcccaaaaaaattagccaggtatggtggcatgcacctgtagtcccagctacttgggaggctgaggtaggaaaatctcttaaacctggaagtctagtctgcagtgaattgtgtttatgccactgcattcccgcctgacagagcaagattctgtttctaaaaatccatctcaaaaaataaaaacagatttgagattactactatgtctgtccttcacttagacacaccttaattcagtatacttaaaagatagagaaaacttaaaatagtttttgtgcaacatttgtaggaaattaaaaaaaaattttttaagttagtttaaaaatacacctttgcagtcgggcacagtggctcacacatgtaatcccagcactttgagagcctggggtgggaggatcccttgagcccaggagttcgagaccagcctggccaacatagtgagactctgtctctacaaaacaataaaaatagttggacatagtggtgtgcctatagcctcagctgcaaaaacaaaacaaaacacacctttgccaacatgctatttaaaaatgatttaatcttaccatttgctttaagtatgttttgtcaaagccatgggcctatagatttaactttatttacagaaaaaaatttctactataatgcctcatttaatggagtcctgtttttggagacggggtctcactctgtcacccaggctggagtgcagtggcgtggtctcagctcactgcatcctctgcctcctaggctcaagcgatccttccacctcagccacccaagtagctgtgactacaagtgtgcacccaccatgcccggctgattttttgtatttttattacagacggggttttgccatgttgcccaggctggtctcaaactcattggctcaagctatccacctgcgttggcctcacaaagtgctgggactacacgtatgagccaccacacccagcctggagtcagtttttattgtcaaatcaattagttcagtcagactttcattttttcagaaaaagtctgactttatttttttctcaacattttagtaacattttcaagcatacataaaagctaaaagaattacaaagtgaacacctgtaataccacctagattgaacagtgaacatcttgtcatatttgccttatcacatatctttaaattgtagacattgctacagtttaccccaaaatccttcaccatgcatatcattaactagtattcaatactatatttgtttataacttttttgaggtaaaatttatatgcagtgaagagcacaaattctaaatgtgtcattagatccattctgactgatgtatcctcactctcatcaaaatatacacactgttagcatcacctcagctactttccttgtaccccttcctaatctacctgcctacttcctgccagaggcaaccacctgatttttttcaccatttattagttttgtctgctctaaaaattcaaataagtggaattatatacatatgtaacttatgtacggctttttccactcaccataattatcttattgttgcctgtattattcctttttattgctgaataatagtatggtatatgcatgtactacattttgttctgttgattctcacatggactgaatccacgtttgggtgattatgaataaagctgctatgactattcttgcacaggtgttttattagacatacacttttactcctcttagttgaattcctaggagtagaatttctgggtcataagataatatgtgttagttgtgtaagaaatgggcagaccatttttcaaagtggatgtaccttttctcccattgaaaaggaagaaaatatataagcgttttcataagtacaaggtggatgtaccatttacggtaatgaagctttgattgacaacatcaaatgttggcaagatgtggtacagtcttttaaattttagccatctagtaggtgtgcagtagtgtctcactgtggttttaacttggatttctttgactaatgattttgagcactttttgaagttcttattggccatttatataatccttgtgaagtgcttttcagattttgtgccttttaacaattgagatttcgttacttttcagttaagatttcttttactgatttgtcagatatggttgtgggtattttctcacatattgtggcttgcgtaattattttcttagtggtatcttgatgagcagaagtttttcgttgtgataaggtcagcttatcaactttctccatgatcattgctttctgtactctacataaagaaacccttgcttctatgtactccccctcccctaccaagttacaaagataggttcttagagaggctttgtagtttatacttagctttcacttttacgtctctgatatctactaaattaatgtttgtatataggtcagagtttattccctcctccccatatggtgttccagtgccatttgttaaaaagtttttccccaatgaattgctttaagtctggtatattgggattacacagatgtgcagatggccccagacttaggttggttcaactttggtttttgacatgatgatggtgtgaaaatgatacgcattcagttgaaattgtactttgagtatccatacgacctttctgtttttattttcattacagtattcaataaattacatgaggtgttcatcactttattataaaacaagttttgtgttaaattattttgccctactgtaggctagtgtcagttttctgagcacagttaaggtatgctaggctaagctataatgtgcagtaaattagatgtatttaaatgcattttccgtttataatattttcaacttacaatgggtttatcagaccataaccccactgtagttgaggaacatctgtatattaattttgtgggtatcactttttagcgctgttgagtcttccagtacatgaacatggtttaagatggtcttttttttcatttgcttgttttccgagaccgagtctagctctgttgcccaggctggagtgcagtggcacgatcttggctcactgcaacctctccccttcctgggctcaagcaattctcctgcctcagcctcctaagtagctgggactgcaggcgtgtgccactgtgcctggctaatgttttttgtatttttagtagagacaggttttcaccacgttggccagactggtcttgagctcctgacctcaagcgatctgcctgcctcagcctcccaaagtgctgggattacagacttgagccactgcacctggcctcaaatattttctttaatcctcacaaaacacctaaaagatggctactgttgcatctttaaagaagaaaagattctcagaaagacacagtggcagacctggtgagcagagcaaggtctgtcagtcatctaaagctgttgatttttccagcctgccacactaatggttttaacaggtatggcctgcattgagttggagctagtgaagaaatcctacaatggtagtgaaaatctttatctagaagaaacaacagattgaggaatgtctggataaggaggaaggtgaggtctgtggtgggggttgtaggggtgagggtagaattatactgtgtgtagaactccaagctcctggatgcatgtagccatttggtcttaaatgggtttaacagacctgttgctcaggcctggggtctttcagcttggggtgggaagattgtgttagttgtacacatcagtactgttcaaacttttgagatgggaactactttgtcgcccaggctggagtacagtggtgcagtcatggctttcactgctgccttgaactcctgggctcaagcaatcttcccaaagttctgggattataggcatgagccaccacacccgactgctcaaactttttttgcatacatatatattaactggggatcttgttaaaatgcagatctcaattctgtcggtcttgggtggggcctgagactcagtatttataacaagctcctggtgatgctcatattgctggtctgccacactgtattttgagtagcaagagcatagttgattctctcctcgtgagggatgggggtaatcatatgcacagtcaccctgattttaatgggtagaaaatggctgcttctagacatagatgccctcagattggggtatggggattatatagatatttggtgtaggggagaatagatacttaaatatggatgtttttgaaggaagcattgtgttttggtaactaatatgtatgggtgaagtctaaagtatatccttagcttgagggaagggtgaacatagagaagcaggaggggagtagtcaggggtaggggcagcaccagtatgggtgatttttgctaggcctttgccatgatgaacaaggctttgacaaacacagatagggagcaagcagaatatctacagccaggaggaataacgtggatggatgacacagcagcaaagctttaaaaaaaaaaaaaaatctccaaaggaaggagactgataattttcccttctaggctatgcctgagtgcctgtggacacagggtgtactgcaggaagttctgaacagctatttctgtggcagcattattctctcgaccctgccatgggaggtcccaggtgggcatgcttcccgtatctgcttgcttctccttgcaacaggggagaacaagcaggtggagtgctaccagctgagtccaggtttgagcagcctgcctggtgagtctgggcctgttgccctaccctcctttatgaggaagaagcccagtgaccctgggctcatgttggaaaaggaccgatgtgggaggagatggcaaagaggaaatggcggaagctccagaagctgaattttcttagtctttgttgctggagctgtgagtggccacagaaataagcattggtcttgtgcagcacctctgagagagggcctggatgttagaggcatcagtggccctcacggctgccctgtatcatgctcagggctcctggaagggcaagagaagcaatattgacagagctaggtgattaggtttcagagtttggtgtttctaatagggcgtaacgatacttcagagactgtttctcttggtttgtcagatgctgcttcgagagtgtttcctcagtctgtgcctacagttgcaggagggaggggaggagctgagccgctgtatctgttcatgactaatacccatcttgttgggatgagggaacctgggcacagggattatcctagtcagggcaggtctcactctggcatgtgggttgtgggccatgtcctttgaggtgtacctggaacagcccagtgactctcccccactctgccaacgcttaccccctttctctgtgataagctgctctagacaagcctggaacaccaggtgttgttccccagggtccaagtgtacagtatttttctgaaggttatcttgttcctcagtggtaaacactgctgtgtcagggtgctgctcaggggccacttggagcacagatttttgctagcaggactgtgaagctttgcattgggctgcaaagccagggcttgagccagcagctggagagagtccaggactagagtgtttttgggtttgggggtggagagcagggggagggaaagggaggggcaggagggcagagccacacgagcaggcagtcggctgctttggctctgctgtcggcggagaggacttcagtcgtgcgtgagggctgcttggccaccattgctggagaccggagggcgctgccttgcaacccagacttaacggcactgcaccgggactattccaagtagctgttgtgctgtctttccctgggaggcaagtctcctccctgtcgtcccctcctgctcctcccccgttctgtgagggatgatgccgctctctattgcacggctcagccggctgatgtcactggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcgggtgagtgccagagaatgagttggctggggtaaggggatgcatgggggtggtgaacgaagatatccacagcaacagttgttctgttcccctttgcatcactccccaccatacacacatacaacatggagctgttttgcaagagatggaaatgcaagctgtgagtgtggcaggacagatggctccacgtaaaggcaggcatggctcttccacttaccctgataaattccctggagttgttagtctgcacctggagtggccctgaggagggtccccaaggcgtggtggccttgtgcagaaaagatccagctaaccccctggtgcccaggcctgtcttggagatgatgaagcaaaacacttttaggtgggggaggggagttaaggggttgattactggatgaccagaattactcagtggttttaaaaaccagggagttatatgaagagtgagtggtctctgaatcatggcaagggaaggattttaacctcagatgaggctggataatgcactgagatatttggaattgacttaacatagggttcagagcattgatcctggaaaggggtaggcagggtgagtggggtggggtaactcccagctatagaatcttttttttttttccctttgtgttgagagtgaccagctggataaaagaagagccactcccctttaggatcccttgtcttcttggtagggttcagtggggacaaactaaagggacttcttggcagcccccccttaaattgcttctgcttataccttctgttacctgtttatttccctcttgtggtacaaggaggagggttgcctaaatacaagtcttggagtattcaggaagaaatgtgaacttaaacactacaggtatacttacaagctacatattttgctttatgtaaattataataaagaggtattggcagcagatactctaggaaaatgaaaaggtggtaaggggcgggggggagggggtggtacagccattcgctgttggtactgacagtgggaaacaccaagtctgctgtccttcccttccctccctggtccaggaaccggcagccatggcagcaaggtactgtcttgttgatttctgtggcctccaccctgtttggcgcaggtctttttttagaatgctttgcagagcctgggcccgttgtgtctgttaggcattttaatgcccagttgttttggtaaaaccccatttaggagaggggtattgaaattgttttatgtggatgtggatggggagagctttaccttaagtaactatctctgggttaagatagggtttcttgaagtactggccttctgctgactcaggtttttccagaaaggtcagcaactaccctgttcccctgggcaaggaagtatggtatcactgtttggtattctatgcctggagaccacggtactttgttttgtgtgttcttgacgccaaccttgggggcctatgaagccagcctcccctgtcctcacttccaccgtatctgagcaaaagatagaagaactcacacaggagatgggcacctgtctgtgggtgatcagtgtttgaccaaggcactgtctttcattggcatcaggttgaagtatagcccttctttggctctcattctctaagctacaatgctctttctgaaatacattataacattgggcccatagaaatgcaggtgtgccccactgggggcttggagagcttggtctgaaagttactatgaaattgagctattaaaagtagcttggatctagtcataatatccacagcttctccaccacctgaaaggcctgtgcttgtagctgtttgtctctgaaatagaaatggtttttcttttccactttccatcccaagcactttagtgataaatattacatgattttgtcgaccagggagggactgcagcctgagcctcagaattcataaggaccagaaccagagttgccccagcagtatgatctggctgtgtaggcaggttagtgtgggtatgttttcctttctgagggttgaggacacacccatccctaatcgtcatgttgcctttggttttggagctgtggtgacagccattgctcttctttccctgggctctgggccttcttggaaagcccacatgagggtactacctcctggagtaggatgcagccctcccaccagccagctgcagtgccagatcgtgcaccctcaccagcaatgcgggaacatgcagcccacattccagtgcctacactgcctttccgtctgaaaaccagctagctcagttgcttcagtgagggaggaggctttcaacagctctgggcattttcggagttatccttgcagataccctgttacactgttgtctctgtgtagagaccaagatgcaagcttattccttgagctctgcttggtgatatattgcccaaggcagctatggcatcacatctgaccatcttctaccactcttaagtaatgagcaaggttggagatagtagggctgttggctaaattcatctggcaaacgtcgagcattcgttgtgtgcagcactggaagtacaacattgattaagataaaattgttacctttaagaatctccgtggctatcaaaggaaaacaaatgaggaggtataccgagtgctgcatctgctatgataggggctttcattttttcccctaaggattttcttcattgtaacaacctttcattggattcttagctttaggctggtacatggataccattctccaggggccagagtacttctgctatctagatttccttggcctcagagtcctgcaagaagaccctgggatagagtctgtttttgagaattgtacctgcaaggcctgcatgggcttggatgtaacactttgtggggtccttctcttctagactgtgcctaccctgaggcactatcccttgatggggaggaagactttgggggcaagatgagtgttataagtgcgtttttctcataccccagtgctaccctttctcatgtccagggctacccttgtcctgcttgcaatgtcttaagatctgtagtggaacagaagggctgtggaaactgtcctcagtatcctggaatggggcatggagtgactaataaccaccatttatcgactaatttttgtgctaagtacatcacatgattttaatgcttgtacagatgaggaaataggctcatggaggttacaaagtgcccaaagtgacacaactcctggaaggctcagaattctaacccaggtctctggttacaaaattcatatgcttcctgttacacctgtggtcctgttagcagaactctaacatattgggtgagaaaacttaaagtaaccatatactactataggggctattcagctagaggtgatgtgctcccttgatgagatctctgaaggtgagggcatatggtagacagttccagccccatcttgatccctgagtctcagcttatcagctgtaccacccgctggatttgtcttcctgccttcccccttgcgactcttttgtgtgcagcattatgcagcagaagagtgaggtgactgagactactgtgggggacctggaaacaaggactctcttaatgatgccttgtacagaagcccagtgggcagaccagatgtgcagtctaaggttgccagaggacatgtctgttttttgccactcccctttagaagtctcttgaggactaacctgttcacactctggttttcttttcttttctttttttttttgagatggagtctcactctgtcgaccaagctggagtacagtggtgcgatcttggctcactgcaacctctgcctcccgggttcaagcaatcctctgcctcagcctcctgagtagctgggattagaggtgcccaccaccacaccgagctaatttttttttttaaagtagagacggggtttcaccatcttggccaggtgggtcttgaactcctgaccttgtgatccacccgcctcggactcccaaaatgctgggattacagatgtgagccaccgtgcctggcccacactctggttttctaccctaactgctaatcagtgaatggaatgttccctgtgctgtgtcacttgcaggctccccattgatctgcaggctacatcagcctaagatgagtggggagtcttaagcaattttcatctgaagcttcttccaaacaaccattctgaggcgacattcagaacgggattaggtctctcttatgtggaacatggacttcctcggcccaaccaggtctcttgtaaatcttcctcaactcccagttctccaatactatattcccagcagtacaacagtgcttggctaatggctgtctaatacatattttttgaatgaatgatgagtgctgagccactgtgtttatcctggttgttttttaactgcagagttcagacaaggtctctcccattcttctgcctcctgcttgtgttgatttagctggatggacagattcttcaaagatcagtatcttgggccctgtagcttctaggggacggtgatgtaattatacaaagttttcatcatacagtggagcatgagctgtattgtggagtcaagtagtctatttgggaaagctttcagtgcagagaggagggagaacctgggaagcagtgtggccagggaggcctcctaggtgagaaagaagttgaggtggttagtgacaggggcaggatgtgtgctgaccttacaagggacatgaatatgtcttttctacaggtaatggaacttgcctgatgatcaagactgggagttatactggggagaagggctgtgtttgtcactaacttgaacttgtgggatccacagtcggggggaagtccacactctgtttaccgccacagtagagatatggtatagagttgcagatttggggtcacaggcagagtggtctgttttcatacatggaatgaatgctactctccccccttcctattccttcagagagatcctgagtaagcaacctagaaccaaggatggtgatagggaagaagggttccaggtatacggccttatatcacaggctagaaataatggctcctggtctggattttccccgttagattttttcccccattagactattcccattagataacaaatatctgaccatcatgtcttggggctagtctctccttcagctaagctcaagctcagatggtcttataatgcaggcattcagtgccaggctcttgttgccattgctaatgctgccatcacactccaggtgcctttgtactcttggggaaggcttccgaaaatttgaacagtgactcagctgtaaaaccgacaggagctggcatagaagggtgaaagtagagaaaattaacaatcagtctaaaaatatcactgctgatttggtctcttataccctctgaggtagcattaatgaactggaaccctctgccaggtcctctcctccccatgacttccctgagagatgtctgtagctgatttcctgccagcatgtgaatggggatgggtacgtctgttctaggaagagcacaatgtcttacccatttttagaagataggaatttgctggacacttggacaccagagctggaggcacttggtaaacctcagactttccatgatcccttgtgttctggaggccaggaaagaacagagcaaagaggtcagggccttggccgttattggagattgactctaggacttctcaccacccctccccctcctctaatccatctaggttaatacttgacatttggaattatgaagttgtgtgccccatgatggggagtggactttgagatgagacactggcctgcattataagggacctgtcatttccactggattttagtttgtgtggcttaaagagaatgcctttccagttaggtatgctcgtggctttgaatataaatgggaacagtctaacgctagctattttgctcctttccttctgattcccagctggtggaaatcggtgctgcgtactcagcaaccttacatagggcaggtatggtctcatgagctgggagcaagacaggttttctttcttgaaatgaggtccccccacttccctttgtctttgctgctttgctgctttctttccattgtctttgctgctttccttcctttgatctgtagacactcagagaactgcctggccagaccctatagaggtacaattaggtcactctagggcatctgaccatgggtggcagtttccacaaaattcacttgttctgtgggttgaaggaaatatcaaaccagctggcaagttctaggcctcttgtcttcttggtatcttctagtcaaatttacagtatatcccttctgatttaatatttgcaggaaactgatgcatggagatgctgacatcccacgtgttaattctggggcaccctgatcctattctctaggatggcattgcccctttctgagccatcaatccaagtcctttccccgtttttctatgtggttggtatataattcagtgagacactctttcttgctcctgtacttgaatgtaggagtgtattgcagtggccctgaagatcccagtagagtctggggagggttgattaggacagagtgatttccaccctgcccctcctcaagcagaggagctttcttcaacctttttctctttgaagaaattgagactcagggaagaagtattgtcgcagatgtgatgcggtgagtcactggtttttaaacctctgttttggcgatgggctgggtagggatgagttaaggtttattcccctaaatctgtattacactctaagtcaacattgtgtccttaggctgggcgcagtggctcacgcctgtaattccagccctttgggaggctgaggcgggtggatcacaaggtcaggagatcaagaccatcctggctaacacggtgaaaccccatctctgctaaaaacacacacacacacaaaattagccgggtgtggtggcaggtgcctgtagtcccagctactcgggaggctgaggcaggagaatggcgtgaacccgggaggcagagcttgcagtgagctgagatcacgccaccgcactccagcctgggcaacagagcgagactccgtctcaaaaaaaaacaaaacaaaaaaacaaaaaaaaccattgtgtccttaaattgaatatccttgatagaaaagggtagggccttagcgtactggctctatggaatacgtactctctgtctttcagtagaattcagcagtcattgttcacctgctttttgccagatgttgagctaattgctattggagtaggatggtaaagattggtcttggtatgcttggttgagaaggcacaactttttacacatgtgggcctgcaaatatctatgcagatttttttgagactttaaaaagcatgtttaaaagattatttcttctaatagagactccaaaagtactcaattactgtcttatcctctgggatcctagttcctattacttgtgcttgatttccctctgctgattagataagttaccttgaaagaggcaaagaaagccaaatgggaattgacttgtttttcttcctgtcattaaaaaaaaatggaaataatttcaaatttatagaagttatacaaataaaattatacaaagaatatttgtaatcctttttatccagaacctcctattgttcgtgttcattttaccccatttgctttatcatttgcacattctctctccatgtatcaatacataattgttttctgaatcattaagaggagagataattggcccaggcacggaggctcacacctgtgacctgagtactttgggaggctgaggcaggaggattgcttgagcccaggagttcaagaccagcctgggcaacagagtgagatcctgcctctaccaaaaaaaaaaaaaaaaaattagtcagacatggtggcatgccgctagctactttggaggctgaagtgggaggttgagactgcagtgagctgtaattgtgcacctgcgctctagcctgggttacagagggagacccttgctcaaaaaaaaaaaaaaaaaaaaaaaagaatagagatgatcttacatacattcatatgtaacaaaacagttaactttagtcaatttaaagttgataacactactttgattaaactgtcattcatattccagttttgtcaagtgacccagtaatgtccttaaatccttaataacatttttctctttctgctctaagtaggcccttgctccttttggttttgctccgtgtgagcttacaaagtcccttgggttgtcttgaatgtttttcacagtgatcagcttgttctagccatcacttttcctgaaactatgataatccttaccattctttttttatattcttatttgttcatggttactgtgtctgtcttgcctctctgtgttgtcctccactcccacccagtgttttcagagagaaggaactcttaagtaaatgtcctatatagccttgttgatttctttatctgatgccttttttttctcttaagtatttaccattttagtgtgagaactgtatttaaattataacctccagtcttttttttttttttgagacaggattttgccctgttgcccagtctggagtgcagtggcacgatcatggcccactgcagcctcaacctcttaggctcaagtgatcctcctgcctcagcctcctgagtaactgggactatcagtgcatgccataatgcctggctgatttattttttttagagacaggccttactatgttgtccagggtggtcttgaactcctggtctcaagcagtcctcctgcctcagtcccccaaggtactggtattacaggcgtgaaccactgcacttggccataacctccagtctttaagtcagaggaaataattatatatgaaagatgtttgggtatgataaggcaattgattaggaatttgaagtagcaagcctcgggtttgtatggatcagtgcttctaaaacttaatgtgtatacacatctcctggggatcttttaaaaatgcagattctgattcaggtctggggtgggacccaaaatgcatttttaatgagttcctgtagtggcaaggccctagatagatttaagacccaaatactctaggtcctaaagcagggacttctggtagggaagatcagtagtctgtagttgatggtcttacaggattcagacaaaggaaaagtgctgaggaatgtgaagacaaacagatgtgaagtcctaaagattaaaaaaaaaaaaaaaagtagctagtgaatggtacttggagtgggaaagcatccagtctctgtcactcattagctgttacttttacaaactgactgccccaagtcttggtttccttttgttaagatgcagtagtaacagccacttcttaggatttggtgaagactgtttacctaaagtgcttctaacacagtgtttgacatgtgctagacgttcagtaagttgttagaagcttaactgaacctggtccagattgcggaacagatgaatgaccatgaactgtgagcacttaacgaagtagagttcgttagtgaccagcgtgggttttcatgccattttctacttaggtttattgccagattagaggatcactacagagataattcctagctttgtacaggaatttgacaaagcctcaagatacctttgtaggcacagtagagaactttcaagttagcagaggtagatgggtttgtggctggtaaaacaggtgtaccaacacaatagtgaatacaaatgatgtgaatgaggaaaggggtctgtagtgcttaccatgttgcttttttgactctttccaaaataccttttaaaaaaaaccttgggtgaggacagttaccagagcccatacttgccatctttggtgttttcagatacaagcctttggggcagcatcccctcttgagtattttttctggcgttctgctttatgctgtttctcccttgacaactctcagagctctctgctgtgccacttgaaactccccttttccagggttaacaaactggctttcttttttttactggtgaatgctccccccattttctgctttagctgaagacttttcctttaagatgctgctatgccaagtagagcctactcattgtcccaggtctctgaaaatctcattgtttaactccaggcccagttatcaccatcggtctttttagtgtccacatgaatgacttatctaatatttcagacttctcacattctaagtcagccacctctaccatactctggaccttgccatcctcagagctcttaatcttcagtgtcccacctcttcgtgtttatattgtctgccaccctcattcctcttatagctatcagcctattgaaatcactggttttccatttatttgctcctaatctattgactttgttctgtctttagcctataatgcacgacccattcttcatttcctttgttgctgttatcatcaattctgttgtcacatttattccttcatacccccttgggggaacaaaatcatagctctgtatggcttcagtgtccatccaggtatctgagctctgctggagaaaatcctttaagtccaacttagttttcctctttgctggacactggttcctactggtgcttttccttagtttccctggtcagccttctttgctatccacacaacagctctgcagatctccttttccgtgtctctcagttacccttaagataaaatcaagctgggtgcagtggctcatgcctgtaatcctaggagtttgtgaggctgaggtaagaggattgcttgagctcaggagttcgagaccagcctgggcaacatagatgctacctctactaaaaattttttttaaatcagccagatgtggtagatatcacatgcctgtagtcccagctgttctagaggctgaggtgggaagatcgcttgagcccaggaagattgaggttgaagtgagccactgcactccagcctgggcaacagaactaggccctgtctcaaaaaaaaaaaaaaaaacaaatgacaataagataaaaactatttaacctagttgtcagagttctttgtgatttgaattgttacctcactgttcatcaccctaacttgtttttgtgaaatgtggaaaaggatgaggccctccagggcattggtaccacttttaagaccagtgcatgtgatctgttgatttttcacagtgcctctttgccaggctttgcagcattagggtggaaccttgaataaaatcttcacatattctgccttctcagggcatggactctacaggctttgattttggatttctatcaggcaggagtttgtcaaggaacttttttttttcagagtcttgctctatcacccaggctggagtgtagtggcgcaatctcggctcactgcaacctctgcctcctgggttcaagcaattcttgtgcctcagcttcccgagtagctgggattacaggcgtgcactttcacgcctggctaatttttgtattttcagtagagacggggtttcgccatgttaggcaggctggtttcaaactcctgacctcaggtgatctacctgtctcaacctcccaaagtgctgggattacaggcgtgagccaccacacccgaccaaaggattatttgagaagtttgtcagggattatttctgatggttatcaatccaagcattttgagacacttagttttagcatacagttaaattttagagctttgaaaactgcttcaaaaggcaatttcaaagttaggaatgtttccttgaaaaacaaaatgctaaactaactccttgctggatgtgctgtggctccaccccacccacatcccacaacatacatacatattagactggctagatataaaaagattgaccaaaccaggtgttggccaggttgtagagggactgaaactctcatcactgccggtgggaatgtaaaatggtatatagttccatctacttggaaaacagtattatgacagtctctttaaaaattaaagctatttttactacaaaataataactagataaatagatatatctacagtttcccctgtgttaaatgttaaggatacacctaccatgtcttatccaaaaggggaggtcatatacctaaaggagcgtgggctggtctggtcccatattaacagatgtttgggatcttgtgtatatgttccatcaatggcatgtgtgtctcgtaccctgaaagcatgcattgattttgatttcagtcttgagaggtttattcctgcttcttgggactccagctccagacaagcattcaaactgacttagaggcctgggaggaaaccagctctgggtgacctgtgtttcatttcattgctagtcagggcggaagtggggccaatcacagccagttattcagcacttacacatatgattttggttttacctcagccattttgaggtgaatgttctcattcttcagatgaaaaaaaaaaaaaacttcaaattaaggcttctttcctagatttagcacacccatagctccatggcaaagccctcttattccttattctcatagatagagggtgtgctttgcttaggttccccaaggccaagtgtggaaaacgttgctctttttttgtttcatatttaaatatttattgtgtgctgggtgctactgtgctgagctctttccatctggtatctaattattgagctgtcctaacaatgtcatgaaatagttgatactccaccctaaatgccagtgagaaaacagagggtcagagaagctaagtgagcttcccagagctcacagacatatacaagaggtgtcagacacagggtttaatcctaagtttaagtcaaagaatgggcttaaccatgtcattctgcttccatcctaaacatttcaagttcaggggtacattgaagagaatctgtatatgctagaagtttgcataagtgaacctctcacatgaggtggtatgcttatgctataccagatttctggggtgtggcctgaaattctatattatagcattagaaaggtgagaattcttctaataaacaaatcgtcaggcagtaaagatgaagtatggtttgggatttctaactgtgctgtaggtgtatccaggcattaatagcagctgtgaccagggaccccagtgacagtttcccaagtactggcattgaccttttaagcctgggtagtataacccagcagttttgctgctattgtaacagcaggaactctggtcttcagtcagcttgtaacttcctctaacaaggcccttgcggccaggtctcagagctggatatatatctgttcattatattgtgttttgctggcatgcttttagttgtcttgcctttggtatctcttgttgggtggctgtaggagaagaaagaggctgttggctgcaaagaaaactaagaggtcatgaggtttccttttttgtcctcctagtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgattgtatgtaactcatttgggaaaggggagttgtgggtggagttgcctgtgtgtgtccaaggggaaggagggtacaatatctatgggatgcctgtcccctggaatgcaggctgggagatgggatgaggggaggagtggagattattgtggacatttgtagagttctcatccttaacaggatagaggatgctttgaagacccattgagcaatacattgcaggacctgagctcaggactctcattttactagctactccaagagtactggaaaacacttaatttcaaaagtaaacgtgagggccctggcagtgttctgtttctttacctacacggggtgctttctttagcccttaaacagtgtcatttatgtactttgatgtatgatatctcacaattaagtaataacgtaaaaaatttttaagtagtaattagcagagataggattttaatccagatctgactgtagctcctgtattttttccactgacccgtgtcagctttcaattcatgccatgatgaatctatgaaacattgcctcagttaatttttgcatttcacgttccttatctacagccatgtatgatgcgtgtggtcttcatgctaagtggagttggcaaatgaattagaataggtaggggatattatagatagattagtacagataatatagataggggatagtagaagtaaatacaggtgggattggcagtgagaaattaccccaaaataagaatacagtttcagatgccttataagcatttttgttgccaaatctcccgagctgaatgtgcagtgaatagaattacttattttaccaccttcttctcttccccatacccaggactggcaactttggttgtgatcgcctgtcagcctgtcctagaatatggaagttggcgatggtgttctcactgaccattggttttatctgttaaggctgcatttctaaaagggcagtcacatgcgggtctctttgcttctctgggctgcagttacctcttctgtaaaatggggtcagatacagtgctggtagttctgtctatattacttagattggactcagtcttggaaatttatctcatgactgattaatatttggggattttaaaatattctgtcaacgagttattttgataatgtatcatttcacacacgtaaattagaatttaaaggtttgacacagcttatggtgttctgatacatttatgatacaatgcagagctctcatagatagcatttttggcattcggctttctaggaatctgaccaaagaaaacacaaaatatgaagaagctacatcttaatttttatttatggttctgaaaacttggaaagtatatatataacaggaagagtatgggtcagtgagatgtaccttgttccctaaatagaatatgataaatgcattttaaatggttataaagactggcaatatggaaaagttgaatgaggagagaaggagcatttgtttaaattatagtataactagaactaatcaaaattgctcaggaagaaagtctaaaagaatatatatcaaatgctaaatgtctattggatgtttttaataatttctataatgtgattattactttataacaaaactagcctttaaaaccctgtcttcctttttcctcccctagtcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcaggtgagtgtgccttgagcatgtgtgaggcctgaggcctcattttgggagcagagaggaagtgaccttagttcacacacttgtgaactgtctagaggaggcttggttgcatggtgaagtctccagatctgcaaagaattatctttctgtggagtaaatactaatgggaacagactcaggaacttcttgaggctgagtggagaggaaagaggcaggttatctggcacatgcatgtgccacagcacaaggagctggctccatctctcacttgtgccgttccgtggagactggctgtgtgctgctcttgcttttactttttccacgggtggatgtcctcaagagaaactctggaagggatatccagaattttgtctaccctctccacattctaattcaaagaccatcagacacaactcatgctggagctttcttccctgaggctttctgattggtatagtcagggatgcactggggaaggaggggtccatttgtcaacctctaaagtgaggagtgtcaccagatgtcctggtctcttaggaatccttaaggttctgacatttaaatttaatcttaggctggcctgggtggctcagcacttaagcagaggcagcaggatggcttgagccgaggagttgcccagcctgggaaacatagcaagaccccatctctatatattttaaaaggtttaaaaaataaattatcctaaatatgtattaaatgtgtttttcatctttgtctagtactgcttcagggagatattcattaaccactggctcttcagaggtcctgaatttgatgactaagttagtgttagtttctgcattccatttgtttccataggcttcagtgtgtctgtttgctcacagagttgggctggatctcattctcctctgatagtgctgtgccctgttcacctaatgattttggcaacccatctttgtactttctctggtgccattgttttcctgtgaaatgacattaccatgcttttggatgagaccattatattctgtttttgtcgtaaaagattgctgacattgcccagtttcttgctgtagcaacacgttgggcctattccttttaggaaatatccttccacatctttgtcctgaatgaaaatgatagttcctttcattggctgtctgcctctttgctgaaagaggagggtgaaataaatgggcaagaactagctagtcctcactaaggtcagtctctgatttggaaaggtacaaacagtggggacaggattgaagactgattcattacgttaccatgctggcatcaaggaaggcccattgtctatttgggtgctataaagatgagtctggcttggaacagttgtgacattcttgtcttactgggttgccagtgctggtttttattggcagtgtcctaacttctgtgattcatgagttcagagccaagacaaggaaacagaatagaatgtttctcatttgaacattggggagaaggcccatttgtaccagtaagcctgcaagatgttgtattgctatgtttattttcaagtaattatgaattagtactgtaagcaataacaggataaaactgctttgtggttagcatattagttgaatgtttgaaaataacatggggtgtaaatttttaccctacacatctggtttggtattcctttcaattttagtggggacagaattagcaaagtaggattatcatacttgactgagtggattggtgagacatagatttcttgcttttcagaataatcatggatattctctcaggcatctgggcaaggattgtggccagtcaggttcttactggacaagttcaccccagggaagagtgtggctttgttgattctctaacctcccctgtttatctctttgccatctaccaaagctgtgaatgaagccacctgtacctggagtggccagcttcctccccggaactataagaaccccatctactcttgcaaggtgtttctaggaggtgttccttgggatattacagaaggtgagctgtctctaagacctgctttaagagttgaagggtggggcatgtctttcaggagcatgaaacttggaattgaggccaggggctgaatgccctgcctgagctcagggtattacatgagtgtctgaggggagaggtgcatttcatagacccccatagtgctccttatgtcgggagcttacaccggagatcagcattcgtttctgagttgtttgtcagtggggatgagccagggaggagaatgctggtgattctgtgtttgtgtctttactgggaaagatggttcctcagcttctgccattcttttctgtctctttgcagctggattagttaacaccttccgtgtttttggctctttgagtgtggagtggcctggtaaggatggcaagcatccccggtgtcctcccaaaggtaatatgcctaaaggtaataaagacatggtaggagcttttttttcccttccctagtacataactgcacctaggggtgctgggatgtcacagctgcatgttggtaacatggtgggcactccagggcacagacctgccatctgtcagcactttctcttcaacctaacatgtccctctgtttcttctgagctaatgttccatctgtccagacttacacagcagtgggagttgcctctgaaaccccttccttgtacacttctctctaaacctgaacccaagcagcacctttcctctcaaaataaggcgtttgaaaagctttcccttgcctgcctgtcctgcccagttacgttgttgcctgacctaattctgaagtccctttggagttggcaggaatgaggaccaagcatctgattcctcactggtctgaaatgagatcccttccctgtagaaaggagcaggtgctattttcaccctgccccatcttcattgaactgaactaatggtttaagtaggtgtttaaagcaatacctgccatctttcctgccaccaggaaagcctggctctgctgacctgaacatgctctgtgttcttgcatagagagctgtggtaatggtgggatcctctgtctcagcttgccagtcctttccttcaccagggtgggagggaggcccacaacccagggcatctgcatagcaaatgcttccactcaacacgacttttcaggagtaaaacaaaaatgtatcttatacacaagaccttctttcttggaagaaacgccctgctgcaaagccaaggctgaggagtggccacctaagggatattaatgcgatttttcctctcattgggaatagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgagttagcgtgatgtcctttctggatcgagggtcttggaatattgaggcactggattttcttgtggtaggtggataggcaggctgcaggcaaggagtattcctgctgaggcaagaaggctcttcttgtcccacaataaaatagcagtatcctctcaattacattaaaaaaaaaaaaaagcaacctttgggacttaatggggtgtgtgcatgcacacatgcgcatgcctgcccatggtaatcaaactgtctgcccgtctttattctgctcttctttcttgtagccaacactttggtttcaaacctcttgtcttagaaatgaaattgagaacagcaaacttctctacttggacttaactgataaacctacagctgtttttccctggtcctgcccttcctgtgccttgtgacctcccagtctgtgggggtgaattcctctttagcccacacccacctgtgggtcacttcttcattcttattcagggctttatttagttttgtgggttttccccataagattctctcttcctacgctttttctaatatcagccttatgtatccttggcagcatgggtctctaacgagtttatctcacctggggatctcattgcacattcttgggccttatcccagacttactgaatcactctgggtggaatttaggaatctccaactgaataaagatccccaggtggttctagtgggtagtgtttgagaaccacttgtcaaagcaagttttgagctcaggaatcagtgcggtggtaaaatcggatttgagagcacacaacttttgtgacattggactagatatttaatatctctgaaactttgtttcctcttctcttctataagatgggaaactaaaatgcctattttagtaaaaaagatcagtggttgccaggggtttagcaggaagggatgaagagacatagcacagaggatttttagggcagtgaaactattctgtatatggtggatacatgtcattatactttggtccaaacccatagaaggtaaaagaaacaccaggattgaactctgatgcaaaccatggactttcggtggggatgatgggtcagtataaaaaaatgttccactctcatgcgggatcctgatagtggggaagtcacgcaagtgtgggggcagagagtatttggagaatccctgtactttctgctcagatttactgtaaaccttaaagcttctctaaaaaaatctatagggtaagaggagaaatgcctattttattgggatggtcacattagatttaaaataaatccatgtaacaaagctggctcttgttctgtgttagagagagggcaggctcatcctctggctgcccacagtgacccacagcttccctaccttctctgcttctttattctctggagcttgtgtagtcttcccaccttagtatgttctaggacttaattaacatgctcctttttcctcccctcctgctttcacaaccagagatggccatatgcatatcacagagcccttccccttcctcctcagtgcccctgtagacaccatcctgtctcccattccctcccatcaccttacagggatttaatctttctttgattcactggctataggctgatgcagttctccttcctctctacttttctttttcctttgtgttcctctccccgccagcaccaacatagccaatatagccaatctttgactcccttcttcttttctagttcagataaatgactcactttgtggcttctctcacctttagacccagattcacctttctagcctcatgtcctacctgagcctcaccttcctgtgggatccttcttcgggatgtcctgtaatcccaaactcttttgtgggcaaaattggctttttcatcttccagtgaaattggctcccctcttgtaacttctgccaggtcctctcatcccaagaccgtgtaggcccagcacctaccaggcctgattcttccttgcttgcccatcctgcttatgctgtctgagtactgcagactcttctgttgaagaatctctttggtcttggcctgttctctgctcgttgccaccagccttgtccaagtcttaatcacctgtcctttgaaactactgtttttgcctccttgctggtttctgcctcagatctcttcctgcttcaagacatatttttagatcttcacttcattctggactcctccacctgctctacaaggttttgttccaggttcaggagattcagaggcaaaggacatggtcagccccagccctttaagactccagggatcttgtatgtgactttctacccaacctctcgccagtcatttccactgctctggcacaaaccctctgaaggctaggttgggccagtaaccatctcatacaaatatcgtaagcactcccacccctctgtccttcaggatcctagcctttaatttctctgtgagtccttcctttcttgaggacttcagattatgcccttttcatcagtgtccacagccctttgttggaactacacagttggaggttgaaatagaatgctgggctcctgggtttggccatgtggtacttttttgcttactctccagcatgagtgagtactgtgtccacttctaccattctggacacatggactcagtaaaattcaactccagttggggtggagtcagggtggtttattggacgcctgtgtgcctgagattgggcaacagcaccttttcacccctgtaagggcgttagcttagcttcagtatctccagagcacgtaccttgccgtgcaagcacctctctctctgtggctctctgccagggctgatacacctttgggtggttttcaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggtaagtgtcccacttctgtgtgcgaaagcttggttggcccctgggagtagaccaagattgtgatacttccccatgggagtgaggagagaggcctgacccaggtctgcagatcagcatataccagcaccataatatctttttctagacaagtcacgagtactggcccttctgtatctagccctctacccaccatctcccacgcagtgggagaaaaagctattggagactacaggaggtgataagaagtgagagtgaggtaggaactttgttggaagctcagagttcacagcgaaaccagtttggaacagacaacaggtactatttcatgaaaaggctgcaattctctgaacttgcctggagttttttattaaaagttcttgaaaagctctggcattgtctaaggtcagagaccaggtcaggctggaggaggactttctgagtgagtcaggcaacagagtgtggcctgtgctttcctaactcagaagtctgtgggcctaaccactaggttttgatcagctcctctgagaaaggaggtcaattcgccagtcctggcaaaatgtcaatgatgaggtatggaggtggagcagagcctgacctctgtgattaacatgtggctaacccacctccccaaatgcttagtcttcacacccacactgaatctggtcaggaaggagcaccatgtactcaccaatactgtgcagcagattgagaacagggacttcagaagccccaggagcggaggaggaacttggcaggatggggcttcttccagctctcttaataggtctccagagtgcctaagggctaggagaggttcagttcaactgctgggcttacccttcagacaagtgttctatctgcatcttggcttccactctgaatcctttaaccttaacctatgctctacctgcactgaaggagtcccttatctttccttcccatcttgatctgcaaattcttcccccattcctgaatggttcacgctaacatgatctccactgtcaaatatggtacgaatatggtagctaccagctaaatgtggccccattgagttttggaaacacagctgttgtcacatttggaaataatattattaacatatagggttaaataaaattttttttttgagatggagtctcactctgttgccgtgctggagtgcagtggtgctatctcagctcactgcaacctctgcctcctgggttcaagtgattctcctgcctcagcctcctgagtagctgggactacaggtgtgcgccaccacgctcagctaatttttgtatttttagtagagacggggtttcaccatgttagccaggatggtctccatctcttgacctcatgatccgcccaccttggcctcccaaagcactgggtttacaggtgtgagccaccgtgcccggccaataaaatatattattaaaattaatgtcaccactgttttaaaatttcagtgtgactactagaaaatttaaagttacataagggctgaccatgatggcttatacctataatcctggcactttgggaggccgaggtggggcagatcgtttgagtccaggagttcaagaccagcctggacaatatggtgaaaccctgtctctacaaaaaaatacaaaaattagccaggcatggtggctcatgcttgtagtcccagctacttgggaggctgaggcaggagattgtttgagcctgggatgcagaggttgcagtgagctgagatcacgccattacactccagcctgagtgacagagggagaccctgtctcaaaaaataaataaagttacatagtagctcacattatatttctgtcggacagcactagtatcgtaaagggtttcctgcattttaaaagagtagcattagggcaggctcggtggctcacgcctgtaatcccagcactttgggaggctgaggcgggcgggtcacaaggtcaggagatcaagaccatgctggctaatggtgaaacccgatctctactaaaaatacaaaaaattagctgggtgtggtggcagatgcctgtagtcccagctactcgggaggctgaggcaggagaatggcgtgaaaccgggaggcagagcttgcagtgagcagagattgcgccactgcacaccagcctgggcgaaagagcgagactccatctcaaaaaaaaaaaaaaaaaaaaaaaaagtagcatttgggagaatttggttagaagggaagcttgtgtctgttgtcctaggttctggtcgtgtgactttcaataaccaacggagttacctgaaagcagtcagcgctgcttttgtggagatcaaaaccaccaagttcacaaagaaggtgagttggctggtttatgcccttactctggggtatatgagaggggtttgggcagttactacccagggcaggcctgagacctgaagctgtttgtgctgggtgtgtttagggaagtgagccaaattcctgagaattaacattgaggttagggtttgggagtgggcttggtctttgtacgcccaggaggaagggaactgggactgttgagcctcttcagtgtgtagggtgccttccctcactgtggtatttctttggcattgctcagtagcctgacttcctattttccaaccttttgggaatcctccgaacacttgcctatactgctaattgatagagggctgaggtacagtttgcctagaagaccaggcattaaggtgtgtggttgcctgaatcccagaggcatccagcctgactgtgcatggtgtatgagtctgtcctctagaactcctttctgtacttcaggcccataattctctccaagcctcctttaaaacaggcaaatatcctgcattccaatatcccgcattcctgtgtgtggccaataatgtgcccttcttctatcgcctatcgagcctcctggtaagaagagccacttcatcatcttattttgcctttgtgcaggttcagattgacccctacctagaagattctctgtgtcatatctgcagttctcagcctggtcctttcttctgtcgagatcaggtgggtccgatgtctatgaagtccctgccctctattaaaaattgttggctgggcgcggtggttcacacctgtaatcccagcactttgggatgccaaggtgggcggatcaggaggaccagcctggccaacatggtgaaaccccgtctctattaaaaatacaacaattagcctggcgtggtggcaggcgcctgtaatcccagctacttgggaggctgaggcaggcgaatagcttgaacccaggaggcggaggttgcagtgagtcgagatcacgccactgcacttcagcctgggacagagcgagactccgtgtcaaaaaaaaaaaattgttatgccaagttcatgacattgaatgttggagttctgaggtaccctgtggtgtctgagagcatagaggaggcagcagtaatgtttgctgaaggtcagaccgggacagacatactttagatagcttgatccagaactcttaagaaaatatgttgaattgagtctttatactttggtctttttcttgcctgggatattgctatgcagtatgccactattgctgagaggtggttttgtagatgatggaagcctggctgggtgtggtcagcagcacgtgggagccaggctcagctgcctaaccctgaagccttctaagctgatttttctgtaaaggaggatgcctcgtcctcctttacatctgaacttctggacgactttgatatttgcatctgggctgtacccacaggtgtcagcgacaggcagaaagcagcgaggtggctttctattgaatgttcctgggtgatggaatgtggatctggatgtgtttggcagtgcttctcaaaccttaattacagacacatcacctgaggatcttagattctgattcagtgggtttggggcggaccctgagattccatgtgtccaacaagtatccaagtggtgtcaatgctgctagtcagtatcatcctttgacaggtgttaggggaagtttgggacctcttaggacaccagcagcagtccttccatgcttagtgggtgctttttaaattttgtttaaaaatttgttgcagtgatgccattgatcagatttggagtctctgaatatggttaaactgaggctctcaagtgagagtttgaagttaagtttgaattgttagttaaagcctgagaccaagtatctctctgatcagcctcatctacgaggcttttatggatctggatctttcacagataatctccatagtcagataattgctcagagattagtggcttgcctgacgttacacagcaaccaagagatgggactagactgagaaacccagtcacctctcctcacttaatgggaagaaagcaggatgttgcctagcattagaatttttagtcagtatccttatacattctccacgttagcagccatgtgatacaactactctgtaggaggtgagaagggcaggggaataggagagcagctgtcatggttagaggggataagagaaactagcatggtctctgcacacactacgagcccaacatgtttaagtaaggggacctgtaacaaggatggtgggtttgccatagttaatcaggcttctgtgttggggtgagagcattcctagggaccatttcttctaacccacagaggccatcgggagtctcccacccttctccaaacagaacaagcagctcgtgcaacagctcctgtgtctggtgctgacacaggcatggcatcctcctttttgttcccccaacccaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 38546 - DNA, 31918 bp, Homo sapiens
accagctctgagatttccagctcagcgatgcccccaggtccctgggagagctgcttctgggtggggggcctcattttgtggctcagcgttggaagttcaggtaagccagggctcaggccttgggaggaacttatttcagtcagtgatcatatttctccaactacttatgcagtactaacttttggaagatcccctaaaagccttttgcctcttctgaggtgaatttaaaacagtaggggaaaaaaaccccttttatcataatcggaatgatggtaaacaggtcacaaaacctgaactttccctggttatccgactcatttttctaaagcccacataaaaaaaccctttctcaccttgcacaagccaggaccaactgtaagaaaataaaatttggttaattctaagatattcatttttcaccccataaatatccaccattccaagatatatttaattttaaaatttaggttttccaaactaataatgattttgtcactgagattgttagatgtcctttctaatccagcaacctaactcaagtggtttgtcatcctggctgggtgatgggaactagtccctgctaacctcagatgcccctgggaaaacttccctcagatgccaatttgcatttacctttcccccagtaaagaactgacccactgatccctcttgcctaacagaaaattaacctgctctactttgggttctcagaagttctcagaagactccttctcactatggtgaggtcacccttagaaaaatcccctccctctactcacaatagcaggctgcttttctgtcttctccgctggacatttaattctcattccctggctctagaatatgtcattgcttctgcctggggttgctcacatcacctttggattgatttctgttctttgcatctttcaagggggcttctgtattcctatctcccttgtactcattctttttctgctcagcacccctccctgctacaaagttccactgggtgactgcatgctctccttgcactcatgggtggtttttcagaggtgctgttgagctctgtatgtgctttctcctacctcaattagttgtccctaaaaggtgaggatttgaggcttctgtctcttttagcatagttagtgctgtgctctgtatagagcagatgtccagtgaatattgcagacattgatgcttagaggaggcaatgggctgagctgatggggaataggctctgtctgggtcgggctaacccagactggaatcctggctctgtttctttgtagctatgtgaccttgaggaagtggctttctttacctgtagctagagatgatccttaccagataggaatgctgtaaggactgaatgggatcatctgtgcacagggcctgacttttgcagttgcttattcctttgtgattttattattagcaaattgttgtctaggctgatggaagtggagggaacagggctgtcatgagccaccttggagagaaggtgggaggtatcacctaggagagctgtgggtcccgttctgagaagtgggcttggcaggcccactttgtccctgctcaggagccccaggcctccttaggggctggaaggcatttgctagttgtcctgatttgaaggttgaggagtgggaggactatagcaaattggcatcaaactctttttggaagctcatctgtcggtaagcctggggcctctgtcacacagataagagaagctcagaaattctgaaccagatagcagggttagggtcagcgcagaagctgatcaggttccagccacatatgtgggaatcattctagatgctctgggcaggaagtgggcttataataacatgttagcagggcctgggtatttccttgcctggtcttcttgcctttgtttgtctctggtgtctttcttttcacacttacccagtgaggcattctctatttcccatccgcttctcttcctttcccaccttaactgagtgtttcactgtcaacagcaacaatatttattaagttaatgttccttattcttacttttagtagtgctgtctcagaaattaagtgagttgatggataggcagagatagaagtgtgtgtgcgtgtgtgtgtgtgtgtggctgggagggatagaaatatgccaaagggaaaaggaaaaaggatgtaattgacttcagacagcctagatgaagtaggtggacagaaagaagatgccggatgcagagagctcaaggtaaaggaaaggaagagctcaaatgatcgggagggaggaggttcaggaggtatccaggtgcctgctgtcacacaagggcagtagctgacccacatgggcctcttggaagttcagcctccactcactttcctggctgtgtacccacacaatctttcatgacaaccccagtcacacctagtttttccttggactgtggagctttagattgttgagctccttgatcaacctggcccttgagcttccaggctggctcaggcgtcctctcctccaggtggatgcacaagtcttcctccatctggggtaggtggtctttctttgtgttctctcagtacctatgtttcctggtcacagatcttacatccctatttgctgtggggcctgcttattttccctttctccgctagactttgagctcccaaagggcagttatggctggcgtcttcttcatccttgaatccccagagcctcacccaggcccaggcacacaggacacattcaataagccaaaagccttggtaactgagaagaaagaaattgagcgggctgcagtcctcatctctacttcctgacgttaggcagattgattaaatgacactcatcctgaaacaattcagccaaagaagggttccagagggtggcccatttcagagacactcctggctgctgatgcctcaatccacaggtcatctgatagcacagctctgtctgtggggagcccagggctcaagggggtggcaggaagttcagtggcccatagtgctgagctggtggcagaagcagcctgtgacaccagcctctgtaaggccagcctgggcctgaaggtggtgctgcaccctgcatgcgtggcagagccaccctcaagtcagctattgggagggggcctccgccctcctcccctcctgcagtgtcttcccgaggagcctggaggagggtgcctgcttcccgacacatgcaccgatggctcctctgtcatctccacatttgataacaaagtgtctgatgtggttttgtgccaactctgtcactgccagaacacccttcccttcttggtccaggccacagaatcaaaactgttttagcaaaataacacttctacgaaacaaaagcccatgggggataccgatctacagaacacacctgagacaggtgcaggtgggagtgcagagtagcacatttccagcatttgcagatcacagaggccacccatgggaaccatgagcagcccaggcgggtgaagggagctctgtcatatatgcctgagagtcactttccattatggaaacatgggtgttaccaggccttactcacccttctctaacacttcttcagtgtcaaagactcaagaatagaaaactataggctattttcagactcagacaagccagtatttcattctgcacccctcatttctattgtttataaatctctggtcagcctggccagatactcatgtgtcactgttctttggttggagtggtggctaggtagaggcagtatctgaatatgcttccctatttatcagcttcaaatactggcaattttcttctctcccttttcaaactttataacttttatcccattgcattgtcttgtttcagtggttaggactaggtcctctagcacaatatttaatagaagcagtgatagcagacatttcttatctgttccctgttctaaatggaatacttctaatatttcccagtaaatctaatccttactgtaggcttttaggagatatcctttcttatgttaaagagggttgaattttgtcaagtgttctttttttctgctcatccgttgagatgagcatatggtttttcttctttagtttgttcatacgtgaattatattaatactttttttaatgttaaaacagcctttaattctttgcaaagaattggcccagcaaaccttgctgggccatgatgtactttgtggtcttgttatcctggatggatttagatttgctgatattttatcttagatttctgtttatgtttataaatgaaagtagcctttagtttttccttctcccctgtcctttgcacttttggtacttcggatattctcatagaatgaactggaatcctgtctcccattttctattcctggaacagcatgtgtaagctagggatcaatagaattcctctgtgaaactctcaggcctcttagacttttctgagggatagttttgaaactagtgtttcaattcctttatgctatagttttacatttgattttctgtttttcctttcttgactaagttttggtaagttacgtttttctaggaaatgatccattttctagcaaaatatcagtattttcagttttggggtggatataaacttttttatggtgtaaggaaatctactgtctgtatttatataccttttttattcctgatattgtttacttttaacttccctttgttctgttactctgtcttatcaaaagtacatctagctcattattcttttcaaagagccagttttgggtactggctctttgtgtgtgacaggtactattttaggcagtagagtgaacaaaatggattttaaaaatccctgctttgttcaaaagtacattctaatgtggactgaccactaatagaaaataagtataataacttggcaaattccatagtagattagaaggtgatgattgctaacaaataaatagaccagggtaaggatgattgagagaaatgaagtgaggaacacaagcaggttacaactgaaataggatgtgagagtagacaagagagcacttgacaagcaaagacttgaaggaggggaaggaactgccatgtagatacataagggaaatgcattccaggcagaaggaacagccgggcaaagaccctcaggcaggaagccatctagagtgaggaagggcaaggagaactactggctgcaatagtgagtgattgtagcataaggcaaaggactcttggagtggggtggattagctcagttagggccttacagtccattgttaggacttcaggtttcaatctgagagaaaaggcttggagacttttgcacagagatgtaacatgacttgactgacttaaaaaaaaaaatcgtgactgctgtgttgcaaatagactgaaggggccaaaagagagggcaagaaatgcagttgcaggctatggcagtggctgtgagagatgatggtggcttaggccaaggtggtgagaagggttagattctgaatatttcattctgatggtcaagccaacagaacttaccaattgtatgtgggatgtgagagataggaaagagtcaaagatatcccaggcaactttgcaaagcctgagaaattgtaatgactaagttgctaccaatgttgctcatatttccttattttctatttcttcaatttcaactattacctttatatttctttccctatattttatttggaattactgtggtattcttttctgagttaaaatattagcttatctaatctaagtctttcccttctcccctcccccaccaacatttgcatgtaagttacacatttttccctattaaaaggtaaacttaggcacattaaaattttaaatagtttatttgaacaaacagtgatttatggtttgggctgcttcacactgcaagtggctcagggctccaccaaagggatgtgaagaataaattttataaggtgcctatgaatgaagcaaggcaaagaaaatatttgattgattaaagtggagcagtaccttaaggtccctagtcagaggttagttggaagcttctgagtggtaaagcttaagcctcagtttcctaggacacagctcttcactatgagttggggtgtggtgagcttctgtaggaactcaaccactagagcttcctcagtctaatggcttcccaaagaattattttaacaacccaagtgctgttttagccactctttgcaagttttgatatgtgctggttttattgtcgtttagtttttaatattctgtacttttcattgtgattattctttaacccatacattccttaaaaggttaaaagggtgtttttctgttggtaggagtgtaaattagtatagccactatggagaatacgatggaggctcctcagaaaactaaagatagaacttccatatgatccagcaattccactactgggtatatatccaaaagaaaggaaaggaagtcagtatatcaaagagatatctgcactctcacgtttatttcagcactgttcacaatagccaagatatagaaccaacctaagagcccatcaactaatgaatgaataaaaaaaaagaagatgtggtatacatacacaaaggaatactattcagcctttaaaaagaaggaaatcctgccatttgcagcaacatggatggaactggaggccattatgttaagtgaaataagccaagcacaggaagacaaatatcacattttcacacatatgtaggagctaaaaaagtggattcatgatgatagagagtagtagattgtggctctcagaggctgagaagggggaaggagttgggaatgaaggggagaaaagaatatacatgtatttattaccactgaactgtacacttaaaaaaggtaaagatgataatttatattcttttacctgaatataaaaaatttttaaaaatcttgaacaagcttcagcaatatgtgtccatgaggaattgtgccaaggagtttctctttgtaatgggctggtaaaaataccacaggcacatgggatgggcttgtcctattgtaaaaaaatggagggggtgtttttacatgtccaaatgtatattaaaataatttttgttattgatttctagttttattacattttatttagatgatattgattctttggtgattatttgggcctgctttgtgacatattatgctcatttaaaaggactcaaactctctgatggatgcaggctgccctatatgaacaatagagcagagtgactcattaatgtggtttgcatctcatgctgaaacacagtcttttcatcttttctttaaagagccaaatgctgggggaggctgataaaatgatggagtcaggcattagctctctcatgtgctgtgggagttcaagccacaggctgaagagcttagggccggcactctcagagtgggcttcatcccaggagcctccaaacctgcctgcttggtctgcctctgcaaggggattgaggacaaagtctggggctcagaagcagtgatggggaaacctctagtctaccacagcgatgctccagaaggcctcatggcttgaggtattctccacaggtggggttcccacaattcactcatagcaccatatcccagagcatcccagatccacactcctgttgtatatgagctcccagttacctctgatagaagataatcactccagaaatctaaagttactgtcttcctcaacaaaggggctcacacaaaccgaagtctgcaatctggatgtctcctctgaacctctgattctgtgaatcactttgtctggtggcagcaatgctgtgtgggactgtgttctgcgggtcagcatgtaccctgctgctcctgccagtctccctttgggatgcatggaagtcagggaccacacctctgcatcacagaagtggggatcggggtgtgatgctgggtgctgaaaatgggccagattttcagctccctgggaagcaggagtttcatgttgccttttctgttcagtgttttttaaaggcctgcagttacctttgccagagaatttccattgtaaaggtatctattgcaaggtgctgtgaagtaggtgagacttgtcaaggctcttctctgtcatctatctaggctatgggctgggcactggaaggctatggcagggctcttgactgctcataaggacaagaagtgattaggtggggctaaagagttgaaaatccttccaggagggagtgttcagactagactgaggctagtccgcagggcaactgttcatttggctgcccagggttctatttagaattctctactagtttgctagggataccataaggaagtgccatggactgggtggctagaacaatggaaatgtattgcctcacaattctggaggctggaagtctgagatcaagatgttggcagtgttagttccttcagggcaatgagcaaaggatctgttccaggacactgtccttggcttgtagatggccactgtctccctatgtctttacaacatcctccctctgtctgtgtccaaatttcctctttatataaagataatagtcatattgatttagacccactctgttggcctctttttaacctttgtgaagaccccatctccaaatacagtcacattctgaagtattgggggttaagatttcaacatatgaattttgggggatgagactcagttcagcccggaacaacagccatttcaccatggcctttaatctcatctagttgagcaatattccttctctgctattttgtccttaggcatgaaaaatattcacacagcttcattacagaagtgatgaaggctgtaataaatgagtgattattgcactagctgatgtataataaaccccatgcctgcaggcccctgtttcttgcttccttccaaggtcatctttcttccttctaagaacagatgacctcaccttggatgttgcttgttttgttttgttttcctccaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcaggtgggagttaaataaccaacaggacttctcaactaagaatgatcaagtaaccataataccataagaagttagtgggcaacaaggggaggaatgaatttaccaatggccacatgttccatccctcatatcctgctgtctttgatggggtctcatgtcaacatgcacacatggtgttcattcttattggtcatatatgttacttctccacccagtcttgtctacacactcacgaacagtacatgtctgtgactggacaaatctccgtacacagaacctttattacccaggattgtatttcccttcttcacttcttccttggttttatgacctaagaaacttccatttatgggtgctacttccgtcatacccagaggttatgggtgtgatggagctatgcacgtctcttcttcaatttctctgatactctccagtccacaatttgttgtaatatatagtcactgagtctcaattccaatcaccatcctttctttgaacagcttttctccaaagcccatctatagggctagaaacagagaaaggtttctgggaggaaagagggagagaatatggtaaagtaatagcactatggagcaagtagagttggggcacccaatgaaaaggtagacacaaaggctgtgcacaaaggaccaccatttcctgatctctggcctgtctccgcctctcaggtccctggactccagagactcagctacatgtttccttaggcatctctccttgctcttgtgccaaaccctctcctctagcacatctcatattccaccactttccaaggctgagtgtgtacctccaacccaggggtagctaatagaggtggagagctcatcaggcaaggcactctgtctgctcttaaatcccacaaccccattccctggcacacacccagtccgcgctcctctgtccacacgagtgtgctctctttgcttctatactgggagtcatcaaaaaacttatttcctgatcccaatctgttgggaaagatttctaaacatttttctatcattttccttttcctggaaaagtcccactatacagtaagttccagaaggacagggactatatcttatttgtctttattttttggaaagcacctagcatactgcctggcccataggtactcaataaatgcttgctgaataaatcagtgggtgaatgagagaaagaaagggagaaggaaggaaaaagaaagagaaaggaagaaaggaaagaaaagaaagaaagaaagaaagaaagagagagaaagaaagagagaaagaaagaaagaaagaaagaaagaaagaaagaaagaaagaaagaaagaaagaaaaagaaaatgtccacaaagaaagagcctatattttagaatgagaattaagatcgcaaatcttaactctagggcataactctagggcatatttcttttccacaaataacacaaatggagcaatgcaatgtatacagtttatgtggtttatgccttgtgcaaaggtgcctgacaaaaggctgatgaggctgacatccaagctaagttctgaaccctagcatgaggctgcatctgcctggaacaaaaggcaaagttttataatttacacaaagactgcatatgtgctggcggaagggctggcaactttggaattgtgtcctccctatgctccaagtactgtgtaataaactcctcatatgagcccttctctagttttgatttcttttctgggtttgagattaatagaggtttccatgacaatgaatatccacttggcaggtaatttttccattcttttttggccccctgtctagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtaggtgcagaagagcttagggtgagtttgggctgcgtatgaggagagagggtcagaaagacaaaagcactgcctgaggaggcttagggtggaagcagagtcaccaggtagctcggtggtcttgggttcaaatcttgactttgccactcacagcactgacctcgggcagcttattgaatattctgagcttcccactgctcctctgtaaaatgtgtcgtggcactttagacagcgaatgcagatggcctggcacttagttgtccctcaagagagaatggccatggtcgttactcacatactttgggcaccaaaaggagagtaagggggttgtcagggtggggagcccaggaagagaaaaagtgattaacaatgagagtgctgtcctttttccctccaaagtaagtgtggtgggtgtgtcatgcccagggcctcggcttctgaagctttgggggaaagcctgccactgtgaagccagcagactctgtggcccacggggaactcactgttcctgctcttctaggtgctgggtgtgtcggaatcctcaatccacatcattggtgttagcctgggggcccacgttgggggcatggtgggacagctcttcggaggccagctgggacagatcacaggtaacattcctccctgcccatcctccaggctttagagatagagaaagcttgccctgaaaatatctcttctaaagcaagcagaggggagtacagagcctttgttctcacgatcaagtcacctattaccactaaaatttatttattgtggttcttttgcataaaatggtattgtgttattattgcatgatttctaatatcaatgtgagaggccatgtatttcttcttttactttttatttttaagtttcttatttaaaaaaacttttagattcaggatttacgtgtgcaggtttattacatgggtgtagcatgtgatgctgaggttcaggtttctaatgatctcattgcccaagtagcaatcagtacttgataggtagttttgcaacccttgtcccttgcttttcctcccccttttgaaatccccagtgtcaattgttcccatctttgtgtccatgtgcacccaatgtttagctcccacttataagtgaaaacatgcggtatttggttttttgtttctgcattaattggcttaggaaaatcacctccagctacattcatgttgctgcagagaacataatttcattcttttttatagctgtgtagaattccatagggtatatgtaccacagtttctttatccagtctaccattggttggcacctgggttgattccaagtctttgctattgtgaatagtgttgcaatgaatatactagtgcaggtatccttttggtagaagaatttcttttcctttgggtatatatctagtaatgggattgctgagtcaagtggtgattttatttttagttctttgaggaatcttcagatcgctttccatagtggctgaacttatttacattcccaccaacagtgtataagtattcccttttctctgcagccttgccaacatctatttatttatttttcacttttttataatagcaattctgagtggtgtgagatggtatatcatggtgtgatgattagtgatgttgagcattttttcaaatgtttgttagccacttgtatgtcttctttcaagaagtctcttttcatgtccttcaccctcattttaatggggttatttgtttttttcttgttgatttgttcaagttccttatagattctggatattagtcctttgtcagatgcatagtttgtgaatattttcccccattctgtaggttgtctgtttactccattggttgtttcttttgctgtacagaaggtctttagtttaattaagtctcacttgtcaatttttgtttttgtttcatttgcttttgaggacttggtcataaatgctttgcctaggctaatattcaggagagtatttcccagattttcttctaggatttttacagttcgaggtcttacatttaagtctttagtccttcttgagtaatttttgtatatggtgagaggtaggggtccagtttcattctcttgcatatggtcagccagttttcccacaccatttatcgaatagggtatcttttcctctaaaaaaagtgttaatttttgtcaactttgtcaaaggtctgacggctgtaggagtgcttctttatttcaggggtccctattctgttccattggcctatgtatctatttttgtaccagtaccatactgttttggttactgtaggcttgtagtatagtttgaaattgggtagtgtgatatgcccagctttattctttttgcttaggattaccttggctatttgggttctttttttgtgccatatgaattttagaatagatttttataattctgtgaaaaatgacattggtaatttggtagggatagcactgaatctgtagattgctttgggcaaaatggatattttaatgatatttattcttctaaccctgcatagaatactgaatactttggcaaatactatgcaaaaagcatagaatacctttccatttgtttgtgtcacctatgattttttttttagcagggttttagagttatccttgtacagatcttttgctgttttggttaggtgtgttcctaggtactttatttttgtgtgtgactatcataaatgagattgcattcctgatttggctctcagcttgaatgttattggtacatagaaatgcaactgacttttgtacattgattttgtgtcctgagactttgctggagttgtttatcaggtctagaagtctttggtcaaacctttagggtgctctagaatcatatcattgatgaagagagacaatttgacttccgcttttcctatttagatgccttttatttctttctcttgcctgattgctctggcaagcacttccccttttatttctttctcagcctcactttctacatctgtaaaatggttgtaacagcccacatctccttggcccactgtggaaataaactttagacagttttgttatatacatgtaaaagtgtggaggactttatgcttccagagccactctcagttaataagggactggagttgtgtagcaaaaaccctcagcttcctagccttttggtgggataattttgggtcttgttttacagaatctcaaagaggtgccccattggggtgagagcccatggggataacctactcactactattttcctttattctctgacctattttcctactccctcaccatgctttctgagactttttcccaaatctactttgaactcttgtggcagggtctgctttttgtagggggaagggaagggatccaaactgagagatgggaatagtagtattcacagtaatcactgtgttatgatgaggactagagtgtgtaaaactgcccggcataaggcctggtacatagtaactgctcgaagaaatttagctattgttattactacatgaaggtagtaacaagctttacattacattaacttctatcaaataattggtgttatcaaggtcatctttttttttttgagatggagtttcgccctgttgcccaggctggagtgcagtggcgcgatcttggcttactgcaacctctgtctcccgggttcacgccattcttctgcctcagcctcccgagtcgctggaactacaggcgcccgccactacgcccagctgattttttgtgtttttagtagagacggggttgcaccatgttagccaggatgatctcgatctcctgacctcgtgatccgcctgcctcggcctcccaaagtgctgggattacaggcgtgagtcaccgcgcccagcctcaagctcatcttagagccagagaaactgggtcattgagaggttacctctagagagacaacagagagtggggtttcctgaggaaggtggtcctcagctaattctcccaacccttgggtcttttctgggagggtctatgatctgcactggaagggtgggtgtgtggtgggtccatgaatgttcctgcagctgagaggaaagaggtccctcatatcagtctcttctcacaggcctggaccccgctggacctgagtacaccagggccagtgtggaagagcgcttggatgctggagatgccctcttcgtggaagccatccacacagacaccgacagtgagctggggtgaccttcctgggatgagggaatgagctcaaggcagcgcctaggaggctggcatctagctctgtggccctgggcagagatgccctgaccctctctgagcttctgttgcacagtgaagagtttaccaaaatgctattgaaagtctcttccagctctgtctctgaccactgaggtgaatggttgtatttttagctactgtaggcaagaggattctcatttatagaccaaaagtatttggttatgagcctcactttctgattcaaatgaatgcagtaataacagtgtgctgagcagtactgggtagggcattgctgcctggctgacttacgggaaagtcatgaagattttttaggatgggtgtgcctggtcccaaggtactgggccattccactccccaggcaggcaggcctgtcacaacttccctcctccccagatgacaagcttggcccttcagtccagtggagaataagaatctctcttccgggccgggcacggtggctcacgccagtaatcccagcactctgggaggccaaggcaggtggatcaggaggtcaggagatcgagaccatcctggctaacacggtgaaaccccgtctctactaaaaatacaaaaaattagccgggcgtggtggcgggcgcctgtagtcccagctactctggaggctgaggcaagagaatggcgtgaacccgggaggcagagtttgcagggagccgacatcgcgctactgcacgccagcctgagcgacagagcgagactctgtctccaaaaaaaagaaaaaaagaatcccttttccaatagtgacaggcacaggaaagactccccatctctcaacccgttatgaccaaattaagtccttctgaccagttgggaaaggcgggggcattcctcttcatgtctgctccacggcaaatgcctgtggggtctgtgcttagtgtggtgggtgcagggagaaataacatctgtccctgaccagacaagcttgcagctcaagttagagatgtccacatctcatttcctgtggtcagaagcctctttttagcatttaagactcatgattctgaaagaaacacatgcagttgtattgtccaacccttcttcccacctttatttcacagataggaaaccaaagcccacaggcctcttcctagctatgttaggtgagttaagcttgttcatttaaaaagtgaatcctggtcgggcgtggtggctcacacctgtaatcccagcactttgggaggccaaggcgggtggatcacaaggtcaggagatcgagaccatctgggctaacaaagtgaaaccccgtctctactaaaaaaaatacaaaaatttagtgaggcgtggtggtaggcacctgtagtcccagctactctggaggctgaggcaggagaatgccctgaacccaggaggcagagcttgcagtgagcggagatcttgccactgcactccagcctgggtgacagagtgagacttcgtctcaaaaaaaaaaaaaaaaaaaaaaaagtgaatcctttctatccttaaatttgctaaatatgtgacttattaggtacccatttacctaagcaaggcctctcaggccccttcaaagttggagcctctccctgatgtgacttaaaaaaaaaaacattctatttattcaatcaatatttattaagctacgtggcaggtactgagaatatggcagcaatcaacacattgaatgaggtccctgcctacatggagcttacaggctacgtggactgtaggagtcatgaagggaagcccggatgcccattagagagtgtctgcagtaggggtccgggtgagagatgatggtggcttgggcaaaggtggtggcagtaaagacagagagaagtagacagattcaaaatatgttttggaggtagagctgactagactcatgatgggctgcatgtggggtatgagggaaaggcaagactcaaggatggcttataggtcattgcttaacctccaggtcgatggcagtaagcaaataatacacaatcaatttcttccaatactgacagatgacagaaggagaaagtcggggtcttcagcagctgggcctgagccagtctgagggctcaagtctgccacagcagagggtccaggaattggtcacagggacagaaagagggcagaggatgctctcttatctccgctctggagccatgttctatttccactcagtcaggagagcacaaaagatatgtttttggggagactgtggaaatgtgaccccatacacatttatctgaactattactcaaaggaaaaccaaaactactcaatgaggaaacttaccaagtttataacatttactgagttacaaaaacttgtgttacaggatattgttcttgattttcttaggcaaatatgagcatcttaccaacagaatctctttggttccttttagcatgaaaaatccctttagaaaactgggaggctgaggcgggtggatcacctgaggtcaagagttcaagaccagcctggctaacatggtgaaaccctgtctctactaaaaaaacacaaaaactagccgggtgtggtggcatccgcctgtaatcccagctactcctgctgaggcaggagaatcgcttgaatccgggaggcggaggttgcagtgagagaagatggcgccactgcactccagcctgggtgacaagagcgagagagcgaaaaaagaaagcctcagaaaaaaaaaagaaaaagaaaagaaaagaaaagaaaagaaatctgtctgagggctcatcctgtgaagtctcacagcacttagaagtgacgtggcagagagtgggtgggctcccaaggtcagagtttgaggtccgctgtgagccgaccccctgaagtaaggaagttaatggagttgtgcctcctttcagatttgggtattcggattcccgttggacatgtggactacttcgtcaacggaggccaagaccaacctggctgccccaccttcttttacgcaggtcagaaagccagtacaatctggtatttggcaaccccggagattgaaattcaccaacagcttttgtgttgagtcagccagagtgggccatagagggtctacttgacagtgtcctttgctatgtcccataacgctttactcagaatgtattcaaggatggatgtcttcagagcccaggcatttgaggggagggtgtggcacagtccacaccaactgcatcctctacagagccttgctgtggcagaggcaagccattgtgcccaaagctggtgagcagaaggatcaattcactgcccagccatttcaccatatttaccaactcaaacagtcctctaaaattgttttcaagatgatctttttgaacacattcaatgactgtacatttcctctctttaaatacagccttctggaatttttaaaaatatatttattgatatattcttagcagactaaatttgtcaaaatctaaggtcaataattatttggttttcttatatcttatgaatatagccaatatatcagaatttcatataaaaatttaaaatgctgatttctgtttactatgtttttagtcttttcttgctttaccaaatttctaacattttaaggattcctttgacaatcttattgaataactactgatctattttaccaaatttactagttttccaaaaacatgcttcttttcgcaatttgcgaatttctcagcaattctgataaaataggatagtttggtttcaatggcttttgaagatttggtggcatttcaattgaccacttttcattttttcttcataacacaacttgagaagggtttagtttgtctctgccccagctccctgttgcaactggagagagcttggccatacagagtgtcccaaccacaggggaaaggaaagtcaaaatattgcttggccttggttgcaggtctcagcaacgaggtctcaaggtgcagggagagtttaaagaccccaggaccctggagttgtatacagctcaccacatacttcttagttccagccaatttatccaatgttgaatgctgcaaacttaaatagtaaataacagtgaaataagttttggtaaactgggatatttgacaaattcggcatatcagtcatttggcccggtgagcctcagcacattgggtgtagagagtgaccacaaacggcggctgatgcagcagtctcactgctgggtagggtataatgaggttgtaaaaaattggttgtatggctgatgataatggaggtaaaaatatgcacaaatacccattttgagaaatggggcagcatcatcaactctctatatattcccattttatgaaggagagtttgcatgatcatataatccatctcaaggccaggtacggtggctcacacctgtaatctcagcactctcggaggttgaggcaggtggatcacctgaggtcaggagtttgagaccagcctggccaatatggcaaaaccctgtttctatgaaaaatacaaaaatttgtgaggcatggtggtgtgcgcctgtaatcccagctactcaggagactgaggcaggaaaattgcttaaacccaggaggcagaggttgcagtggcccaagatcatgccattacactccagcctgggtgacagagtgagattccgtctcaaaaaaaaaagaaaagaaaagaaaagaaaaaaaagaatgcatctcaaatcaagcaattttcttgatggattatgcttatgtatctcaggaaaagtaaaatgaaaaaagtagaatgtagtaaccatgtacactaatattctgaaaaagtgatttgaggggactcccatgcatgtatttacagcttgctggaatataaaattcaatagagtttcactaaacagcatagatttccatttgtcttgactgaaaccttggttgtgttttttctctgttcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggtaaagtgctacccctttgacttcctttgacaatgtggggaagttcaagccctgctagttgtcccctcttaatgtcctgatgtcctatggtcaagaattctatccaatttgggaaaagaaaattaagcaatgaggtgctcagcctgttcttacttggaggtggacggttggttctcgtgccccacccctcactctctatagtgttccctatggccatccttgccccacacacacccttcccacatacaggttcctccactctcagaccagatgctgcctataggtctttctcacttctggccattctccagttcttcatagaccctaaatctatgacccttcatagaccctaaatctatggtggggaatccctaagagtggaacacaagacctacattacaggtcggatattctggtggcctcgtgagagctggggggatgcctagttgctggaggacttgggcaccttcctggatgatccaggccagtctggggaaaggatgccaggaaggctgcaggatctggcctctaactcacttgtgtagatcattgctatgcatatcccgtggttatccaggatgaagagctccaggaaaaactcctgggcagtggaaatggtttctctccctcccgcactctctcacttcccgctacccctggctgccactcaactgcagcagcctgtcactgcttatatgagtgaaatgggtaccagcttgacaaaatagtaaagtagggtagcttccaatgatagaaccagtcatcattatttcctattcattgtgcatatgtcagtttcccctagatgccatggacccacagacataacagccacctcacactgtctgcccagcctcatctctcactacactttctcttgcactgaacacctggtggtgctaactacttgtacttccaagtgtacatcgggcttcctcacctgtgtgccttggtcctaaccatactctcttcccagaatgccctctctccacctgtcatccactagtcttcaggtcaaacacttcctgcttcaccatgctcccactgcacgggatataaatgtcatgaaaacaactactataggagattggttttgcaagttagagacagattagtgtcagatttcttataataacctgccaagaatgagtcagatgatctgaaaagcatatttccgtttatgtgtgtgtttactgcccactggaccgagttgctgggatcccaggactcaccttagaatacagcacatagtgcgtgtatggtgtagatgtccgtggaataaatgggtgcatgaattaataaacacgtggctgggtgctgtgggaccctaagatagccttctcaggactctgctgtctttgcttctttatttccaggactggtggaacaaggtggtgtcaagatagagccgctccccaaggaagtgaaagtctacctcctgactacttccagtgctccgtactgcagtgagtagggggaaatgcatgagctcagctctgccagggcaccaccagaggagtccagcccagtgtggtagcctgggtgggagtgaatgataagagcaaaggcatcaccggaggtgtggcaacagcccctggtctgaaccaaaactttcagagtgagtccaaccgattgctcttcagatgaggacttgggggcttcttactgtctatctactgatcgtatttcctcttaccctcaaaatttaccctctagtgggtcttctctctcgagtgatgtttaggagtgtcctccggctgcctcctttctgcactctcatttcccacttcttggcgcccaccctatgtggttctcaccctggcagcctccaaggttggggtccctggggaatactgaacctttccctctggtctccttccccttcacagatgcattccagcttctcactgttgctcctaaccatggcatttccttgaagctaggatgctggtgattgtaacgatgttaaatgtgaagtaaaaatgtgtccagaatccatgaaatacattacaagctaaaccgtcatccttccctatgctatgtgcatcttaactagggtgactatacttcctggtttatgctggttatcctggggtcctgtttgctttatcatgtgtacaggataaagtatgccggcttggatgataaacaacatgccacccaattttaactgattttctgatcagcttgtgtcaagtcagtgcagggatctttgtgaaaatatcttcctggtaccagaaggcctggtgccatatgacatggagcctagagctcagactctgtgttcacctggacctggattcaaatctcagcttctccacttaccagctgtgtgatcaggaacaagttatttaaactctctgaactctatatccttatgtgaaaatgggaaccataacagtacctactttaaagaaccaattgtgagtataaaataaaatggtgcacaggagatcactagcacagggactggaacccaatcagtaataatttccttcccttagtcaatcagagaatttgggagaagaatagttagggtgtttgtatcttcatgccagagaaaatttttggctacctcttaggagcaaagtggactacagagtcaactgtgggcttttcatgtccttatcagctctttcaacaacccaactgggagacttaaggaaagggaagctctgagagaccaagtggcatgcccaagtctccacagctggatgaaaaggtcagaactcaactccaggtctcctgactgtaaactctatactccttcctcaccaccaccatgcttccatcttctgagaacctgctgtccgcaggccgtacgtctcagctccccttctgtcagcgccaccccatctgagttggcatgcgggaggatgttttgtctggtggtggaggtggtgttgccaggaccagatgtcctgacttctaattccagctgctgggcagattcacagcaacctgagctggtgcctctgtgtctgtgcagctaagaatatacccagcaggaaagtgtggggaatgcctggagactaacagcatgttaaggtccctgctgagggggttcacagggccatgttttttctgactcttttgtatttattgtgagaccacctccccacaccttcagaagcgtagccctgttggttccaaaaccacagaggggcacataaacaggcatgctctgccttgagctgtcacttctagggatggaagcggagtcctccctgctctccctggacagatatgggtagggagggggtagggaccagcagctctccagccactctcaggccatcatggcactgggctcccatgcctagcactcttggtctgctttgacttcagcaatgttgacctgtgccaggcatgcgccagcatgggcagaggatcttctaccaaataataatttttaaacaatatattccctcatagaacagtttttcacatagtgtaccttttctccattacttcactccatccttaccatgtcctgtgtgataagttgagggctatggcttgcagatgagggaactgaggcatggagaggctcagtgtcttaggcaaggcagcatggcttgtaagcagcagggttgggccttggatccaggcctcctgaccaaccactcaggactctgtgttgtacgacatgagacatgttcctgtgcagatttgattccactaattcccacccacccaacattaggcctagctcccttggggcctccagggtaagtgaagaaagaagtaggccaggtgcagtggctcacgtctctaatcccagcacttcgggaggctgaggtgggagggttgcttgaggagaggagttcgagactgcagtgagctgattgtgccagtgcattccagcctgggcaagagagcaagaacctgtttctgaagaaagaagaagaagaagaagaaggagaaggagaaggagaagaagaggaagaggaggaggaggaggaagaagaagaagaagaagaagaagaagaagaagaagaagaagaagaagaagaagaagaaggagacagaatcttagaaaactttcttaatcaatgatacttgctagcaaaggaagaagtattaataatataatatagcaaactcagccctgagaattaaattcctaaagcttctgtaagttagctattttttccacattgcaaatatcatcctttccagttcagcccttgcccgtccccataacaattgatatcccatagtaacatctgagaaggagagacagacagggtgtggtataagatgtcctcctctgtggaggggaagcattcaaggcccctttcttcttgtgggttcttggcatcttggcaccttttggtgagccctgttcctaaccccagggagctcagatgggccatagcactccttcaacttagtgctgagttcacctgcatccagtttatgttcccttccccaatgttagcccataaaatgtggcaaatgagaaagtacaggtagagtagaggcgaaggattgcatctctagctatgttcccatcaccaaaggagcctgggaaaattccgagactaaagtgattgcaaaatgccaccaggttgcacctaccccttagtaaaaaaaaaaaggacagtgtgttagggaaactgtaatctttcttttcttatttatttatttatttagagacagagtctcgctctgtcacctaggctggagtgcagtggcacgatcttgactcactgcaacctccgcctcttgggttcaagcaattcttctgcctcagcctcccgagtagctgggactacaggcatccaccaccacaccctgctaatttttttgtatttttagtagagacggtgtttcaccatgttggccaggctggtctcgaactcctgacctcagatgatctgcctgccttagcctcccaaagtgctgggattacaggcatgagccactgcgcctggcttttcttaaaatttttaattttgattttttttgagacagggtctcccactgtcacccaggctggagtgtggtggcacagtcacggttcactgcagctacaacctcccatgctcaggtgatcctcccacctcagcctcccaaatagctgggactacaggtacacaccacatgcccaactaattttttgtttttgtttttttgtagagactgggtcttgccatgtggcccaggctggtcttgaactcctgggctcaagtgatctgcccaccttggcctcccaaagtactaggatttcaggcatgagccactatgcctggcctgtaatctttcttaccttctcttgccagagggacagcaggtcccaggggtatcaccatggcccaggctgtacacccagtctatgttggcgacactcactttgagagctccagtgtccatgctgctcaagggagagtctggatgccacataggtaaccagcggctgcagggagaggagcagtctcctacacacacagcctgcttccctgacgctgggtgtgtggagagggagcagggccgttgctgtatttaatgagttaattctctctttcttttttttttttttttttttttttgagacagagtttcactcttgtcacccaggctgtaatgcaacggcaccatctcggctcactgcaacctctgcctcccgggttcaaatgcttctcctgcctcagcctccttagtagctggggttacaggtgcctgccaccatgcctggctaatttttatatttttagtagagacagggtttcaccatattggctaggctggtctcaaactcctgacctcaggtgatccacccgccttggcctcccaaagtgctgcgattacaggagtgagccaccacgcctgaccttatgagttaaacctttagtttatgtcttagtctacttgtgctactatgacacagtacctgagactgggtaacttacaaagctcagaaatttattttcccacagctctagaggctgggaagtcccagatcaaggcgccggcactccatgtctataagggttgcactttctgctcccaagaaggtgctttgctgttgcattctccagaggggacagataccgtgttcacacacagcagaacgcaggaggtcaaataagggccctgccaattcccttgagcccttctataaggcactatttcattcatgatagtagagccttcatgacttaatcccttccctcaaaggccccacctctcagtactgttgcacagagcattcagtttaaacatgaactcggaggggacacaaacaaaagatagccgtatatgatagatgcattttggctcattcaagatcatcccaccatgaatatgtcagcaaacaaggggaagtaaaacattagtattacaaaataacaaaaactaacattactgaatgcttcctaggcacaggcactgtcctgagaagttcatacatattaacccacttatttcagacctagggtatctatttttttttttttttagacggagtcttgctctgccgcccaggctggagtgcagtggtgcaatttctgctcactgcaaactctgcctcctgagttcaagcgattctcctgtctcagcctcctgagtagctgggattacaggcacccgccaccacacctggctaatttttatatttttagtagagatggggtttcaccatgttggtcagactggtctcaaactcctgacctcaggtgatccactcgcctcggcctcccaaagtgctgggattacaggcgtgaaccactgcgcccagccaagtgtctatttttattatcctcaatttgcacttgaggaaactgaggacctgagattataggtgatctgctcctgggcacacagccactaagagatagagccaagattcccaaccacactgctgctctctggggtttttgcccattgcaccttctgccctctggccagtctctgttgtgctttggtttcctagtgcatcacagcctcgtggagtttcacttgaaggaactgagaaacaaggacaccaacatcgaggttaccttccttagcagtaacatcacctcttcatctaagatcaccatgtacgtaagtgtcccacctggttgactcctccccttaggagttggttactttttcattttacacacatggacatcccaggtcagggactgtgtgattgctgatgcatgggcccagccggcttggctgggggcagcacctactatagatccagccacagacacatgctgaggagctgttcagtagtgggtccaagtatagcagattcagatgagagtaggcagggcaagcaggcagcagggatggcatgtcccaacagatggagaggacataggaatcaggtccctgagaggaaacagtactctggaatccagacagtgcgggtatcagggatgtcagtagggaggagggcctcagtcaccagcccaggaagggctagccagagcctggagagcacccactcctgggaaaggagagcagttctgggtcagttaccagaatggaatctgaggcacagggtcagtcagcaacggagtgcgagctgagggccagactagcggccaggagggcttggtgctgggtgattcctgaaactgggggtagtcattcccttcctttgttggggcagacttgggcttgggggctggtgggactacgcttgaagtgagagggcaaggaaccccaactgtagggagccacagcctgcaggggataggaagtcagcagccatggtgcatgcttctttaaaaagcaaccggttagttattcacaagccagcgggagacagattgtcagataatgtcactgtctcagtgagagtccggtcaggaaaacagaggaggtccaagagaaggaatttagcacagtgaactcattacaagtgtgttggatgagctggaaaacagagatggggacacaatgcagagattaatcacaacaggagccaatacaaccctaggctagagggacaaagcaggagtggagttggcaaagctgggtccacagggaaggctgcttggcaggagctgaacccatgggaagtgcggcccctctggaacccctgcccaaagcagccacccacctgagcatgcttccactgggttagacctcactggaacctgttggtgggggaacctgcaggggaatagatcagtccagagcaaacagggaaatgaccagtgcacacacacttaaatgagtgagcaatgccctgagagtgacagcatagaagacagagtctgactgagtccaaggaaatgatgagcaggctttccaggagctacccaggccaggcttagagagaatgtgacacctctggtgtgtctggagcacagatttggggttgtggggatgctgtgaggctggagaggcaagtcagagccagaccctgccaggccttgaaggacaggtttttatcctgagagtagtttggagagccactgggagttttaaacaggacagtgatgagatcagatgtgagtttggagatatttctcgggttgggatgttggacatgaactctgctgtgaggcactacaagtttctgctggaaggagtgcatttcactcccaaaaccgtggccactagctggtgttccttctggctcacccaaagtcacacagctaggtacagccatcaggattccagcacaggcctgcaggtgcccacagagccttgcagattgtggctggatatcagtaagccaagtacctttcattagacccgctcaaggttgtgctacttctagaagggtgttttcatcatcttctagcccattggtaggtccagcaacactggcaggagtcatgaaaatgacccacaaccctgactgcacgttagaatcacctggagagctttaaaaaatactgacgccaagccccccaacccagaccaatcacatcagggtctctgggcataggctccacagctacattttaaaagctccccgagtaattccagtcaacatccacagattagcgcttcctcctccatgaagaggttcacataactcttttgaagaaggcaccagaacatgattcacttcttgcagatcagaaattgggggaaaaacggggaggttatgtgtggtctttttccaaatttctatagctttatgcgacgctaagatttccttctaattggagaattaacctgggccaactccccaaaccactcacttaaaagatttttcatattccttgtattttacaaactcttcagtctaagcttaaaggaaacaatcttatttattccctctgtaatatttcaaaagacttgtgaatttaaaaaaagagggaatggtttttaaacaaaattatacatgatcttccctcagaaggaaaaaacaagtgatatgactaacactggactaaaaagaacacaaagaggccctatcaccactctgcgaaggccagaaaggaacaggaaacccagttggcaagggtggttccccacaccacccctgcccccgccgagaggaacgcagcgccctccttctttcctctttttcagagtcccacttggattccagggaggatcacaaagggccccacaagtcaaattccttccctagctgggtggtgcagctctgctgggcgccctccttgatcccccactcaccaccctcaggatctgctggctgggctgtgccttgcactcagcgtgaagactttcctcattgaatctcacgattttttgcttttgtctccagtacctagtacctagggggtaccacagcccttttggaagcaccctgctaggttgatcacttcatactcctccctcatctttgtctcagtccaaagtggtgcctgaatctttaaacataaagggaatctgggggggcaaagccaagaggctgggttaagacagaactggatgccattttcactctgagtctcctcagctgaagtcagtatgaaccaaaccctacggttcaagttcatagcagcatgtagggaagctggaacttacacctagttgctatgtgactccacagccaccttgccagcttaggtaacttgtccaaagccatacagctgggaagacaaacctgggttccacccaactctgtctgcgcttcatgatgttttcttgttgctgtttccacccacacattcatacttagcctaaaacagaaaagtccttacacagaattctttgaaaaggaatgtcctaaaagagggtttctacttctgggtaattagatctgaaggtgaagatctcctccagctaggaatccaagaacgaggaacagtttttccagatatgaaaatccaggagctactattttgttgcagtgtccacttgtttattctaaaaaatcaacaactactttcttggtcatattcaaagctgtaggtgtgggcagaggggctggtgaaggtgacacaaaggactgtggtaaggagctaaccccttggtgcatgacagccaaccagtgccaccagcagagcccgatcggagccaaaggggaagtacaggtggtaagggctacagtcatttactttccctttacccttttcttgcagacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacaggtaagccccagtattcacctctgcaccagatgcactcacacatcaaagaccagtcttggcattagatgtgctgcctattgaggttcaatctcatcatagtgattatcatcttagaagcagagatgacagacacccggtgttttccagaacctcctgtgggaccatcttgggttggggaaattccactgtatttgttctgcatatttggtttctatgtaagattttattagaacaaagttttctcattgcatattttctcctctgtggcctccactccaactgtgtcatgggtcacattcatgggtgtggatccagaatccacatcccctttcccttcctctaaaggcatttatgtcattaaccttaccacccctgggcacttggaccacaggaactggctcttaattgtaggtgattgcagatttctttcaccagacatcatgggaattcaaaagccacacaatgccaagccctgtctcctcaccagccactgctctcttattgctcttctcttccagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagt

SEQ ID NO: 38547 - DNA, 14700 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgagtggcaggaggcctgccccggcatactccggcgggtgtggagggaaggagggctggcccccagcgtgacctgggacaaaccaggtcccctgcctgcactagtttcctgatttgaaagaagaggggggctagcccttgcaaaaccgatggcaaccgcagtgggaataaccatggttgtttttttgtttgttttattttttgagacggagtttcactctgtcgcccaggctgcagtgcaatggcgcgatctcagcgcactgcaacctcagcctcccgggttcaagcgattatccctccttagcctccagagtagctgggattacaggggcctgccaccacgcccaactaatttttgtaatttttttttttttttaagtagaggtggggtttcaccatgttggtcttgaactcctgacctcaggtgatccacctgcctaggcctcccaaagtgctgggattacaggcatgagccaccacgccaggcaggttggtcttttttgagctacttgcaggccctatgctaagcactttcactgtttaactgatttaatactcttcaccacccaggaagtaggaattattatgcccattttacagagaaagacactgagaggtttcatggcattaatcaacttgcccaaggtgacatggagggtcgaggagccgagtaaaggcagctggactccaggtcccaccatgaacctcctctctgtgtgttatggggatgtgcgggcagggcaggagcaagccagcttcttcctaccagcagtgctagaggctgtcaggccgacttgctcagatcccagctctgcctttcactagctggagccacatgggcaagaactcatttatatcctgaatgggctgcctggtcttctcccttagctcaacctctgagcctttctccgttcccccttgaacagagcatggcacgtagaagaaatttaataagtatttgctaaatgaatgagtaaatgcccaacaacacggctatattttgatagctgttcccagtgggatattagacaataatttagactaaaatgtaatattattaaaataaccacatatggtgtaaatgagcaaaagcaggaggcaggactgcatacagataggactgcagccatgtggaaagacgaggtgtcaacgaaaggaaactggaaaaagattgtcacagtggtatgatcaggccactggactaattgcactttcttcttgtctcagtttatcaaatgttctttgattgcacatattatactcataaaggggacatttttcaaaaggatcgtttcatccaattggcacccacaattcagcacctagcagtttccagtgtccttgacaaggagtcacttgtccagcttgtttaggatcctttgatgatgacttcatgcccccaggccagccctggccatctcttttctttctttctttctttctttctttctttctttctttctttctttctttctttctttctttctttccttctttctttctttcttcctttctttctctttctctctctctctttctttctctttctttctttctttctttctttccttctttctttctttcttcctttctttctctttctctctctctctttctttctctttctttccttctttcctttctttcttcctttcttttgacggagtctcgctctgttgcctacgctggagtgcagaggtgcgatctcagatcactgcaacctccacctcccgggctcaagcaattctccctgcctcagcctcccaagtagctgggattataggtgcccgctaccacgctggctagtttttgtatttttttaggagagatgtggtttcgccatgttggccaggctggtcttgactcctgacctcaggtgatccacctgcctcagcctcccaaagtgctgggattacaggcgtgagccactgcgaccggccagccctgaccgtttcttacttcttgttgacattctttctgacctagagacccccaatatttgtcaatgggaatctctcatcttcctttaatcctattatttcattgacatcccactagcacccccaacccagtacccttaacctgtgtcattgaccctattgacctccagagagcctcacccatctagtaccccctgtggcaaaactgatcttctggaggccaggccactgagcagagcctcccgtggcatcaacagggccagaagctcctgtacgttctccccttggctgggcacgaactttgggtggagcaaaggcaggccacaaggcctcatgaagtcgggacctgatccctaggacagtgcagaaacaccaaaatgatttgaggcaggaatggacatcactggatttgagctcttcaaaaatggctccggctgcagtgtagatagcatatgggttaacaagagtgggtacttcacaacaggcaggaagcggctgcagaattcaggggggcagtcagatggggatgtgggggtgggtgggactggcaccatctggcaacagctataccccaggagctgcgtgtttcacatacttgctgatttcagaaagggccatccatcactctcgacaaagcatctgctcattctaaaagaactcatttatatcctgaatgggctgcctggtcttcccccttagagttacaatagtcacattcatttacttccaattaataaatggaagtggctgcttctaatgggacctattcaattttctgcttgaaagtctagagcgagaattatcagtgagctggtatgcccctccctccccacttccaggaggaccccgcagaatctccaatggaatgcgggtttaagtgcatctgtgtggactataattttacatttgaaaaaggaaaaataaatacttgtcttttccccaatgcaactacagaaagtaaagtttgacaaaatcgccctagctagtggaaatataaatctctacttgaaaggcagtaatggatcctgagatttgcaggggcatggaaagggtgactggtttagcaatgtagagaagtatttattctctccattgaaatggcccctagtcctcactgctttttttttaaatgcagatgcccaggtcctgccccagacctgctgagtcagaatctgggacctgggcctgggagatttggaagcagctagtgcagctgactggagccaacagaccagaaggggcctggggcctggctgttgctgattgatccaaattctgggtaaagattttcagcccatctgcccttgctgggaggcctgaaaaaaaacgtttttttcaccaggccagaactcactcttggggctgtgcctgggaccacctctgctgtatatcagagggacaaaagtggggtgaaaggatgggtcacagtaggcttctctgcttgcctctccgaactgcagaggaaattctcgctcagacttctgttctttcggtaacatgcatacaacatttttaataatgtgcaataaaactgagatcttattggcttttttctgattataaaagtaatgaataggccgggcgcgatggctcacgcctgtaatcccagaactttgggaggccgaggcgagcggatcacgaggtcaggagatcgagaccatcctggctaacaaggtgaaaccccgtctctactaaaaatacaaaaaattagccaggtgtggtggcaggtgcctgtagtcccagctactcaggaggctgaggcaggagaatggcatgaacccggaaggtggagcttgcagtgagccgagattgtgccactgcactccagcctgggcaacagagcaagactgtctcaaaaaaaaaaaaataatgaatagtgtaggttgctcagtgaaaaacaaagggataaatcaaccagaaatgaacaagtccatctgagacatctgttgtatgtgttcctctgcgacaataaaaaagcagtgtgtgtcatgggtatgcaaaagcagctgggccaaatgtcctgatctttagcaagtgactcccaagagaaggattcattcattcactcagcaaatatttactgagcatctgtttgtgatcagagactgggaaagtgtcggaacgcccaccacccactgacccaagaagtgtctctgtaggagggaggggtatgggtacagagagtgccccggacccctttggccctcactgtcaccccttcctgaatggcaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccaggtaaggaggggctctgggtgcagggagcctccaagcctggagaagcgctggatcgctcccggggaggcatggtccaggttgcagacattctggttcagctacagtgatagctttttatgatgatctgctctccagtgggccagagctgcccgctgtgactgaggatggaggtcaaggtagtggtggtagtggtggtggtattattggttgccatctacgtacagaatgtgtgaggatggggctgggggcggtggctatccctctaattccagcactttgggaggctgaagctggtggcttgcttgagcctgggagttcgagaccagcctgggcaacatggtgaaacctcatctctacaaaaaaatacaaaaattagtggggtgtggtggcctgtgcctgtggtctcagctacttgggaggctgacatagaaggatcaatcgagtccaggaggttgaggctggagtgagccatgatggtgccactgcactccagcctgggtgacagaacaggaaaaaaataaaaaaagaaaaatgaaaaaaaaggaagtgtgaggatgatcagggtcttgacagtgaagatggtagtaaggataaggatgatggtgttggtatctacactgaagacacaaacattggcaatgcggatgacagtggcattaaaggagaggatgatggggatgatgtttccaatgaaggctgttaggatacaatgtaaataattccacattaccctgttactaaccatcacagcgtcttaggaaatcggccaaactcgctccctcctcattagctgacatccaaaggaggaaggttctgaatgaccttgcataggtcccatggcttccttttgcccctcgccttcctaaattaactgtctacttatgccaagcaaatctgtctccagaccttgcagccagttacagctcctgtcaataggatctaaatgaaaaaggtgaagaacatgctttccccagtctggcatattgctagaggtttgtaagttgtcaggagccgagaagtgtggtggttttcattacctatcgctgcctaacaaaccacaccagagcttagtgatttaaatgacctttttatctcctctcccagttctgagtgactgggctcagtcgggccgttctgcttctcgtgatggcactggggttgcagtcatttgggacctggaaagggctagaacttctgagtctgctcacttacatggctggcagtcaatgtgggctgttggctgtgagctcagatgggactgtgtggaccagagcaccttggttcccattcgtgtggtcttaccatgtggcttgaacttctcacagcgtcgtgtgagggttccaagaggagggagctttccaagaatgaatgttccggggaggaagaaagcagaagttatgggtcttcttaaggtccttaagaggcgttgaagtcccagaccaccacttctgcttcattctaacaggtcaaagctgtcacaaggccagcagggaaacaatggcagtgaaagtaaactccacctgttggtggcaaaatggcagcacacgctgggaagggtggagttgacagtggctgtctttggagatgactacactaatattgtcccttttggaatctcaaaggacagtgcaaggctcttggacaaaaagaggtcagaaagctctcaggacaaagggcaaagggcaaagggtaaaggctgcagcagtgattgatcaatcttgtcgcctactgatattccctctacccccacctctccactctctatgccttgtcatggagggagagggttgccatgttgactgttgaggaggatggacttgagacagcaaggggggggaattttggtgtatcaaatctgtgacagcgtctctctctgagtcaggcttggactgggactcccctggttcccgtggcaaattgatgctacgagccaaaaaatcccttcagactgttttccacagtctctggtcttacttccctcaggactcagaggggccacagctctagagcggaatgagtcttggctaggcacttttgcagcaaaagagaggatagaataatattggcagtagtggtgccaacattgaaaaagagtgatggtgatgtgaatggaaaccccgtggagaggacgattttgctgacagcagtcaccttactaaaggtgatgatagtaaggatgctggccttggcgatggtggtgatgatggcgaaggtggtgctaacagcggggtggaggagatgagggtactgatttcagagacgtgctgatactgggaggaggattaaattagggggtgatggtagaagtgaaaacgttggctgaggtggtggggaagattatggctgctgcgtttgtttgtttgcttgttttttgagagggagtctggctctgttgcccaggctgaagtgcagtggcacagtcttggctcactgcaacatccgtctcccaggttcaagcaattctcctgtctcagcctcccaaataactgggactacaggtgcacgccaaaacagcctggctaatttttgtatttttagtagggacggagtttcatcatcttggccaggctggtcttgaactcctgacctcaggtgatccacccgcctcagcctcccaaagtgctgggattacaggcataagccaccaagcccagccttgactgttgttttatctgctgcctctggggtctcacagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccaggtgagcatacctgccctttttctctgggggcctggctccccactcaccatctgaatggcctcatttctcatcacagaggcccagggcatgtggaaagggggaaagtctgggaataaagtgaggtgctgccccgtaccagctagcatggggcctggcacaaagccgtctcagcaatccaactccctcggtggtacggcaagaggaactctggagacagcttcctcctgctatacctcctgcgggagttgaattactgggatggctttgtgccaggctaggtccttgaataagtcacctcatctctctgggcctgtttcctcatgtgtacaatgggtggcttaaacgagaggcttttccagctctgctgcattcagattgtccgacttggtagctgaggcctagagagggtgtgtcagttgcccaaggccccacggcaggcaggtcaggggcaagctcacaaaagtgagtactttgcaacagtggttccccagcctggctgtgcttcagaatcaccggcagagcttttaaaaatatgctgttttaaaaacagattccaagtccaaccacaggctattgaatcagaattgctggggaagtttctagtttaagaaacttttcagatgatacagatactcagagttgagaactattgtcttccactcaccatattactcctcagtggggaggttagtgatgtgtttgtgtgtgtgtgtgtgtgtgtgtgtgtgtgtgtgtgtgtgtgtgtgtgtgataggagggtgggcagcagcttaatgctagcccccaggccataaggtcattgccttccatacccccttcacaggaacatttgttggagctcccagcctgctacttaggggcacacagtatttctatgatgagatggcggcatgtggtgggagggtgtccatggctgattctcagtcataccaatcagatactgacttccttccataccagttggtaaatggctgctgccctgagcagtccacatgctctcccctgccccagcccttcctgtgggagtctcctggatcctactccattatatagcaactaaaggggcagtgcgtggtattggaggtggcccctgggccctgctcctgcagctgtgtccagagccattctggcaagtccatgtctatgcagtgcttgtgtcaacctgtggactcagcttggcttcagtgtcagatgagaactccctgtgggggcagccattatctttcccatttcagcaaacatttatccatgcttaccctgtgctgggccctggggacacaaatactagtcagaccagctgtgcctgggctctgggataaggctgcacgcactgcctacaggcctgagagcagagcacaggaagctccctgcccagcccagctacctaggagaaaggagggtgggaaggtgactatctccctgagactgggagaggggacagctgcccagctgtcctgtggtacggcgctgaggaatgccacctaggagttgggagggggcatggccgtttctgttccagcctcacccctgtctctcttggcagatgcagtccacctatgtcctgcagggtcttcacctccacatcccaaacattttcccagccaacccggccaacatctctgtggccctgagagcccagggcagcagctacacggtgagagataaagcatgtgttcggcacccagttcagccaggtagcggcttcctctgagaagaggaggaaatgaaactgccttcacactcccctttcctgcctgcaaggcaacctcaggatacaggaaaagcacctggagggtgggaggacttgtgtcacagcgcagggatcctgccaagatgctcaactgcttgaaggaattcaggccagctgcacacccccatgctgctgctctgaagcaggtctcgctgcctaatttgcaccctcagatcaagcatacttaggtcccttttcaactcttccttgtcccctctttctctgggacccttagatacctagatctctgcctttcccagaactttctaaaccagttccttggcatttcagactcatgaaatgaatgatctgcagagctggcagatatatgagaaatttgccattgtagtccatttccttgcccatggcagacatcactagtcaatcatgactttttttatgctgagcccataaatgttccataatcagccactaccaattgataaaagttagaatacaagaggaacctatttgccatctctacataatcccactccctggttacacagctgaggagcatgaactccagagagggaaaggagctggaccccagggtcacccagggccagtctagagtccaggtctcctgactgcagccaggctccttgcactctgctagcctgcctctcctgacttcctcctgcccagatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggtgtgcagaggggtgtggggcagggggctgaactttgggcttggggaagtctgcttccaccatgggctgatgctgaagtggtagcctggaccaagttcagcctctcccagtgggcgtcagtgttggcttcccagaggtgcaagctgaaagagaccctcctatctaatccagctgcccctcattttgacagaagaagaaactcaggccgagagaggaacaaatattttcccccagtgaattatcagctccttgaaggcagagatagtttttctttttttattcactgctatgaacatgcacgtgggccctccataaatgtgttgaatgaattttccacttagtggcaaatgaagacttaaaaaaaaattatcttccttcttccatttcaaaaggatctgaagccatttgttacaaagtgggggttggtgggggcagtgggggggatcagctaaagaagtctttcacactgttgcacaaacctgaaccctttttacttagtaactttatgaccctgaagttccttagagtctctgagctatgtctttaaaatggggacaggtgtcattcggaccctgagcagggctctgcccttgtggaactcagtctgatggggggtgttgtgaggattacagcagatgaagtctgtaaagcactcagtagtgtgcctggatcacaagtatgagctggagaaatgaaagctccataaacggtattgtgttgaaagtgtgaaaacccaactagattttattccagctatatccttaaagcagtttgtcctattttatcctcacaataatcctgggaatgttattcctgcttcttgagtaagggaactgagtctagagaggttaagtgatttgcccaaggtcacacagctagccaggctgggaacccaggtcccccaactccatgtccaatgttcattccactagagcacagctatctcccaagcaacacaggagaaggagataacatagttaaacttgaaagccaggttagaaacactacagcaatacttgacgttgcagtagagaagtcatgtgatatcatggaaagtaggccagctttgaaaccagacataccagagctcaaatccagccctgactacttatcagctgtgtgactgtgggctagttgcttaactttctagttaagcacttgaaagtgctagttatttcactttcttccgcagcaaggatgcatggtaaatgcctagcacataacaggttctccattaatgagagttgttagtgttattgagtgcaaaactcagcttggagcttctagcagccaagaccaaaagggaggagttggtcacatcttggccccctcctccaccccccagtccagcattcttttccttgcctgctgctcaatctttggctgcttcatgagtaccccatccccaccatgtacaagctcttctgtgggctaagctgcctggggtgggcctgactataatccccctctgctcctccaccaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggtaccctggatcccctcccctgctcctgcaccagtgatgggctctgcccggtggcacctcaaagtcaggtaccccagggatgcagcccccagggcccatctgcatggaggaaggcagtgttttctgaccagggctcattcacccaacgggggtctataattagcacctggttcaagtcagcccctatgtgacaggcactggggatttggaggcgagcaagaaacttcccacaccagctctccacgtattcccctggtgccaggttctccaccctctgtgtctttgaagttgctgttccctctaccttagactgaaggtgaactccaatatccccttcaattctgagcctaaataccaaggtccttgggcagaaggggtcctcccttcccgccccgtgttcatctctctatcatagcacacagtactctgggtcatagtaatggatttctatgtccttcgctccccaccctcccaacccccttccccgggctgggagctagagctgcaaggctggggcaggcccttcagtcagcaaaaaagcaagggcttcctcagctgcgggcccagggctaggctgggtcagacataaagaaaagactgaccctgggagctcactcagatggggagagagtcaggcaaacagtgagccagtggagtgctgtggaagtcagggcagagtgcagtgggagcccttaagcatggagaggaggcgggcaggtgagtgggtaggaggagcggtcttacaggcagagggaacagcataagcaaaggcccaagcctttgggaagcgtgggggatagggctggagaggcatgggaggtgcagggagccgaagtgtcgaagggctttgtgcgctgagcctgcaccttgggatttctcctgaaggcaacagcgcccctcctctccagggggttttggccgggaaaggaccccatccgaggtcctttagactgatgctcctggctgtgtgaggaggacaggagtcaggggagtttaagaggcatttgcagaaagtgaccagggctggggttggacccagggcagagggaatagagagaaggacatatatttagaatagatttcagaggctgtatcaaaacaatttgacgatgacgttgaaggtgggcagagagggtggggagagagaggaggtaaagatggtgctgtcactgaaatgatagacctggcaggaaggggaggaggggagacagagctattggggcagcgcatggagtaccccggtgcaggggttcagccaggaggcaggtgagcagggcagaggggaaggcggcattgatgcatgggtgctgtcattgccactgagtggacaggcatccaggggaagcctggagggtggcttggtgggggcagggtcaggggcagcaagcaggggcctgggcctgttctctgcgcctgcaccagcccctgagatcgtctctgctccccctctgcaggcctggagtttgcctactcagaggccccgcgctccatgcagggtgccatcatgggcatcttcttctgcctgtcgggggtgggctcactgttgggctccagcctagtggcactgctgtccttgcccgggggctggctgcactgccccaaggactttggtgagtatggggcctccccaggagtgggacatggatggagggaggcttggaaaggaggtggcaactgctaaagtgctttgactctggggagaagcaagtagagggctagacttgggagaatggggttctagcccgggcttggccagtcacccacagcgtggcctccctccttgggcctttctttccccaagtgttgaacttagtggacctccaaggctcctttctgcttctggaactctgccatctctggctgaagggttacctttctcatggtgtttatatttcacgcccccttctgaatagctgaagaggaattgtagacacccctggagatcttcaggaagtcaaacattagtgggtatctgtccagtgtcttcagatcccaccactgcccacatggcctcagttgccagccccagggctaggacacggcaggcacagggcgcaagacagaggatccctgtcctgacccaaatctaacccctcctttccccagggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcac

SEQ ID NO: 38548 - DNA, 47458 bp, Homo sapiens
gctcccggggctgaggtggagccgcgggacgccggcagggttgtggcgcagcagtctccttcctgcgcgcgcgcctgaagtcggcgtgggcgtttgaggaagctgggtgagtcctgtctgtgggtctccggcgccaggcaaccgtagagggctcgcgcccgccgcccgcgcgtaaggaggctccctcgtcgggccctgtccggcccggccttctgggggctgtggggccgtccagccgggttttccctgcgttcggcgccggcctgcagactcgggcccgcggagcccccgccgccccttcttgcccctgcccgcgtcccttcgggccgaccgtgaccgtggcgccgccgcgacccgcaagcagcccggggaggctgccctgccgcgctgtcacgccgtcaggttgcgttcctggggagggctggagaggctccatctcgtgcctttcaccttctcgcgcggcgggcacggaggcgacggttttcgggacgccctgctgcggccgcgacgccctcccgaggccggagcgagggccccggggcggctccagcccttcttcgcccctcccgtttgccccgaaccattgctaggagcctgtgttttctgcacttttctgatttcattcttacgagagtcaagtacagaggcgggaggggaaagggaaggggaacaacattctttcgagaattataaaccttgagctccgttaaataagtagcagcagagcattgtcactggagcagtggtagtcgcgggtaggaccgtttcggtttttagccaataggctggttaaaggtacttaaaacagtaagttggaaggtgctgaaattctaaggtaaatacgtgacctttcaaaaccaaagcagtgagacgggctaggctgggctgctccccgctgcgcgtgcctgggtcggggggtgcggaggggcagggggcggaggcctcggacgggacggggtgggagggaagtggcatccgcatcgtcttacatcgcgctgtaagacccgattttctcttttcggaggatcccatctcccttctcagactcttcatcctacctgcactgtggatcccttgacacttcagaggctctgaactctcaggccggtcacactttttcatcattttgtttcttgtcttttaaacctgcatgcatttcaaacgtagagcaaacattaaactttttttttaaactgaagatagtggtgcaagactttgttattgaaatgcaaaccaaaagttatcttgaatatttatcgcgctggaaaagcaggtttaattagagtgaggtggggacgtatatttcttcttccggagacacagccttcccactcaccaccccaatccctcctctctgtcaactagggttacagcagccttacactggctagtcttttctgaattctgaattcacttctgggggccaaggtaaagaatttatcgtattttatcctcattttccttttctgttttttttgagacagagtctccctcgttgaccaggctacaagtacagtggcccgatctctgctcactgcagcctgcacctctagggttaaagggattttacagcctcagcctcccgagtagctgggatcacaggcgcctgccaccatgcctggctaatttttatattcttagtagagagagagtttcaccatgttggccaggctggtcttgaactcctgacctcaagtgatccgcttgcctcggtctctgaaagtactgggattacaggtgtgggcaccgcgcctggccttttaaagtgtattattattatttttaaatttatttatttatttattttttgagacagagtcttgctctgtctcccaggctggagtgcagtggcaagatctcggctcactgcaagctccacgtcctgggttcacgccattctcctgcctcagcctccctagtagttgggactacaggcgcccaccaccacgcccggctaattttttgtatttttagtaaagacgggttttcaccgtgttagccaggatggtctcgatctcctgacctcgtgatccacctgcctcagcctcccaaagtgctgggattacaggcgtgagccactgtgcccggcctaaagtttatttttaacttatgtatatatatatataatttttgaggccgagttttgctcttgttgcccaggctggagtgcaatggcgctatcgtggctcactgcaacctccgcctcccaggtttaaacgattctcctgtctcagcctcccaagtaaactgggattacaggcgcccgccgccacgcccagctaatttttgtatttttagtagagactcgaactcctgacctcaggtaacccccccccgcctcggcctcccaaagtgctgggattacagacgtgagccaccgtacctagcccgttttactttttaaatgattaaagtaacattcaggttgtttaaaacatttaaacatgacagaagaatatcaagtaaaattcagacagcgcagaggtatgtcaagttagaattccttgtttgttcactctttacatcctcaattccattccctaggagggtattatattataatattgctcggcaactgatgataatataaggacacatttccttcataagcacgtggagacctacctcatttcctcccaaccccacccctcactttggagaccgggtctcactgtgttgcccaggctggagtgcagtggttccctcacggcttgctgcagccttgggctcaaacgatcctcccacctcagcctcctgagaagctgagactataggcgagtgccaccatgcctaatttttgtaatttttgtagagacgggtttctcatattgcccaggctggtcttgaattcctgaactcaagccatccacctgcctcagcctctcaaagtgctgggattacaggtgtgagccatcctgcccagccaacttgcctcattttcagaatgttgcatggtataccgttgtttggatgtaccctaatatacattttttggttccttattgatggacattttgactgtttctgggttttagccattaaaagctttgctttatgaaaatctttttgtcgttctagggtaagtttcaagtagataatataaacagatgattgtactttgatataattttatttcacaaggaatctttttaaacttaaagttgtttttttttttttttttttgagatggagtctcactctgtcgcccaggctggagtgcagtggtgcgatctcggctcactgcaagctccacctcccgggttcacaccattctcctgcctcagcctcccgagaagctgggactacaggcaccctccaccacgcccagctaattttttgtgtttttagtagagacggggtttcatcgttttagccaggatggtctcaatctcctgacctcgtgatccgctggcctcggcttcccaaagtgcagggattacaggtgtgagccaccacgcctgatgttataacttaaaagattttataatttaaaagcagtagctaaatctatttgaattaaatgcatttctaagattccatatattcttttattattttttgagacggagttttgctcttgttgcccaagctggagtgcaatggcgtgatcttggctcactgcaacctccatctcccaggttcaagcaattctcctgcctcagcctcctgagtagctgggattacagacatgcgccaccacctcggctaattttgtattcttagtagagacgggcttttgtcaggctggtcttgaactcccgatctcaggggatccacccacctaggcctcccaaagtcttgggtttacaggcatgagccactgtgcctggctctatatattcttttatatttagaggctggaacagaaaattttgaagactgtattaaataatagaggatttattactcttcttaccacgaagtggtgttgaccttaaggttatattgcctcatttaattgggttggcagaagtgataagagaggtccttcagattagagggggctctgctgcccaggccggagtgcagtggtgagatcttggctcactgcaacctccacctcctgggtttaagtgattctcctgcctcagcctcccgagtagctgggactacaggtgcgtgccaccacgcccagctgattttttgtatttttattagagatggggtttcaacgtgttagccaggattgtcttgttctcctgacctcatgatctgcccaccttggcctcccaaagtgctgggattacaggagtaagccaccgcacccagctgcttgttcttttttaaaagtaatttcttcctgggcgcggtggctcacgcctgtattcccagcactttgggaggccaaggcgggtggatcacgaggtcaggagttcaagaccagcctggccaagatggtgaaaccctgtctctactaaaaatacaaaaaagtagccgggcctggtgatgggcccctgtaatcccagctacttgggaggtgggggcagataactgcttgaatccaggaggcgggagttacagtgagccaagatcgtgccactgcactccagcctgggcgacagagcgagactccatctcccaaaaaaaaatagtaataatttctttcattgcaaattttatctcaggtacaaaaaagcatataaaacatgtataatttaaagaatactattgcaatgatcattttgtatccactaccagattaagaaacaaaatgtttggccagccgcagtggctcaacacctgtaatgccagcatcttgggaggctgagacaggcagatcactgaagactgggcgttggagaccagcctggccaacatgtgaaaccctgtctctaccaaaaatataaaaattagccggtcgtggtggtgggcacctgtaatctccgctacttgggaggctgaggcaggagaattgcttgaacctgggaggtggaggttgcagtgagctcagatcacgccactgcactccatcctgggtgacagagagagactctgtcttgggggtggtggcggtgggggaacaaaatgtttgcatttttttcttccagaggtagcctctgtcctgatttgtttgtgtttatctttctcttgcttttttattttatttatttttattttattttattttatttatttatttatttttatttttattttttttttttttggtgacggagtttcactcctgttgcccaggctggagtgcaatggcacgatcttggctcactgcaacctctgcctcccgggtccaagcgattctcctgcctcagcctcctgaataggtgggattacaggcatccaccaccacgcccagcttggttttgtatttttagtagagacagggtttcaccaggctggtgtcgaactcctgacctcaggtaatccacccaccttggcctcccaaagtgctgggattacaagtgttagccattgcacctggcctcttcagtttttcttgtaggtctcagtttcatcgggtatcattcctttcagcttgaagaattccctttagcatttctttcttagcgcaggtttggtgatgaattatctcaatttttgtttacctggaagtaccattattttactcttattaaaaaaaagaaaactggctgggaatggtggtgcacacctgtaatctcagcattttgggaggctgaggcaggcagatcgcttgagttcaggagtttaagaccagcttggacaactgggtgaaaccctgtctctcttaaaaaaaacaacaacaaccccctcccctgccccccaaaaaacacagctttgttgagatacagtatatatactgtaacattcacctgttttaagtgtacagtcgaatgatttttagtatttacggagctgtgcagtcattgccacaatctagttttagaatcttgtagccttttgcagtcactttgtatctttcttctccccatccctagacagccactaatccgctttatgtctatagatttgcctattctggatgtttcttgtaaatggaatcacacaatatatggtcttctgtcttttacttagtcagttgttgaggttcgttcatgtagcatctatcagtaggaacctctttcctttttgttgctgaatttgtatttcgttgtatggatgtgctatgttttatttatccattcgttgatgtatgtttggttgcttccactccgtggcaattacgaataatgctgctatgaacaagttattgtgaagatatattttcatttctcttgggtagttagataggagtagaattgctgtcaccttcttgtttttttttttttttgagacaaggtctcactgtgtcacctgtcatagctcactgtaacctcgaacttctgggcacaagtgatccttgcatctcagcctcctgagtagctgagactacaagtgcacaccaccatgcttggctatcctcatttttggagaatatttttgctgggtatagaatttgggattgagtttttttttttttttttttttcttccgagacagagtctcacttttttgcccaggctggagtgcagtggtgcgatctcagctcactgcaacctccagctcctgggttcaagtgattcctgtgcctcagcctcctgagtagctgggtctacaggtaagggccaccatgcccagataatttttgtatttttattagagatggggtttctccatgttgcccaggctggtcttgaactcctggcctcaaagcagtctgcccacctcagtctccaaagtgttgggattacaggcatgagccaccacacctggcctgattttttttgtcttaaagcgttattaacagtgtcattcctgtgtcttctagtatcctttgttctggttagaagtgagccatcattcctattgttctgtctctgtatatgttgtattgatttttttccccataagactgtttcaagagtttctctgtatctctggttttcagcagtttgattatgatgttttctttgtatttatcctccttggagtttgctgagctttttggatttataagttaatatttttcaccaaatttgagaaattttcatttattcttttttttttttgagatggagttttgttcttgtttcccaggctgaaatgcaatgaatggtgtgatcttggctcactgcaacctccgcctcccaggttcaagtgatcctcctgcctcagcctcccaagtagctgggattacaggcatgtgccatcacacccagttttgtatttttagtagtgacggggtttcaccatgttggccaggctggtctcgaactcctgacctcaggtgatccacccgcctcagcctcccaaagtgctgggattgcaggtgtgagccaccgtgcccagcccatctattatttttttcaaaatttttttatttcttattctgtcttttcttcttctgggaactttaattacatatattttagaccacttagtattgttcctcaggtctctaaattggataatttcttttgatgtttaagtttactgtccttttcttctactgtatctaatctgcgattaagttcatttagttaattatttatttatttattttttagatggaatcttgctctgttgcctgactggagtgcagtggtgcaatctcggctcactgcaacctccgcctcctgggttcaggcaattctactgccttagcctcctgagtagctaggattacaggtgcctgctaccatgcccagctaagtttttgtatttttagtggagacggggtttcaccatgttggccaggatggtctcgatctcttgacctcgtgatccccccgccttggcctcccaaagtgctgggattacatgtgtgagccatcctgcccggcccatttaatttttaaattcaaacattgtaatttgcagttctagaattttctttctttctttttttttttttttaggggagtctcgctctgttgcccaggctggagtgcagtggtgccatctcggctcactgcaagctctacctcccgggttctcgccattctgcctcagcctcctgagtagctgggactacaggcgcctgccaccatgcctggctaattttttgtatttttagtagagacggggtttcaccatgttagtcaggatggtctcgatctcctgacctcgtgatccgcctgcctcggcctcccaaagtgctgggattacaggcatgagccactgcgcccagcccctagaattttcatttgaatctttttacattttaatttattttttagagacagggtcttgctatgttgcctgggctgggcttgaagtcctggcctcaagcaatcttcctgcctcgaccttctgagtagctgggattacaggtgcaagccatcacattggctcctgattctttttttaaaaaatagtttccttttctctactaagattctccattggttcagttattttgaccatgttttcctgtaagtccttgaatatgatttttataatgggtgctttaaagtctttgtctgctaatttcaatatctgagtcattttgggatttatttctattgactgttctttttcctccttaaaaatagatcacattttcctggttctttgcatgtctagtgatttttttttagtatatattggacgttgtgaataatatgagtcaattttgttatcttcatctgaaaagtattgctttttattgtaacaggcagttaaaatattggctgatcaccttgaaattgtggagacttggttttatattttgttaggatatgtccccaaggtgtttactgatcctccctgacttggtggaatgaaaattccaaaatgtctcccttattttaaagtgtttggggctctctttgtgacttactcctttccgagatgtcccccttcaatttccagctgttatggtggtcctgaactcccatcttctggcatctcaagccaagaagactgtggctttttgctgccactgtggccactttgtgccaaggggactccctgggctgggaatgggagtttaatggggttcctaaggggaacagctgatcccacttactgtgttttctttctttttttttctttgagagggagtctcactctgttgcccaggctggagtgcagtggtgtgatcttggctcaccccaacctctgcctcctgggatcaaatgattctcctatttcggcctcctgagtagctgggattacaggtgcatgctaccatgattggctgattttttttcttttttgagatggagtctttctctgttgcccaggctggagggcagtggctcactgcaagccccgcctcccgggttcatgccattctcctgcctcagcctcccgagtagctgggactacaggcgcctgccatcatgcccagctaattttttttttttgtatttttagtacagacggggtttcaccatgttagccaggatggtctctatctcctgacttcgtgatccgcctgccttggcctcccaaagtgctgggattacaggcgtaagccaccgagcctagccgatttttttttttttttttttttttgagacacagtctcgctttgtctcccaggctagagtgcagtggcacaatcttggcttactgcaaccttcgcctcccgggttcaagcgattctcctgcctcagatttttgtatttttagtagagacgggatttcaccatgttggccaggctggtcatgaactcgtgacctcaaatgatccacccgcctcggcctcctgaagtgctgggattataggcgtgagccaccacgcatctggctgtgttttctttctttcaaggatgaagtttctttcaatttctgcctgtttttcagccctgtccagtgctttcaattttttttttatttctttctagaatttatggtggccttgaaacatttcatgtttacataatatctttgtttttaaaaatagtatgctacactcctatagttatttaggcacatgatttttctccttcttccagttatgtcttactgcgttacagattaatgccaaaaccctgtggcttaaaacagtcattttattatgtttattagattttatgggtcaggaatttggaaggggcatagccaggatgatgtatctctgctccatatatctggtgccttacctgggaaggctcaaacttttgggatggtgctatagctggatagcagttacctaaaagtgtctttactcatgtctggcagttaatactagctgttagctgggacctcaactgtaactgtgggtcagaacacctataaatggtctccttacagcatggtagcccaagcattagtgttccagagaaccaggcagatgctccattgccttctgtgacctgatcttggaagtggcatggagaagttacatagcatcacttcctctactctactggtctactagtctttattgttgacccaaattcaaaggtaggacataaatctacctctcaatggaagaagtgtcaaatattttagatatgtttaatttatttcatttatttatttatttttggacagagtcttgctctgttgcccaggctggagtgcagtggcataatcttgcactgcaatctctgccttccaggttcaagcaattcttgttcctcagcctcccgagtagctgtgattacaggcatgtgccaccacgcccagttaattttttgtatttttagtagagacaaggtttcataatattggccaggctggtctcgaactcctggcctcaagtgatctgcccactttggcctcccaaagtgctggaattacaggcgtgaaccacctcggcacctagctcctagacatggtttaaaaccatagtgctcatttatcaaatagcaagctcccccttgggtcctagcgtagtcctatatacatctcaattaggtacttgttgaagtattgaatttttcttaactatagtagaataggacctaaagtaaagttgtgtgtaaagctttaagaaaggagtaaggtattttacttttagaaaacattttcttaggttgattagtttttgtctttctgtttgtaggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattggtaagtgagaaagactggttggtgacatgtatcccttaccttttgccctggaaattaatgccggttcctttgaactgagaatggctttccagaactatttatttcactgctgttttgtatagatgattatcagagttctagatactattgccaagcagaatatggtaggccctggattcattttgactttgtaaatgtgtacttaatatcttttcttcagttccagtgataatataattattataggcaatagcatttttaacttactgatacaacatatatgtaagtactttaagatccttaaaggctcagaatttgatgtaacccaaaattattgttgtgacttattgaaggtcagacaacagtgacagtactctgcagataatagtaacaaccttaggctccattggaactgaagccctgcagcggctctagggaagaaataccatctctgtttccccagctgcaacatcaggggagcatcagaggaagagatttgtgaaggaaactattgtttaattttctttccatcattttttaactttaattgaaaatgacaggcataaaacaaaagcagagagaatggtataaagattccatcacctcctttatcccatgtgtctatcatccagcttaaaaaaaaaacaccccaaaatcaggacctatcttggtttataattccatcaaccactctctgtccgcacttttttttttttttttaaagagacgaggtcttgctatgttgtacagctactagagtacagttgctatttacagatgtggtcgtagtatactacagcttcaaattcatggtctcaagcaatcttcctgcctcagtctcccaggtagctgggactacaggttcatactaccattcctggctcccacagcattttttggaagcaaatttctttatctgtttacattttaaaaattcatctctttcaatgtacagttctacacctaaagtccaatagaaaaacaaaatgaaatgaagcagagcaagaactaacgataattgtgaagcagtctgctcactgcagtctccgcctctgacttcccaggttcaagcaattcttgtgcctcagcctcccaagtagctaggattagaggcacatgccaccatgcccagctaatttttgtatttatatttgaatgtttttgagacagagtctcgttctttcgtccaggctggagtgcagtggcgtgatctcagctcattgcagcctccacctcctgggtttaagcgattctcctgcttcagcctcccaagtagctgggattacaggtgcctgccaccatgcccagctaatttttgtacttttagtagaaacgaggtttcaccatgttgaccagactggtctcaaactcctgacctcaggtgatttgcgcgtgttggcctcccaaagtgctgggattacagatgtcagcactgcgcccggccttgtatttttagaagagatgaggttttaccatgatgaccaggcttgaactcctgacctcaagtaatccacctgccttggcctcccaaagtgctgggattacaggcgtgagcctctgtacccagcccatttatatgatctgtaggacaaaaggaatgttaaaaagcaggtattgtgctagcaagagttttaatgtttcagtgacttgggctgtgttttaagttttttacaggctggtggataatgattgatgcagctgtggtgtatcctaagccagaacagttgaaccatgcctttcacacatgtggtgtattttccacattggctttcttcatgtaagtatgaagataattctctattcaaggtgatttttctaaaaatactttcctgttaatgtgcagtgctttcttgaataactttttaatttatttgatagactattttttaacatgatacatacataattcccattttattacgattttttttaaccaagaatgagtgttggatttggtcatatatctttttagcacctataacaattatcttgtgatttttttttttcctcatatttttaaatctggtcagttacatattttgtcagttgcaagatctactttttcgcattttaatacctctgaatatcaggatgcatcttacagtcagtggtatcttagaattataattgataacatttttatttcttgtcagtattaaaaattaatggtgtatcttaaaactgatggctctgagatttcatgaaacatgttacgtttctgcatttttttagtagtaaatcacccgtaggtgttgtagtacactcaacttttaccttgcagtattatttttattttttttaatgtgctacttgactgtgtttgccagtgtttgaggaaaaggcaagattggcctcaaaagagatttgtttgtggcttttgtttttattaaattatttttaagtttatgttacctcatttcataaaaaagcttggaagctttttatggatgtcttttaacaattaaaaaatattaaacattaagattacatcatttccttataccatcaggaggtttttttgtttttgagacagagtcttactctgttgtttgggctggaccacactggtgtgatcttggctcactgcaacctctgcctcccgggttcaagtgattcccttgcctcagcctcccaagtagctgggattacaggtgcctgccactacgcccagctaattttttgtatttttagtagagacggggttccaccatgtttgccaggctggtcttgaactcctgacctcgtgatttgcctgctgtggactctcaaagtgctgggattacaggtgtgagccactgcacctggccaggagttttaaaaaggttatattttggaaaatggaactacttatatccattgtggcttctaaaaaaaggaaattcctgttactaattaatgtaccttgctctaacaaaaatggaaggggaagctgaataaagtgggcatattatacataagctacattttctctgagcttaagaaatggatcatagaaaatcacttgacttttaacacaaagagaaactgtttaactcttgataataatgagaaccttgaagtgggatagcactgagtcattcatgtataaatgtgaaatagacaaagaatccagaaaactggtccctcttgtataatctctggagagaagtgatagaaatctcttaaaataaatgtgttttctgggtgtactttatgaaaataagactaatgtaacatttctatcaactagcatttttattaggttaaaaatatgttaaattattcagatactgattttagttatgaaataatctgttttccgtctaagtgttatataaatatttgagtattttaacagcgaatactgaaattcatttgatgattttgtgccgttctaggataaatgctgtatccaatgctcaggtgagaggtgatagctatgaaagcggctgtttaggaagaacaggtaaagatactttgagctgttaatgggtgttgacaaaacagaaatttgtcaccagaaaaaaagcctctcttgtgagtctttattcaagactggtaatgattatatagaatattttttatttgctttaaaacaaagttttagtgttattcaaatccttaagaaagtaagttattgctagaagttactgtttttgtcatgttacactgcccatgatatagataaaaaatgttgctattcaaatggatcttggactccagtgctaatgatggatttattattatcccaattgttgaccaataatgttacttacaagatggctgactatgattattaacaggaaagtaatgaacacattaggggatcaaacctaggactacagtgtctttacattcacttctgatcacctgagtagccacctacagactgcaacaaaattgttcagtagaaagatgctatttgtctacacataaattagtttttatagtttgaattcatttgaattgttatccaatttttgttttttttttttttttttttgagacggagtttagctcttctttcccaggctggagtgcagtggtgggtttttggctcaccacaacctccaccccctgggttcaagcaattctcctgcctcaccctcccgagagctgggatttcaggcatgcgccaccatgcttggctaattttgaagttttagtagagatggggtttctccatgttgatcacgctggtctcgaactcccgacctcaggtgatccacccaccttggcctcccaaagtgctgggattacaggagtgagccaccgagcccggcccaattgtgttttttaaacatttacggccgggcgcagtggctcacgcctgtaatcccagcactttgggaggctgagacgggtggaacacctaaggtcaggagttcgagaccagccctgccaacatggagaaaccccgtctctactaaaaaatatacaaaattagccaggcgtggtgacacacttctgtagtcccagctacttgggaggctgaggcaagagaatcgcttgaacccgggaggcagaggttgcggtgagccgagatcacctcattggactccagcctgggcaacaagagtgaaactccgtctcaaaaaaaaaaaaaaaatttacattataatatgaagaaattaaggtacagtgggcttacataatgtgtccaaagtcacagagcaagtaagtggtggagccaggattgaacatggacagtctggctccagagcccatgcttttagccactatgctgtgcttgtttcccatctagaaccatttggtcactttgtctggtttggtatcacgtgtatattttttctttttgtcagcttaattgaatataatttaagtataataaaattcactaatgtatttattattttattaattttttttgagacggagtctcactctgccacccaggctggagtgcagtggcatgatcttggctcactgcagcctcaacagcctgggctcgagtgatcctcctgcctcagtttctcaagtagctgtgattataggcacatgctgctgtgcccagctaatttatttattttttgtagagacagggttttaccacgttgttcaggctggtcttgatctcctggcctcaagctatccacctggcctcaagctatcagcctcccaaagtgctgggattgcaggcatgagccaccacgcctggccagaatccaccaatttaaagtgtacaatttgatgagcttgatcaaatgtgtacagttacagttgtgtaactaccactacaatcatgatacagaacatttccattgccccaaaaagttccctcatacccctttttatagttaatactcttcccctcacctcgtggccactactgatctactttctatgatggttgctttgccttttctatgatttcatataaatgggatcatatagtaagtatcatagccttttaaaccaaataaagcagctttgaagagcttagctttcttttctacttgatgttttattttttaaattttgtatttattttgtttgagacggagtctcgctctgtcacccagactggagtacagtggtgcgatctcagctcattgcatcctccgcctcccaggctcaagcaattcttctgcctcagcctcctgagtagctgggattacaggtgcctgccaccacgcctggctagtttttgtatttttggtagaaactgggtttcaccatgttggccaggctgttctcaaactcctgacctcaggtgatgcacccgccttggcctcccaaagtgctgggattacaggcatgaaccaccatgcccagccttctacctgatgctttaaatgctgatgtagattttgtaacctcacttctactggaatccatggagaatttgcgagagggtataatgacaaatgacagatgagcctaagtttaaagtgcacaatatgtgtgtgtatgcgcatgcgatcgcgcttacttttcatcatatcctgtatgtcagcctcagcagtaatgtcaggaatgagggaaggtaaagaaaaaatatatattagcaagtgaagatgttgtatgtagagcatacaataatgtactccatcatttttctttcaagaatattccacggacattgctgtgaattatgttactattatctttttttgagacgaggtcttgctctgtctcccaggctagagtgcagtggcatgatcatgacgcagaaaagccttgaactcctgggctcaagcaatcctcccctctcagcctccagagtagctgggattaccggtgtaagccactgtgcctggccactattatctgttttttataggaagtttcactgtaacttatccaaagttttttagcttaaaagtggaacctgtatttgtctttggtctgtctggttcccaagcccgtcgtttttaccctaagtgattattatattttattctatgatattccctattctattaaaattaacagtacagtttatatttttatattgtgcatatagtgcaatttctgtttagtgtttcaaaaattaaggacaaactgtcttatagtcatgcccaggtattgctactcttaagcttttgtactgcttaagtggtttatctgtaaactatctctatttagttcccggaggaattaataggaaagtatcaaaataataaatatactataaatgaaacagctaaataataaaactataaaaaagaacaggaactaggtagaaaaatgatcattgtacttagaacctgggacaagatggatgcttttaattgttcattaaccttaactcagagcttccttgtagccaaagcaaacaagagaaaatgttacagttttatttttttgctaaacaaaagcatacttctttttcttttttttctctttttgttaatatgccctcagacatacttactttacaagagaaatttttttcttgtttaattctattagaaagtttaatgtatatagccataaataaaggacatgatggaaaataattgtaaggatttttttttttttgaaacagttttgctttgttgcgcaggctagagtgtagtggcatgatcttggctcactgcaacctctgcctctcaggttcaagcaattctcttgcctcagcctcttgaatagctgggactacaggcacccgccaccaagcccgactgatttttttttcttttagtagagatagggttttaccatgttgcccaggctggtctcgaactcctgagctcaggcaattagcccaccttggcctcccaaatttctaggattacaggtgtgagctaccatgccccgcctttaaggatttttaatagttccttttattcacgttagataaaagctatgattgaatataatttagagattgtatttctccaaagaactaaacattactgtttatttctggagatctgcttagtattgtaataaaatttagataatatagagacctatttctctcagatatcagctgttctaaccattatgaactttgatcagtgcttcttccttatctggtgtctaaaatgaatcttttccctggtaacaaaatatttgcaactgaggcaaatttagttttctgttatggaaattggctaggattttatttttacttcagtggagctttcttccccttccagaggttgatggggctgtcagtatacctgtgaacaggatctggtgcaagtattaacctgctttcctaaaaatatgttgaatctactcaagtgtccagatgatttacattatcgagatctagaattttgttcaatacagggttgaagagatacttctgatcttgaagttttcatgaatatgtggtacagattggctgcctcagcaataaaaaagcctgaatatactcctaaagaatggccgttatttgtaccatattgaataatggtgtgattatagaagcttaccattgattaaaaagggacatattagtccttcttcatttgaagtctctcattcctatgtggtgatggctatccagaatacatgtgctacttttaatagagcaattattttggtaatatatacaacagtgtaattttttaattagggcattcgtttctctagtcagtaaaaaggtaactttctttttttccttttccatgtatggtttaacttcttttagtgttttttttttaaatcatcattcatttaacttacagcagatttatataaatatatgactatctttgatatgcataatatatactaggctaacagggctcctagtattatgtattcctaagacgttacagagctgcaaaaatgaacaaaatcataaagcctcttctctacacaggtgctcgagtttggcttttcattggtttcatgttgatgtttgggtcacttattgcttccatgtggattctttttggtgcatatgttacccaaagtaagtatatattcttcttgtattttataggagagattcagatatgtcttttatatttggcttactctaccttgagtacaacttagtataattgttcacttagattgaagatactgctctgtgtgaagatacatgagtttaataaaacttgtcagtgggaacacttagtgcagtaggatagccctggttaggaaatccaagccactgacaaagctggtacctctcagctgtctccagactttctgctttccttctttaccttagacagccaggattttatgctagaggcccatttactgggagttgcagtagaaaaagtgagaaaccagtacaggtgtacactcccttatatacaattctaaaatccacaaaatgctgaaaatcaagttatttataactagtctggcagcaaaacctgacctaaactgacatggagctcactattttctttatcccatttagtgtaagtattcaaatgttttattgtaggaatgaaaatagatatattagattataggatgtgcttgtctatacccagctggcggtgctatgtagtatatgtgctttcccttactgttcttaaacctgaagaattctgaatcccaaaatatatcttgccccagggatttcagataaggggtatagaccccttatctgataatctatggattgccagtagataatctttcgtttcattgacaccttctctctccaacctaatcctgtaatttttttttttttttttgagacggagtctcactctgtcacccaggatggagtgcagtggtgtgatctcggctcactgcaacctccgcctcacaggttcaagtaatttgcctgtctcagcctcccaagtagctgggattacaggtgcacgccaccacacccagctaatttttgtatttttttagtagagacagggtttcaccatgttggccaggctggtctcaaactcctgacctcaagtgatccacccatcttggtctcccaaagtgctgggattacaggtgtgagccaccatgcccagccaatcctgtaatttttaagtcatgggtacagggggagttttttaagggcaagactgaacacatatgtatactcttcatacagaaacagctgatggagtgggatgagctcttattacaccatgctgaaatctgtggctctgccaggtgccatagcttttcattcacagtagtgatgaaaaatagaacccagtttcagaaatgtctctggaagcgtcggaagactgtttcactggccctcttcctttgctcctaagacaggagtcagtttcagagaacgcaatttattcatcctctgactcctctacctctggaatctctttgtcagccttctttgcttaactgtcacatctccttgtcctgactcacagctggtttttgaatacttttgatagtatcatttaagtctcatagtttgatcagtataagatctttggaatacttttgtttttcttttgtctttcacttgatacaaaataagtcagattacaagaggacagtggttggcttaaataacattggtcaccaactgtatctaaaatgtgttttttagttaattaaaaatactactagagcacataattctggtatgaagcatatctgaaggaaaatgcttttttaaagatagcttcattgagatataatttgcataccatataattcagccatttaaaatatgcagttcagtgtttttagtattttcacagaattatgctaccatcatcacaatccaatttgagaatatttttatcactgccatacccattagcagtcactccccattactccttcccctagccctaggcagccactaatgtactttctgtctgtatctatttcatacacatggaatcttataggaaagtgtttttttgagacagaaccttgctctgtcgcccaggctggagtgcagtggcgtgatctcggctcactgcaacctctgcctcccaggttcaagcaattctcctttctcagcctcctaagtagctgggactgcaggtgcatgccaccacgcccagataatttttgtatttttagtagagatggggtttcaccatattggtcaggctggtctcgaattcctgacctcaggtgatccacccacctcagcctcccaaagtgctggtattacaggcgtgagccactgtgcccagccggaaagtgtgttttaaactcattttatccctgactgtaagaagggtgggctgctgtcactgattttcttaaaaggtctccatagttatgttaaagaaaaactttagataaattagcaatttgagcaaaccaagaagaggttcggagagcttcacccagcagcatgagcagctgtaggctgaacacaaggcaaagacaagaaatttttagattgtctgtagctatatgtttgtcttatttgtgcatggtctcatcagttggctgcttgggattggctaaagcttagccgtttgtgattgactaaaattcagctatttattaaaaaatataaccctaggtttcagttcgtttacgtaagttaggttccggggggtgggttggggtcacacaggaactcagagtagggagatagcctcaggttaatggcttcctgcttatttactttagcagttgaagtgatccatgagctttacagtttctatagtgaaaatagggataaattgccatttctgtaaggtatgtagggaaatattgtttgtaaaggctttactattgttgagtgtatttttttttttttttttgagttggagtttcactcttgtcgcccaggctggagtgcaatggcacagtctcggctcactgcaacctctgcctcccgggttcaagcgattctcctgcctcagcttcccgaatagctgggattatagccgcctgccacgactcccagctaattttttgtatttttagtagagacagggtttcaccatgttggccaagctggtcttgaagtcctgatctcagacgatctacccaccttggcctcccaaagtgttgggattacaggcatgaaccaccgctcccagccaattgtatcttaatatttaaagaactagtaaatattgataaatttcttgattgtgaatttcatctttctatttcaacagcattactcatttaaatatacttttcttttttttttaagatggagtttcgccctgtcgtccaggctagagtgcagtggtatagtcttggcccacggcaacctctgcctcctgggttcaagtgattctcctgtctcaatctcccaagtagctgggattacagccatccaccaccacacttggctaattttgtatttttagtagagacagggtttccccatgttggccaggctggtctcaaactcctgacctcaagtgatctacccgcctcggccccccaaagtgctgggattacaagcgtgagtcaccacacccagcctaaatatacttttctatttgtaaagtgaatatgactttatttcagagagcatttctaggccatgtttcaaatcttttactgtacagatttgcttgaactattaatattcatagtaatagctaacttttatatattactttataggctagatactgttctaagcactatatagagtcactcatctaattcttacactctggagtaggtgctattacaatgcccgttttacaggtgaggaaatgaagatatgctgaggttaaataatttgcccaaggtcatacagttagtcattggtatagataggattcaaacctgggtctggctcaaacttggagctcttaaccatgctgctgtattgtttgctatgatatcaagagctcagaattgaaccagtttcttcatcttctccagtattttttaaatcaacatttgtagttttacaaaagttaataatccacaaaaatttaagtagtttccattttgtttcttttcttttcctataaagatagtaaccatttcctccaggatagattcagtgaaagagaatgataaattctaactgtgttatttatatctgacatatttgcatgataaaactcctggattgagagccaggcattgtggtgtgtgcctgtagtcccatccacttgggacgctgaggcaggaggatcacttgagcccaggagtttgggctgtagtttgctatgattgtgcctgtcagtagctgctgcactccagtctgggcaatatagtgaggccccatttctttaaaaacaaacacaaaaaacctcttgaattcatgaaagaaaataaattaacagactgtttaaaagtcaagaatttattttgtatgtttttacgattttgcatttcagtgttggccataggaggcaaaggagcaagttactgcttcctcagcagttttgatgtagctagaaccagcaattactttgactaaaagaaaactttgtaagttcattgacttttatccagagtaagagcagtcctttgctttgggggaattaaattggcattttcttctttcagtttcattatagatgtcttacagttaatgaataatagcagtatgttgtaatatacaaaatgtatcattatgaatggcactgatactttattactgccgtttgcctatataaccgtctaatctgttttactttgtgtatgtagatactgatgtttatccgggactagctgtgttttttcaaaatgcacttatattttttaggtaagttgccttattttttaaccacgcctgtaacatttacagaaatgtcaacttaattaaggcagcatatatatggaacacatataaatcccatggattggttacaatgatagaacttcttttaaaaggtgagaattccactgttacataagagcagagaggccttttaactagaggtcttgctgtgtatcaagactttagctggatcctttatatattttaccctttgaattcacatttaggccaagtgctgtggctcatgcctgtaatcccagcactttgggaggctgaagtgggtggattgcttaagtctaggagtttaagaccagcctgggcaacatggcaaaaccctgtctctataaaaaaatataaaaattatctggttgtggtggtgtacagtgccagctactcaagaggctgaggtgggaggattgcttgagccgaggaggttgaggctgcagtgaggcaaggctgcaccactgtactccagcctgggcaatagagtgagaccaaaataaaataaaataatgcatttaattattttaaatatatgtcaggtgttattcccattttatttatttttatttttatttatttatttattttttgcgagggagtctcaccctgtagcccaagctgccttagtgcagtggaacaatctcggctcactgcagcctccgcctcgggactcaggcgattcccatgcctcagcctcccgagtaggtgggactacaggtgcacaccaccacacccagctaattttttgtattttagtagagacgaggtttcaccatattgcccagagtggtctcgaactcctgagctcagacaatttgcctgcctcggcctcccaaagtgctgggattatagccaccacacccagtgttattcccattttatagatgaggaaataaagtttagggcttgctttaggatgcctagctagtaaatgagaagcctggatttgaatccagactgctgcttccatagcctgtgtcttattaaaaaaccctatcagacccattgtttcacttgactagcctttcgggaaaaaaaaaattaacaacaacaggtaaagtacctttatgaagaaaaaaggaaaaaccagaattaatacctagtggccagccaggtgtggtggctcatgtctgtaatcccagcactttgggaggctgaagtgggtggatcatctgaggtcaggggttcgagaccagcctggccaacatggtgaaaccccatctctaataaaaatacaaacattagtcgggcatggtggtgtgtgcctgtaatcccagctactcggaaggctgaggcaggagaaccacttgaacccaggagacacgggggttggagtgagtcgagatagtgccactgcatttcagcttgggtgacagagcaagactccatatcaaaataataataataattaatacatagtatgcatattatatacaaaacctgttgggaaattctgttttctgaatgcccttttaagaaaagttaaagtaagtggaaaaataaaccaatattaaaagtattttttaggggcagtcttctaaaatatccccaaaatgaagtccattctatgctttttagaatgaatgtcttttttttttttttttttgagctggattctcgctctgttgcccaggctgatgtgcagtggtgcaatctcagctcaatgcaacctctgcctcccaggctcaagcaattccgtgcctcagcctcccaagtagctgggattacaggcatgcactgccacacccagctaatttttgtatttttagtagagatggggttttgccatgttgaccaggccggtctcgaactcctgacctcaagtgatctgcccacctcagcctcccaaagtggtaggattacaggtgtgagccaccatgcccagcctagaatgaatgtcttttaatgtcaacataggatatttaggtatatatttataaaattttatctgcctctgtccccatcccccataaatcattaagtaacttctaagccttgaaaaactttgcttttgtcactggttttaagtaatttgattacgatgtactgtggtctagttttcttgatattccttctgcttggtgtatattgagtttcttggatctataggtttatagttcatcaataaatctagattcttctcagccattatttcttcaagcattttttgtatccactgcaccctccctctgggatttcaattacaggttataataggctgctcgaagttgtctcacagcttgctaatggtcagatttttttttcctgtttgtgtttcagtttggatagtttctattgttacattttaaaattaatctcggctgggcatggtggctcacacctgtaatctcaacactttgggaggccaaggcgggtggatcacttgaggtcaggagttcgagaccagcctggccaacatggtgaaacctcatctctactaaaaatacagacattagctgggcatggtggtgcatgcctggaatcccagctactcggaaggctgaggccagagaatcacttgaacccgggaggctgaggttgcagtgagctgagatcacaccattgctgagcaacagagcgagacttcatctcaaaataaataaatacataaataaataaaattaatctctctattgtcactttgaagaattaaataaattaatctctacttctgcaatgtctaatctatgccatccaatgattttttcatctcagacattgtattttctctctctagaagcttgattgggtctttaaaaatatttctgatgtcttcccttaacatgctcatgccctcttccaccttgaacacacagagtatatttatagctatctcagggtccttgtccaattgtctgtgtcatttctgcatctgcttctactgattttttctgcttctgtttactcttcattttggacctattttcccttatttggtgctttgcatacaatttgttgggactggatctttgctagtcctttaaatgtttttaagctttgttttgggatgcagttaggtgactcagaaacaatcagaaacaatttgatccttttatgtctcttaagctttgttataggcaggaccagagcagctgtagcccaggactgatttgtccccctactaaggcagtcataccctttgagtgtttccactctctgatgcttcatgtattccgaggtttctctactcgacttgtgagagtatgaactctcttccagccttgtggtagctctgggacatgttctttccagtggttctttccttcccttgggtagtttcctcttatgtatagactcttcagtactcagccacagactgaaggagcaccccctgcagatctcctgcgttccctctgtgtggctgtctgtacgctgcatggcaaactctagccatgtggtctccctccactctcagaccaccatgctctacctggatttcgccttgtggccttgacactcctggttttgaaagatgtttggcagtttctgctgtcttatatgtcaaagacatgtgactgacagccttctggggatatggtaagttgttatgaagacattttaggcagtctttagagattaagttcagattcaacactttgtggtggtagatgaatccacttaaatgacaattggatgaacagaaaccttgtatgctcaggtggacatagttgacagctgtgtcatctatgtgctctgcccagaggctggcaagttatcaggcagcctgtatgcttcctgtgtgctggacctgttctaagctctggggtacaacctcttttatttacatctctggtcactcctctgttttccttgcaagctgatcctccactccctgcctactaccttttgaagtctcttaaagctgttcttggccttaagaaactccttgttatttttctgtccctgggtgaactcatgtgtacttaggactccaattattgcttatatgccagtgagtcacagatgtccctttccaggcctaaaccgtatatccagattcctacttcacatcccttcttgggttgctgacatttcaaatccaaaacatttagtatgcccacagctcaactcatggccctggagtgtcccatctctctgctcccgcctccttatcctctctcactttgccgagataattccccctcttcttttggatctcaattcagtcaccactcctcaggaaaacctttcctgacctctctaactaggtctgatccttatgtttcactctgaggatactgtgcacctctcatttatagcatttttttataggtggaattttatatttatttgattgtctccttattagacccttagctccattagggagcaagtttgtctggactcagtctcaccccagcacttaggtgcttggtacgtagccacttttcagtgcacaataattatttgttgaaggaatgaagaattgcagcatggtctgttgtagggtgcttcagttactgtaatttagatatggtaggctcctggagacataaaatggccctaatgcctgtcactatgagaatggtctctctccctttttcttttgatttattgattcatttttttgtttctgagtcatagagaaatgtctcttttccttacaagttgcctgttaataacttcccaggccttaagaaagaatacagttatgcttagccatcgtagttaacagactgctttacaaaataagcaaattaagaccaacactgccatgatgtctaatttaatttttaaaattgataggaatcagtgaagtacctgtcaaagcatattgagaaaatgaattctgtgttgcttgttccatcggttttttcctcatgatttgttttcctatctttctagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtatacccaattaaagatgcagttatgtttataaaataagaagaaatagacttgtaaaatgcttatgtgagggttattgaaggtttccctgaagactgactggaaatggtggctgtttttttctatttctgactctgccatgaatttttttttttttttttaaagacaatatctcactctgttgcctaggctggagtgcagtggtgcaaccacagctcactgcaccttcaaatgctggagctcaggcaatcctcttacctccgctttccaagcagctgggaccacaggtacgtgtcattatgtctggttaattaaaaaaaaatgttttgggaggcctaggtgggcggatcacgaggtcaggagatcgagaccatcctggctaacatggtgaaaccctgtctgtactaaaaatacaaaaaaattagccgggcgtggtgggggtcacctgtagtcccagctacttgggaggctgaggcaagagaatggcgtgaaccttggaggcagagcttgcagtgagccaaaatcgtgccactgcactccagtctgggcaacagagcaagactccatgtcattaaaaaaaaaagttgttttttgtagagacgggggtctcactatgctgttctgggtgaactggtctcaacacatccacctgcctcaacctcacaaagtgctaggttgacaggcatgagccaccacacccaaccctgaatttgttttttagttgtgagcaaatcacttaattttctgtttcttcattttaaaaaaagagataatgtggtcaggcgtgggggctcacgcctgtaatcccagcactttgggaggccgaggcgggcagatcatgaggtcaggagttcgagaccagcctggccaacatactgaaacccggtctgtactaaaaatacaacaaattagccaggcgtggtggtgcacccctgtaatcccagctactcgggaggctgaggcagggagaattgcttgaacccgggaggcagaggttgcagtgagccaagatcgtgcaactgcactccagcttgggtgacaaagcgagactccgtctagaaaataaaaaataaataaaaacataaaagagataatgttagtatccactcttagaaatattatgagttagggcagaatctttggtaatcatctacaaatgcatgtgattcccttactaaggttctcaagctgtcacatagattcagtggtcattgaatctgagtgttttttgtgtgtggaccaatattatcagagtattccattttattgctctaagatccttgtattccttgtgctgttgccactgagtaaaaacccagaggctgtatttttccagtatatatatatatgtgtgtgtgtgtgtgtgtgtgtgtgtgtgtgtgtgtgtatttctatacacaagacgttgacttgacattgatttgcatcaacataatgaaattggaagactgaaagattgatgatatcaaaccatataatttggccccttgagcaagagcccccagagggtttgacatgggtgcattgaactcatgatctctacatttttccccagtggaagggttttcagtcacaacatcaactcaggagtctttgttttcattgttcttttttatggagtcctttttacagtgtcttactcttgcccaggctggaacgccgtggtgtgattatagctcactactgccttgaactccttggctcaagcagtcctcccctcagtctactataggtgtgcaccaccacactcagctctcctttttagatttagttgcacctttcccaagttgcttttagaacactggtggccctgaaggtgtacctgagaaaaggtgtgtgtgtcaaagaagcttgggaaaccctgggctgaactaggtctaaacatgttttttctttctttatttcttgattttttttttttttttcagatggagttttgctcttgtcacccaggctggagtgtagtggtgcaatctcagctcactgcaacctctgtctcccaggttcaaatggttctcgtgcctcagcctcccgagtagctggggttacaggtgggtaccatcctacccggctaatttttgtatttttagtagagacatggtttcaccatattggccaagctggtctcaaattcctgaccccaggtgatccacccgcctcggcctcccaaagtgttgggattacaggcgtgagcactgcgccccgccttcttgcttagtcttttttagagaggggtcttgctatgttgcccaggctggtcttgaattcctgagctcaagtgatcctcctgcctcagcctcctgagtagctgggactagaggtgcaaatcaccacactaggctccaaaacacctttttaaaattctgtaaagttcttttctttcttagaggtttttttttttttttttttttttgtgtgtgtgtgtgtgtgtgtattgtatgtctttaggaggagggtgtcaattatatggtgttttctattactgagacttggaaatttatctcctggaacatgttgaaaaatgtaatttggggccaggcacagcggctctcgcctgtactcccagtactttgggagtccgaggcgggcagattacttgaggtcaggagttcgagatcagcctggccaacatagtgaaacccatctctactaaaaatacaaaaaattagccaagtatggtggtacatgcctgtaatcccagctacttgggatgctgaggcaggagaattgcttgagcccaggaggcagaggctgcagtgagctcagatcaagccactgtactccagtgtgggcaacagagcaagactgtctcaaaaaaaaataaaaaataaaaaataaaaaaaataaaagaaaaatgtaatttggggaaagtgctgctatggtggctttagaatagatagaacacagggaattaacaaaaggagaggaaaatgtttaggtgtgggcatggctggctttgggaaaagcctgtggccagcctgattatggggaataaaaatggtggcaggagggcacagtaggaagaattcttccaattgcgttgttactagacagttgtggtttgggcgctgggattctcggaggcctatggatttaagtttaggttggtttacttctcccttattcccttattctggcactgccatttattagctatttgactgcaagactgtttccctgtctgtaagtatgtttgagaattaatctgaggaaatgcttaacaaagttcctggaaataataagtgattcacacaagtaggctttttttttccttttttttttgagacagagtctcactctgtcatccaggctggagtgcagtggctcactgcagcctcagcctcctgggttcaagccattctcgtgccttggcctcccaagtaactgggattgtaggcacatgccaccacgcctggctaattgtttttgtatttttagtagagatggggttttgccatgttggccaggctggtctcgaacttctaacctcaagcgatccgccagccttggcctcccaaagtgcagggaattacaggcgccgtgcccggcatttcttatgatgacttttgaagggatgtttcctttctcatctgatgactttttagctttttgccacaaggtggcatgccatgctaagaaaaacaagacttccaagtttagagcctgccagagcatttttttgtagcacttttatcacagcttaagtaattttacttagggttttggatagcagtaaatgcctcttcaattctttcagctgtggcagataggatattttaaatttctttgagtaagtatggcaggacaggctgcctagaccctcatggattatgccagtgtagagagtgctgggtctttgatttggggagcatgttgacctcttccccaccccagaggtctagacataaaaccagagagctctccaaaaaggatgtaaattgtgctcttttccagcagcagtttctggttttttttttttttttttgagactgggtctcactctgtcaccctccacctcccaggctcaagcgatcctcccacctcagccttccaagtagctcaggtgcatgccactacatcctggctaattgttaatgttttgtagagatggggtttcaccatgttacccaggctggtctcgaactcctgggctcaaaggatctgcctacctcagcctcctaaagtgctgggattacaggtatgaaccactgcacccagccagcagtttcttttgtttctttttctttctttttttttttttttttgtaaagagatggagtctcactattttacccaggctggagtacagtggctttcacaggcatgaacattgcacacttcgacctggaactcttgagctcaagtgaccctccagcctcagcctcccgagtagctgggactatagtacaggtctgtgctccaacagtttctactcctggtgccaaaaacattattcagtgtgatcagtgtacttccctcccaccatggaagttgtgagtttagaaattaaccttttttttttttgagacagggtctggctctgtcacccaggctggagtgcagtggtgtgagctcggctcactgcaacctctgcctcctaggctcaagagatcctctctcctcagtctcctgagtagcttggactacagacgcacgccaccatgcctggctaattgtattttttgtagagacacggtttcaccatgttgcccagattggtctggagctcctgagctcaagcggtctgctcacctcaacttcccaaagtgctaggattacaggcgtgagccactgcgcccagcctgagattaactttttatgttgaaattacatcagacttaccaggagagttataaaaatagcacaaagaggccaggcatggtgctcacgcctatatctcagtgctttgggaggccaaggtgggcggatcaccggaggtcaggagttcaagaccagcttggccaacatggtgaaatcccatctctactaaaaatacaaaaattagccaggcgtagtggcaggtgcctataatcccagctacttgggaggctgaggcaggagaatcgcttgaacccaggaggcggaagttgcagtgagccaagaccccgccattgcactccagcctgggcgacagagcgaaactctgtaaaaaaacaaacaaacaaacaaaaaaaaaccacaaagaattcctgtataacctttcagattcccagaagttaacattttactacatttgctttggtctgttattttaaatgtttggcagcatgctgcagatgtgacgcctgtttacttacccttgaatcctgtgtatatttccccccaaacatcactgcgatacgatgccaaagtcagaaaattaacattgatacagtactttgtgccttattcaaattcttcagattacccctgtaatgtactttatagtaaagaaaaatactatttttctgtggcaggatcctgcccatggtcacacgttgcatttagtcgtcatatccctgcagtgtctctaatatttggaatggttcttcagtctttgtcttctgtgactaggcatttggaacttgagtggcttacgtatcaggactactagcagttgctgtgtgcctttgtgttctgtttaggtcaacagcacctgtggggttgtgcggtgcacagcctacaggaatgtacccacagccccgactactggtgctccactattttagtagttagcatggggctggccacttgagaagtgtctggatctggaggacacttgaaggtactcacagttgtattaagggtcacaggaaaatttcagaaagtaaatagtcaagaaacacattagtttgattgattaattgaattttatgccaggcaaaattttgtacctgcccatctccaaggacctcagggtcctcctacctggacttaccagctctttaagggtttgaccctctcttaggcttttcagatacaaaaatactcttattacccacagagaatagatcagatatttttattcacctgaatgtagaaatgaaacgagttgaattaatatttacagttattatacattgttactcataccactatttaatttcaaggaaaatcattaatatcatatgttgtgctttttgttttgatttgttttgtttttttttttgagacagagtctctctctgttagcccaggctggagtgcagtggcacgatcttgctcactgcaacctccgcctcccaggttcaagcgattctcatgccttaacctactgagtagctggaactacaggcatgcaccatcatgcctggctaatttttgtatttttagtagagacggggtttctccatgttggccaggctggtgtcgaactcctgacctcaagtgatctgcctgcctctgcctcccaaagtgctgggattacaggcatgagccagcgcgcctggccacatatcatttgatgtttatgttgtagctaggtatatggatgtaaagtaaccctgagggtctgcctccctcctctttttttgataactgaggggcccagagaagctagtgctgcctgtatttctacaatgggatgaatttttaggctatcattttttaggaatgtctaggtgtcattcctagagcattggcaagttgccctgaccagagtcctctccttagcaacgggtggctctgaggccccaggtcccaagtaaccactctgaccagtttccataccctctcaagcgtagccagctgttttccctcaccacagactggaaacaaggagaaagacgtcactttcacttcattcccgtgggacagtccttgagtctcaagggaggctgggagtggcagtgaagggtggggaggcatgactgcatctccggaagctgctggggtggagtctcacttctcatcaaacagaaggacagctggggatgttctcatctcaaatagagactatttggcaaacagcaaatatattttgaagggctctgggcgcctcagagatgtgactgcatagtgtggaagttgtcagaatcaaaatggagtcacttgtgcttcaaacaaacaagcaaacaaataaaaaaccctgacaaatagagctggggaaggccatgaaggattctcatgcaaaaatgcttgataacaaaaatgatcacaaggccgggcgtggtggctcatgcctgtaatcccagcattttagaaggttgaggcaggtggatcacttgaggtcaggagttcaagaccagcctgggcaacatggcaaaatcccatctctactaaaaatacaaaaaattagccaggcatggtggcggatgcctgtagtcccagctactaaggaggctgagacaggagaatttcttgaatccaggaggcagacgttgcagtgagctgtgattgcatcactgccctccagcttgggtgacagagcaagactctgtctctaaataaataaataaataaaaatgatcacaaaagactgcaaaaatctcaaccttgcacaaagcccttcaccgccttacacaacaaacacttctatgaggacatctgcccaacaactgcctgtctaaccttggaatggcatcccccttgctattgatccttatagccaaggataattatcttaaaacagtgatctaatcctcattttttcctttaagaacctttgttttccttcaccttcctaaatatgtacatagtttactctggcacacgtgttccccttgtaataccctattcccaaatcagtatcatttcctttcagagagcctctctctgttgtggcacttcaaagacatagtggccatagtgactatgcaggcttctttaaatgttatgtaccaagaagtcctttttttttttgagacagattcttgctctgttgcccaggttgaggtgcagtggtgtcatctgggctcactgcaacttccaccttgtgggttcaaccgattctcctgcctcagcctcctgaatagctgtgattacaggcacctgccactgcgctgggctgatttttgtatttttagtagagacagggtgtcaccttgttggccagactgatcttgaactcctgacctcaggcgatccgctcacctgagcctcccaaaatgctgggattacaggtgtgagccgccgtgccctgccagaagtccattttatgtgatttaaacactatggacagagacgttattttattttattattattttttgagacagagtcttgctctgtcgcccaggtggagtgcagtggtgcaatcttggctcactgcaacctctgcctcccaggttcaagtgattctcctgcctcagcctcctgagtagctgggattacaggcacacatcaccacgcccagctaatctttgtatttttagtagggacggggtttcaccatgttggtcaggctggtctcaaactcctgacctcatgatccctcctgcctcagcctcccaaagttctgggattacaagcgtgagcccccgcacccggcctattttattattatttttgagacagagtctcgctctgtcaccaggcatgcagtggcacgatctctgctcactgcaacctctgcatcccaggttcaagcaattcccttcgctcagcctcctgagtagctgggattacaggcatgcaccaccatgcccagctaatttttgtatttttagtagagacggtgtttcaccatgttggtcaggctggtctcaaactcctggcctcaaatgatccgcccacctcagcctcccaaagtgctgggattacaggtgtgaaccactacacgcagcttaccttctgggttctaataaatatttatgaacagtgaaatttgaatatcatagaattttcatgtgtgatgaaatattcttcttttgactttaactattccaagatgtaaaagctattcttagcacacgggttttacaaaaacagggaatgggctgatttggcaagtaggttatggattatgccctgtcaacggattatttataagagtgcttccaactcaaaaattttgacaatgtacttagcttgactttatttttcttgagacagagtcttgctctgttgcccaggctggagtgcagaggtgccatgtcagctcactgcaacctccgcttctcgggctcaagtgattctcctgcctcagcttcccaagtagctgggattacaggtgtgagccaccacgcccagctaatttttgtatttttaatagaaacaggttttcgccatgttgaccaggcttgtctcaaactcctgacctcatgatccacccacctcagggtctcaaagtgctcggattacaggtgtgagccactgcgcctggccttgacagtgtaaatactaatcccatcaattagtcatttattttactaaggagaatgaggcatttcatttcagaaaatactatttaaggctgggcacagtggctcacacctgtaatcccagcactttgggaggctgaggtgagcggatcacctgaggtcaggagtttgagaccagcctgaccaacatagtgaaaccccatctctactaaaaatacaaaaattagctgggtgtggtggcgcacatctgtaatcccagctactctggaggctgaggcacaaaaatcgcttgaacccggaaggcagaggttgcagtgaagtgagattgtgccactgcgctccagcctgggcaacagggtgagactgtgtctctaaataaataaatggggtggcacagatgcacttaccctaacagagttgatttgccctctgtcctgctgggctgaaactctttcctgttctcctgctatagatgtatcctccactcctcgctggccaccatcctgctgcccaacagaagaagctcttctgtctccgatttcctgaacggtctaaggtaagtctttacaactcctatctacaacttcttcctccaaacttgtctacttaaggtgcacctaatgcatacaacagatgcttcacagggagacttgtgtgcatggggtgggagtgggccttgtttttctaactcttgccactgcagacagcatggtacacaacacttaagagagttagccacttttgccggacacggtggctcacgcctgtgatctcaaccctttgggagaccaaggtgggtggatcatgaggtcaggagttcgagaccagcctggccaacatggtgaaaccccatctctactaaaaatacaaaaattagccaggcatagtggtgcacgcctgtaatcccagctattcgggaggctgaggcaggagaattgcttgaacctgggaggtggaggttgcagcgagctgagatcgcgccactgcgctccagcctgggcgacagagtgagactctgtctcaaaagaaaaaaaaaaagccactttcttaccagcagtacagggccccaactgcctcccatgtagctgggattataggtgcctgccaccacactcagctaatttttgtgcttttagtggagacaggctttcaccatgttggccaggctggtctcgaactcctgacctcaggtgatctgcctgcctcggcctcccaaagtgctgggattacaggtgtgagccaccgtgcccagcctataaatggattttaaatacatatcctttgaacaacagagcccgacagtactgacacaatcagatgacttgcgtgctcagtagataacattactattgattaatcagttaattctctttattgcccacaaatccctgccttggtcaacacagtgtgacttgtcacatataaatgaagtgctaatgtgccttctgcaaatcccccttataacttttatatttttgagacagggtctcttgctctgttgccaaggctggaatgtagtggtgtaatcattgctcactgcagccttgaactcctaactcctaggctcaaatgatcctctggtctcagcctcctgagtagctgggactacgggtgtgcaccaccacgactagctaattttttattttttgtgaaaacaaggtctcactatgttgcccaggctgttctcaaactcctggcctcaagcgatcctcccatcttgacctcccaaagtgctgggattacaggcatgagccaccatgcccagccctctttttttttttttttttgagatagggtctcgctctgcctcccacgctggagtgcagtggcatcatttcggctcatggtaacctccgcctcccaggctaaagcatcctcccactttagcctctcaagtagctgggactacaggtgcatgtcatcatgcctggataatttttgcatttttcatagagacagggtttcaccatgttgcccaggtgggtctagaactcctggcctcaagtgatccacccacctcagcctcccaaagtgctgggattataggcgtgggccactgcactaggccctggccttctttataacctttggaggatcaagtgacatccataggaagtgtttgctgagttcccatgaggcctcagtagctctagcaggtgttatttaagaaaaaacaagtttagattgagtaattttagaaagctgaaactctgcagaaaataggctacaataaagaaaacacttcacatagactttaaaaaacatgcactatacaatcttttatttccagtttaaaaacaaaatcttaaattactaggagtatatttacaagattaattacattttaagccagcacaccatggatgtacatgaagggccactcggtgtccctcgctgggacaggttgtgtgacctgcccaaggggctccggctcatttgccaaagtcaagacgacgaccaggtcttctgactgctcagcccaaccaataatgaaaaaagtatcagagatgtgtcatatccattttgctaacaagcaattacatgcctttttagtgtttaagagaagccttaattttcctgggatatctccgtaaaatcattctggaatttgattttgaaaattctttaagaaaaaaaaaaaaagcttgtcacccccatgagacctgctgtctctcatgtctgcagggacaggccttttagaggcagcaaaagggaatactggtctctggaaagtccagacagaactctagcagctccgatggcttgatctcttccagggagccagtgggctaggcccatgctttggttcaaagcgtttggagaacatcttcttgctccttttccggaaacgagataatggacacagagtcccagacgtcatcctttggtgagctgtccttgtccaaggcctctaagatgggctgagttgggtcttttaaatacttgaggaggttggaaagcaaaattgtaattagtttaccagttcagtataccagaccttttaactttagtttttgtttttattttatttttatttttattttttttttgagatggagtcttactcttgcctaggctggagtatagtggtgtgatctcagctcactgcaacctctgcttcccaggttcaagcgattctcctgcctcaatcctccaagtagctgggactacaggtgcccaccaccttgcctggctaattttgtatttttagtagagacagggtttcactatgttggccacgctggtctcaaactcctgatcgcaaatgatccacccaccttggcctcccaaagtgctgggattataggcgtgagccactacgcctggcctactttagttttaattggtatagttattttattcagatataagttgattctgtccaccaatgacataacttatttttctttttattcaacaatgaaacaattttttttttttgagacggagtttcacgttgttgcccaggctggagtgcaatgacacgatctcatctcactgcaacctctgcctcagcctcccaagtagctgggattacaggcatgcaccaccacaccctgctaattttgtattttaagtagagacggggtttcccatgttggtcaggctgtctcgaactcctgacctcaggtgatccgcccgcctcggcctcccaaagtgctgggattgcaggtgtgagccactgcacccggcaacaattttttattgttgttgagtcagtctctttttcgcccaggctggagtgcagtggcgcgatctcggctcactgcaacttccgcctcctgggttcaagcaattctcctgcctcagcttcccaaccaagtagctaggattgcaggcgtgcaccaccacggctggctaatttttttttttttttttttttttttgagacggagtcttgctctgttgccaggctggagtgcagtggcgtggatctcagctcactgcagcctccgcctcctgggttcaagtgattctcctgcctcagcctcccaagtagctgggactacaggcgcatgccaccatgcctgggtaatttttgtatttttagtagagacagggtttcaccctgttggccaggatggtctcgatctcctgacttcatgatccacccacctcggcctctcaaagtgctgggattacaggcatgagccacctcacccagccaacaacttctaatagttgaatactccttacccctcatctcagtaatcactttaatactcatcccagggctgaccatgttaatatgctgagagtttaaaagggcaaaactcaggaaaagcaagttttgtttttttcttctgattttctgattggaagaaaagcaagttcttccttgcaaccctcagtgtaggcctgtgggttattaatcttaagacgtctctaaaattgtaacctttcagtgaaggagggactgggggctcttgttcagctgtgatggggaaaaagagggcaagttcacaagcattggtctcaggcactcctccacccctccccttgcaccagcgcacagcaagcagagaatctgggagcgagggccttaggccttaacatataaaggggtgtttcccagcgattaatttcccttttgctcccgcaggctttaggcttagccatagattcaccaagttaccaagaatctagtgtctagctcttggaaatgctgaaagatactggaagacaataagcttgtagctgactgactgaaagaggaacaaaaccaaaacatgtacccttgtgaaaccccagaattataagtgaaacatgattcactgttcccatgtaactcagagacctttggcggatgttctttatgctttcctagaaaagtgaactgacaggcctgtgttttctgttcatgtctcagaggaatgactcatagtatattcatgtactggggctcagctggtagttctaccaggagagagagagattattactgcaagtaagattctgagacctgttaggagctgtgattttgtgacaatattaaccagggaggttctagtagggaatctgtatactgcctgtgtacctacaatacatcatggcagatgaaggaacaagtgactagggttctttctgaaagtgctgctatgtttctgcagacttggaccttatctaacctctgttcatcccacatgtaactgagtaacattctgcttccaacacctttactctaggtttacccaagaataatgtgaagcctccagaagcaaatgctttttatttattttatttttttgagatggagtcttgctctgccacccaagctaaagtgctatggtgcgatattggcttactgtaacttccacctcctgggttcaagcaattctcctgcctcagcctctcatgtagctgggattacaggcgcccaccaccacgcccggctaatttttgtatttttggtagagacagggtttcaccatgttggccaggctggtctcgaactcctgacctcaggtgatctgcccaccctggcctccccaagtcctgggattacaggtgtgggtcactgcgcccggctgcaaatgctttttaaatgttcttctctcagctcgcctctgatccccaaaatgtcctgaccgtgtcctcagaaggcccaatggcctcacagagcctcagggggctggggttatgcaggaaaataagactttccacaagacccacgctactgttctttctcaagtcctttcaaatattagcaatacccactgggcaatgggtacacggggcctggcactcacagctctgggtgttgactctgccttagggccctcctaagcaccctgtgggccccaaagctcaagctcctgatcactgtctccaccgccttcacgtcctccagccaggccacttccctggagcattctccagacagcagaggagacctgctgcctcggagaggggtctactgcagccaatctccaggccaggccacctttttagccaaccccatgccattaaaaaaaaaaaattaaattgtggtaaaatacacataacataaaatgtaccatcataactctttttaggtgtacagttcggtagtgccaagcacattcacattgtgcaatcatgaccaccatccatctccagaactctgtacagccccagaactgaaactctggccccattcaacacgaacttcccacttccctccctccaccaccgcaaccaccattctacttcctgtctttatggatttgatgactctggggacctcatttaagtggaagcagacagtatccttttgtgactgccctactctactcagcataatgtcctcaaggtccatgtgtgtggtaggatgtgtcacaatccccttcctttctaaggctgaatgatattccattgtatggaaagaccatctattaaagatttatctattaatccttcaacgacaccggagtgcttccaccttttggctgttgtgaatcgtgtcaacatgaacatgggtgtacaaacaaccccataccatttgtaacccaaatctctgtgtccacggctttgcccacagctgcactcttaggggttgccaggggcagtggggccctgatgtgtcaccattaagatgtctgcgtggccgggcgcagtggctcccgcctgtaatcccagcactttgggaggctgaggtgggtggatcacttgaggtcaggagtttgagaccagtctggccaacatagcaaaaccctgtttctaccaaaaatacaaaaattagcaggccatggtggtgagcacttgtaataccagctactcaggaggctgaggcaggagaatcgcttgaacctgggagatggaggctgcagtgagcagagattgtaccatgacactcccgcctgggcaacagagcaagaccctgtctcaaaaaaaaaaaaagagatgtgtgcacacgtacctcttctatctgtaatgggatgcttggtggagtgtgaaaccagtatttaatcaggcctctatatttcaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacatcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 38549 - DNA, 4815 bp, Homo sapiens
gcatttcctgcttggagtctcaggccccagcgtctggcacaggcaggggcctgcggagctgagggcagtggaccagctgcaggtagggggtgggttggggcccagggcccagttcctgccagtcagtggctctcttgctccgaccggcctcttctttctgtccatcttttcgtttcacctccactagtctccggggggctccctgcactgctcagctcgttcactggaggggtgttgggaggaccccagttttggagtcggggctgggaggcctgggttgagcctggggacggggcccgggcctattctcaaaatcataagttccagccagacccccgccaagtgttctggagcgtgtgggggcgtctctgaactcctgggcgctcaggcctctgcttcccgcggcccctccttgggagacggcccagtccagtgggagccgcgggcgggggcagggtccgggggtgactgttcaccccagtgggcgcctgggcggccactgactccttcgacgactcctccaggaagccggggcggccaccagataagcctctaccccgccacttcctcaaggcccgcggccgtttatgggaagacccgagagatttgcatcggggccctgcggaggggcggaggggcggaggggcggaggggtcgcttgccggtctgaggggcgaggccgcgaccaggcccctggccctggggcagcccgggccgcaccccacgggactcccagggggtaagatcactccggggaccggttccggcggcccgcgggaaagggcagtggcgggagtccagagaccctccccgtcttcccgttgcagggagggcgacctgtatgcggagcgccgttcctgcgacatggaccgcggccagcccagcctggagcctgctgccgcggccccccgagcctcgggccggtgcgtgatcgcgcccgtgcgcgctgtgctccgcctgcgccgccgggtgtgtgtcctacgcaaacggcgcctcctgcagccgggtggggggcccgacgtcgggaccggggcgcccaggccgggctgcagcccccgggcaccgcgcgcggacctggaccagccaaagttcttcaccttcgacagccccgcggagctaccctccaggacgccacgcaagaagcgccggcgcagccgcctggtgctttacccggagacctcgcgcaagtatcggccgcgcgtggagcacaggagccgcgcgcagcgctgccttctgctgctagtcgccatcgtgggcttccaagttctcaacgctatcgagaacctggacgataacgcgcagcgctatgacctcgacgggctggagaaagcgctgcagcgcgcggtgttcggccagcccgctgccgtatcgcgcatcgtggcgctgatgcgggactacctggccacgcatgtgcacagtcgtccgctcctcctggcgctgcacgggcccagtggcgtgggcaagagccacgtgggccgcctgctggcgcgccacttccgctcggtgctggaggacagcgcgctcgtgctgcaataccatgcgcggcaccactgccccgaggcgcgcgccgcacaggactgccgcgaggagctggcgcggcgcgtggccgacgtggtggcgcgggccgaagcggaggagaagaccccactcttggtgctggacgacgtggagctcatgccgcggccgctgctggacgagctgcacggcttcctgcagccgcagcgctcccaccacttccacaacgccatctacgtgctcctcagtggcgcgggtggcgccgaggtcacgcgcttcgtgctgcagaacgcgtcccgcgcgctgcccctgcgccccgacggcttccgcagtgccgaggccgcagcggcgcaggcggaagaagacctgcgcgccagcctgctggctgtgctgtcccgggagcatccgctgtggcaggccgcggccatcgtgccgtttctgctgctggacaagcgggatgtggtcagctgcttccgggacgagatggcgggtgagggcttctttcctgaccaggcccgcgcggagaacctggccgcgcagctcagcttctaccgcgtggctggccgcgagtttgccgtcaccggctgcaagcaggtggtggccacggtgaacctcctgtagtggaggcgcaggacgggacgtttgggttgatggcggcagtaggagggcgaccagggaccttgtgggctggtgcaggcccctgaggtttctagtgaatttgtggctgcccggctggtgggtgcggatcagcttggagctctgcttccaggtccacacccgcctcagagtccggagtctgtccctgggggcggcaggacagcagccacctccctcccaaacttgcccattgccctgctgggcgtcccaggcatggtctggtgcgttctccctgtggccccaagaggtgggttcccatggtacaaggatgatctcagggccaacaattcccggggtcacacagctgggacgtgaccccgcctcttgggggtggtcgcgtgttgctcagtgctgaagtggggttctcattccggcccccctggagatgaccccggaggaggccacagccaaccatgacagtgctggggctctggctgccttctccacccaccccacccctcactcaggtcgtgttttcaggagctcaaggctggagtgtcttgacagtaaggggaggggagcggaggcggaggcgcctcaggcagcctctccccctccttcctggaccccccaaccccgggcccgccagccctggcttgggcttactgggtgaccgagagcccgcggggcaagcgggaggtgcctaggcctctccccatccccctcttctccgcacgtgggacccttagcccgtggccagtcccctggtcaccacgattgcgcgacctccctttccctggggccttttgtgccccgagttccgcccacccgcaccctctgcgcagagcgccctccccacgccagtcgaccccacaccccacactccccacgcgccgcctcccggaagccctcctggacgcctcccgtggatgggcccaccgcgcccacgggggctttaggggaaggtgctttgggcgttttttgcgccatgtctcctcggggccggcggttgcctcgggacggttctcgcctcctcccacagccccggtgtctgggacgcacccggcagccccgctgctgccgccttgtggcgcgcccggcccagccggtggcttctgtggtcgccgggggctgagcgcgcggctgggccctgagtcccccaggccgccccgatcctctgtccccgccgccggccccgctgcagtcccaacccgggcctgcccgggaggagcgcaggggcggcgatgaccagtcccgaaaggggctcagagggcagcgaggaggtttcacgccggtgcggggcgccgtcgaggtgggggcaccgcgaaggtggaggcggggccgcgccggaagccccgagtcgagcgcacacggcgggcgcccctggcaagtgggactcctccggccccgaggcctgaactcagcccggagaccgcgcccaccagcgccggtgtccccggaggggccccgctagttccctgagcagaggtcctgcggcttcccggagggtgtcctgttctctcccccgcctcgcatccattctcgccctggtggttggtgtctgtggtcgggggcgagggccgtctagtggagacggggattcaggccgcttgaaagtctgggatctctgggcggatggcagcggctccgcggagctcgagctcggcgcgcaggtcctgggcccagggcgggagcgctagcgagagggctgccccgtcctgcccagagggtcctgaggactcccgctgctcctggagtcttggggaggggtccggctccacggggtgggggtgggggctaccaggaaacctttgcctcctggggctgtgcaggaccggctagccagcgctgggaaccagggctgagttcagcccagctctgtccaccccaaccccagggctaggggaaggagctgggagaaggagccccacctctcccaggcgagtatctgtcccaggagcccacacagagggacacccagctctggtctggccttcgtgttggcttcaaggtggtaacagagagagctgcagagtgggggtgtgtttgccagtccctgcatgggtgaatgttggggtgcccactgctccccaggcaggacccccaggactgtcagctccccttcccacagagcacccacctggaggtgtcacctgccggcaagcgtgggccattcatccacctgtcagtcaacaacacccgctgagcatcggcttgtatcaaaaggtccagacctaaggggaaattttatctctttctttctttctttcttttttttttgacacagagttttgctcttgttgcccaggctggagtgcaatgacacgatctcggttcactgcaacctctgcctcctgggttcaagcgattctcctgcctcagcctcccgagtagctgggattacaggcgcccgccatcacgcccgggtaatttttttgtattgttggtagagacggtgattcactatgttggccaggctagtcacgaactcctgacctcgtgatccgcccacctcggcctcccaaagtgctgggattacaggtgtgagccaccgtgcccggcctctttttatttattcctaaaatattaccttgaggccaaattctgcgcttaaggagaatgtgcaccaagtgctggggtgggggctggtaataaacgaggccacaaatcatgcttgttaataaattgtgtggttcaaatctg

SEQ ID NO: 38550 - DNA, 19317 bp, Homo sapiens
gctggatccagcgtagcggggcggccgggcggatccagcgcagccgggagacagatgcgaggcggcggtcaggtgagcggcgcggggccggcggggtcggggccggcggggacggggccggcggggacggggccggcggggacggggtcggcggggtcggggctgggagggacggggccggcggggacggggtcggcggggacggggctgggagggacggggccggcggggacggggccggcggggacggggccggcggggtcggggctgggagggacggggccggcggggacggggtcggcggggtcggggctgggagggacggggccggcggggacggggccggcggggacggggccggcgaggtcggggccggcggggacggggctgggagggcggcccgcccggcgcaggggcctcgagacctcggccgccccaccccggggacgccgccgctgctccggcgtccacaccagctgcgtgcggagcacccgggcggctcaggggacccgcgtggccgtgcccccgccctgggctgctccgagcctcagtttccccctcggtggaacgggtgggtgggagagacctgcccccgaggagcccgggagaccgggcgagctcccgcgggtgtggtgggtggggaggcacagtgctggggtggcttctccctgcagcaggtgccgaacccacggccaggcttccgtggccagcagccctagaggaatggccatcctgtccctgcgagcccctgggccctggcaggcgatgcaggtatgggcagacaggacgctgttgactccgcacaccggggtgacttctcaggttctcggggtggcagctgcagtgatgacaccgcttcctggtggtcacgccgcgggcaggacgcgggaggccaggtccgtgcatcccgcgtgtcctgagcttcggcccagggtccctccgtgccccggaaccccgccggctttcttcggcttcctttcattgctaagttgtggggtcctccccgatgagagcagtgggctctagaggaggggcagggggtggccagacctcttgctttcactcttccacttcctgcccgctcctttctgaggccaagtcccacatctgggtgcagaactggtggggtgagcctggtgagaggggcaggctggcgttctgctcagagtcggccactgtggccggcatccccaggtctgtgtgagcagaagctaaggctgcgaggccagcggcctcccctcattcatcccctgcccgtgcgccaggcctggggctggcactgactgtcagtaaataggcaaataaaagatgccttttttcacagcccggaggagagctggtagcctagagtacagctgctgggcagaacggaggtgtccctgccagcgtgccttccttgacgctcctctggccatgttttaaacaccaggaggtttccagcggcttccccaggcgtagctcctgcacctttttcctgggctggtcaccatatgtgatgacagtgccagtctgttctgagcagctctgggctcctggcttcactgacatcataaacaagtccttagcccttccatccaccccagaaagtaggtgttccccctgatttataggcaagacaatggagaaccagagtctaaatcagggctgattttttttttttttttgagatggagttttgctgtgttgcctaggctggagtgcagtggcacaatctcggctcactgcaacctccacctcccgtgttcaagtgattctcctgcctcagcttcccaagtagctggattacaggcatgcaccaccatgcccagctaatttgtttgtgtttttagtacagacggggtttcaccatgttggtcaggctggtttgaactcttgacctcaaatgatccacccgcctcagcctcccaaagtgagccaccacacaccggccatgattcttaaaaataacagtaataggccaggcatggtagctcacacctataatcccagcaatttgggaggcagaggcaggagggttgcttgaagccaggagtttgagaccagcctgggcatcagagtgagactccgtctctacaaaaagttaaaaaaaattagctgagtgtggtggcacacactggagttccagctacttgggaggctaatatgggaggaccccttcagcccaggagtttgaggctgcagtgagctgtgatcgcaccactgcactccagctcgggtgacagagcaacaccctgtctcaaaaaaaagtaataatgataaattataatcaatatttattgggtgcttactatgtgccggccagtgttctctgaacttagtattaactactttaatcttgacaataaccctgtatggtactattgtaatccccatttgagacatgggagaatggaggcagagaaacgtttatccacttacccaaggtcacacagctaggagctagcagagttgggattcaagctggacgtgtctgtcttgttaccatgaaactattgggatcatcagtcagaatcttttcttttttttttttctgagatggagtctcactctgtcacccaagctggagtgcagtggctcaatctcggctcacctcctgggttcaagcgattctcctgcctcagcctcccaagtagctgggattacagatgcccaccaccacgcccggctaatttttgtatttttggtagagacggggtttcaccaggttggccaggctggtctcgaactgctcacctcaggtgatcagcccacttctgcttcccaaagtgctgggattacaggcgtgagccaccgagctgggtctttcagtcagaatctactttggccgcaagagacaaaaacctcccctataacactggtgggaatatcgtatttctctcacttgaatgaagtctggctgtgagcagcttagggctcaggtgcagtcccctgcaatcacgtcactctccccagtgtggctattccagctgcagcctttacatctgcattccaggcagcaggaggcagggatggctgaagaggggcagcccctacctttaaggacaattctcagaagtcttttcttttttctcatatgtatgtatacacacacacacatatatatgtatatacacacacatacatatttatgtaaaaaagattttttttttttttgatatggagtctcgctctgttgcccaggctggagtgcagtggtgcgttctcggctcactgcaagctccgcttcctgggttcacgctattctgctgcctcagcctcccgagtagctggggctacaggcgcctgccaccacacctggctaattttttgtatttctagtagagacagggtttcaatgtgttagccaggatggtttcgatctcctgacctggtgatccgcccgcctcggcctcccaatgtgctgggattacaggcgtgagccacggcgcccagcccatatttgtataaaatttaatagagatagggcctcattgcattgggcctggccggatgccgtcctcctgccttggccttccagagtgctgggattataggtgtgagctaccacgcccggcccattactgttgttttcagatagccctgatttagtctctggttctcccttttcttgcctataaatcagggagaacacgtacttcctggggtggatggaagggctaagcacttgggtatgtcagtgaagccaggagcccagagctgctcagatctgcctgatcttctcaagccgagggggtcagaacagtcactttaccaggtctagctgctggggaggctgggaaattatgtgacaaacaaaaatgaggctcctcattcaggaagaaggaggagtgatgttgggatggcctgatttctcctgtgtcctgggtgctccctgggagactggggaggtgctggcatcgggtggccgcctctgactctgtgacccacccacagtcatcaggtaataagagaaggaggtgggactggggcccactcacgttccctgtgtcttccccgtgcctccctgttggggtccacgggcagcctgtccatgggtgctttgtcctttcaggctggcgtgcaggtgcccaacccacactcctgccccacaggcacaacaggcaggacaggccccataggtggtgtggagtcttgcccagttgcagggcagccatgtggggttggggtggcctccttatcccactgccagtgaggcaattagttcaaatcccagttcttccaggccacagtgtgaccctgagcagggccgtcccctctgggctcagctctctttcttttgggagaagagacagaggataaatcataggattgattattataattgtgaattatttcagactgtagcaggtgtagtgaaagcataactaacactgtagcaggtgtagtgaaagcataactaacactgttgcagttactgaacaactttaaaaagacatctccgactttctataacatcaacagaccttacagcgagcttactttgtgctcagtctctgttaactcatttcaccctcacaatggcccattacggatggggaaatggaggcagagaggctaaggaatgtggcccaggaagttaagtgggagggctggatgccaactgcctctactcccaccccaaccaaagtcccttcctccctgccaggagccatcagccctgtgtgttctgcagtgttctgagcctccgggtggggaaagagcaattcttgatcctgagcttctgccacgtggagaactaggcccttccggcctgtttcctgggttcctgaggcacagagccgtgggcctggttcaggtcgtgttgctcatcacaggatcagaacccaggccagagagcctggatgcatttgtagggggcttctctgtgtgctggcagggaatcctcccaagatcccctgctcctgggcatggggaaggtgggccctgctcactcacctgtggcagagcaggaatgggccctggaactgtccccaagtgtccaaccctaagtcctgagacaggggctgtggtttcagggtgctctgacaagaaagcacctttgcttggggcccaggaaggaggaacccatttctgagaggtgtgtctcacatagcaggtggatagcaagctagagcggggctgagtgagtatctggggctgaggcccagagaggatcccataggtagctctagggctggagctctgcaacattgggcaagaggaccctgtgctgggaggcagggagcttgggcccctcagatgggccacgtgccctcgtgggaccctcattgtcaccgtgagctctttccaaggggacgccaccagtgggggcctgggcaggaggcagctgaggtgtttcaggaaaaggctgaagatcaaggctgtggtgtgaggactacccactttagggaagtgaaagaggccagcctcaccccagacaccccagtgtggttggggaaagggggtggtccgtggtgagcctggtacctggggactcatcctggccctgcctggccctcaggtgggatgctatggaatatgatgagaagctggcccgtttccggcaggcccacctcaaccccttcaacaagcagtctgggccgagacagcatgagcagggccctggggaggaggtcccggacgtcactcctgaaggtgggtgctggtgggagtcagggtgggagctgggcaggtctctgactgcttacgtggacccctcctttcttcctgccgcgtcctgcgcagccctggctttcccacggagccggcacctgctggctgtgttctttttcccatctcttctgtggtcgtgtggtttgtttctgtgtccccactagaattcacattcctgagggcaagatttgtgcctgacccatcactgctgcatcctagggcccagcacatagtaggtgctcagggaacacttgctgagtgcggtcagcgctgagacctggtaagggagaggttagccgagggaacgtgctctgggcgtcagggtggcatgagctttagaaactgcagatgaggtcatcagggagtgcttggagcggggcagctgcagagacggcctggagtcgacactggggttcgtggattttgctgtgtagccatgcagtggtttttctctcgcccccgtggtcacgcatgaggtgtccaccttagaaatgggatgtctctataatgctgtcttgaggacttttggcaccgagtgtcattccacctcctcattttgagtggctctttcctgtctacacaaggctgtgggctcctctgtgaatgcagactggacggtgtgcagatctgagtggtgcccagctctcacggtgcctcctttctgtgcggcttcctgaatccctttcccactcctggctatctcagctcctccctaggggatgggaggcaggaggtagcagctgacgctccacacctgtccccgtcttcctccagaggccctgcctgagctgccccctggggagccggaattccgctgccctgaacgcgtgatggatctcggcctgtctgaggaccacttctcccgccctgtggtaaggttttagatctcggaggggagagggactgagggaacccccaaggcaggaagggccagggtttccttgtcactccctcccaggtggcagggcagtgtcctgtgagctggggtacagtctcactccattgtcaggctcagcagcccccacctcagccagggctcctggcttcgaatctgaggcctgcatgacaccacagacccccaccctcagagcctgagtgaaggcaggtggagagagcctgggattggggttcatgaacctggggctgcttctgtcccctgagctccatgtcttcatgaagcaaatgtgcagagaatagattccctctggggtccttgaggtcctgtacacttgccgagagtcagggtgtgggaggcaaggggaagccccttgtctgcctcgtactgaccagtcggtattacagggccactcttgtttgttccgtgttttgttccatggaagccttgtgttgaagaagaaaagggggaggatataatgatttttttaaaaaagtttgaggccgggcgcggtggctcacgcctgtaatcccagcactttgggaggctgaggcgggcggatcacgaggtcaggagatggagaccatcctggctaacacggtgaaaccccgtctctactaaaaaatgcaaaaaatcagccgggcgtggtggcacatgcctgtagtcccagctactcgggaggctgaggtaggagaatgatgtgaacctaggaggcagagtttgcagtgagccgagactgcgccactgcactccagcctgggtgacagagtgagactccgtctcaaagaaaaaaaaagtttgaaaaccttttatttttatgcaaaccatctccaacttttgagggaaacattacggcaacattcaaatgtaactttgaaaggatttgggccagacgtggtggctcacgcctgtaatccagcactttgggaggccgaggcgggcggatcgtgaggtcaggagttcgagaccagcctgaccaacatgctgaaaccccgtctctactaaaaatacaaaaaaaaatttagccgggcatagtggagcgcccctgtagtcccagctactcaggaggctgaggcaggagaatcgcttgaacccgggaggtggaggttgcagtgagccgagatcgtgccgctgcactccagcctgggcgacagagactccgtctgaaaaaaaaaaaaagagggagagacttcatatatttgtttcgtatcttattttttttcctttttcttgagataaggtctcgctctgttgcccccgctgtgaagtgcagtggcgcaatcatggctcactgcagcctcgacctcctgagcccaagcgatcctcccacctcagcttcctgattagctgagactacaggtgtgcactacaatgctcagataatttttcattttttttttatagacacggggtctcgctctgttgcccaggctagtctaaagctcctgagctcaagtgatccacccacctcggcctcccaaagtgctagcattataggtgtgacccactgcactcagcttgttttgtatattacaacattttgagcacttcctttgggccacaggctgagctgcaagggggaggggagggtgccacctcccctttgcctgggtctcagagcccagcagcctggaggaggaggatggctcctgagggcggggtccaggctccccagcactgagacctgatcctgtcttccccgggatccccagagtgttctgagtctggggccttgctgggccgtgagccccctggtcgctatgtggcgaaagcaaccagaagtgctggggctggctctcggcatgtgcttgggcttggcagtcaagctcgaggccacttactgtccttcatgacagcaaatgtcctttccctagctttcctccaagaggaagctcttcagaaggaagtgaagtgacataacaaaaaagcatctggatttctcaaagaaggaagttgtcttttgaaaagcaactttcaaacattaggttttcagaggtctgtgggcaggcaggtcaggctaggagcacgcagcaccgggtggaccttgaccgtgctgccacctttcctgccctggagcaagtcctcggtgccctctgggttgagtttccttctctgggtgaggggtgtcggggtctgctctgggcctgtctcggcggatgggccttaacagggagctcctgcaggatgggcctttgactgcccccgcccccaacctgggcagggtctgttcctggcctctgacgtccagcagctgcggcaggcgatcgaggagtgcaagcaggtgattctggagctgcccgagcagtcggagaagcagaaggatgccgtggtgcgactcatccacctccggctgaagctccaggagctgaaggtgggtgtggggccgccccgccgtggggcagcctggggccgaggccagaactgtggaactaggaggaccctgccagcctctggctctctctcaggcggtggtctctctctcggcctcaggggctgaggtagaagggcacgagacaggcagggtggaagacgggccctcaccccactgcgggaggtttccctattagcctagaccctcctgttgcaaggaacagaaactcaaccctgagtagcttaagccaaaaagaaaaatgtatttgcttggtgactggaagatcctccagtgtcaggaatcttgctctcttccaactcgacttcctgtgtctgatccagcctcaggcaggccttccctgtgcggtggcagagacggtcccggcaaccacatcttgctttccaggagctgagcctccctgtgcagatgacagctgccttttcacagtggttatagcaggaacctcaggcctgactttcattggccagtcctgaccggatgacagtggctgactggccagttctgggtcatgtgcccacccctgacccaatgacagtggccgattggctagttctgggctgtgtgcccgcccactgacccaatgacggtggccgattggctagttctgggctgtgtgcccacccactgaagcaagcgggtgggctaagtaagttcctccctgagtgagccacatggacaaggacgggtggtgtcttgaaggtgacaacaaaagaaggtggtgggtcccaggccacagatgttcctgatgcagtccttgggtctgtgtgtgctttggcctggctgccctgtgtcccctgtgctgattcaggtatccctgggaatgtagaaagtagaatattcatgaggaaacaggtaaattggtggtaagaaaaaaaaaccccaaaacatagtggcttagagaagatgtgttcgtttcctcacgtaaaaatcccataggtggtctggggcctctatgacagctaatggtgttggggagggcctccttttccattgccctgcacctaaccggcaaaaagcaggaggggcagagaggccgggtcgctcccgctcacatgcccatggcccggtgcaatcccacacagcccctcgctgcaagggatgctgggaaaggtcgcaagggatgctgggaaaggtagcatgtgaccttggcggtccttgtccagctgatcattgtttactgtgaaagggagaaaagggacatggcattgtgctgaaactcacaatctctgccctaaatggtgcctggaagaaataagttgaggggcttgtgcgaagggaaaggaacttcagcccagctcacctgtgaccccctccctgactcaccctctgcaggaccccaatgaggatgagccaaacatccgagtgctccttgagcaccgcttttacaaggagaagagcaagagcgtcaagcagacctgtgacaagtgtaacaccatcatctgggggctcattcagacctggtacacctgcacaggtgggccgagacccagacgaggagtgaggaatgagagagaccaaagttcctgcctccgctgggctcacattcagatgtgagctatccagtgtggtggccactagccaaacatggccagtcaaagttaaattaactaaatatgcatttcctcgttgtactgtctacattggacagggctgttctggatgagaaattaaactagtgaattacatggtgtgtctagtttgtacaatgaagaaaaagggaaaggacctagcacgtgttagggtggagtgaatgtgactttagggcagaatgtaaaggcatcacgtgactttgttttttgtttttgtttgtttttggtttggttttgtttttgagacggagtctcactcaatcgcccaggctggagtgcagtggtgcaatctcagctcactgcaagctccacctcccgggttcacaccgttctcctgcctcagcctcctgagtagctgggactacaggtgcccgccaccacgcccggctaattttttgtattttttttagtagagacggggtttcaccgtgttagccaggatggtctctatctcctgatcttgtgttccgtccacctcggcctcccaaagtgctgggattacaggcgtgagccaccacgcccagccggcgtcacgtgacttttaagcaaaaacttgaaggtcagggagcaagccaagacaatatgtctggaggaatgttctggtgggggcagccctgtggttgatgtgtccagtgccttaaggaggagcagagagccaggtgtggctgcagctttgtgtctggaggactgttccggtggggacagtgctgtggttgatataaggaggagcagagagccaggtgtggctgcagctctgtgtctggaggaatgttccggtgggggcagccctgtggttgatataaggaggagcagagagccaggtggggctgcagttctgtttctgggggaggtgggctcagaggtggctggggcttttctttaagtgcagtgggggccacaagtgggtgctggacatacttgagctttaataggttactgtggctgctgactgagcttggactgagagggaggtgactgagaagagggggatgactctgattgggctggggtaggtggtgggagtgaggagtcgctaagggcagtccagctgaaggtttggaaacggaatgtaacagattagaaaatagtctgactgagtgcggtggctcacgcctgtaatcctagggttttccagtgcaaagatgggaggatcgcttgggccctggagtctgaggctgcagtgagctctgattgcacgactacactccagcctgggcaaaagagcaagaccctgtctcttaaaaagtacaaaaacaacaacaacaaaaacagagagagagaaacccttcaggataactcatgatattgaaagggtggagctgctgaaaccgagatggggaagctgaggggcttggggtcgggggtgggagtttcgtttgttacatttggacaggttgggtctggtggtgggagtggcaggttggccccaaacatgtgagtcaagttggaggacaaggtctgggccacctttggggcaaggctcaggggccagggagaaaaggatctttgaggttctaaggcctcccttggtgccaggaggtcttagattgatctgggcctcagagtggaacccacggggagggggcaagccagctgagggtggcctgggctgcaggcgcacccttcccgcttttgagaagtgtgtgtccctccaccctagggtgttattaccgctgtcacagtaagtgcttgaacctcatctccaagccctgtgtgagctccaaagtcagccaccaagctgaatacgaactgaacatctgccctgagacagggctggacagccaggattaccgctgtgccgagtgccgggcgcccatctctctgcgtgagtggtggcagggagagaagagggtgagggagctgttcctggcggggagccgggtgcacaggtgtgtaagggcacgtaagtcagacagttgagtgaggccctggggcagtgcctgcttgatatctttaggaagtgacaagggtctgttgctgccattgtttcatttctcactgaagcagactgaggttccagccgttccgtgactcacccaggtcactgaggagcacctggagggctgggacctggcctccgcctccccgtgtgaaagcctcatagatgaggactagggagaagtcacacagcacagaaagcctcatagacggggtctagggagagtacacggttgtcgcccagttgtgcacatgtgcgcgtcagctcttctttctagagagttgctggtgttaattcatgaagtccctgcctcggtcctacagtgaggccctgtttatatcccattttactgataagagaacaggtcagtgagacgctgggaccacctgaggtcttccggctgaggataggacatgttcccatgtctccccgagggctgtggtccatgggaggacagaccatgaggctggaaagctgtgtggggtttttgtgaggcagggacactcagggcccctctgaccctgcagggggtgtgcccagtgaggccaggcagtgcgactacaccggccagtactactgcagccactgccactggaacgacctggctgtgatccctgcacgcgttgtacacaactgggactttgagcctcgaaaggtgggggttggaaggtgggggcatccccctggggagggagagcaggaagggggttggggtgtggagccggtgtacccctggttgggtgttgcccgctgcacgggccctgggtgggtgtgagaggtgtcacccggccgtgcctggcaggtttctcgctgcagcatgcgctacctggcgctgatggtgtctcggcccgtactcaggctccgggagatcaaccctctgctgttcagctacgtggaggagctggtggagattcgcgtgaggctggggccatggaagtggggggcgggggcgctgtgtcaggtgggccctagggccgggccagtaccctcttctcctctgggccacgggaggttctgagcagaggagggaggccacctgcttagggtgagccaggcgccgcggctgcccttttggttgaaggtgctggagcggtgtcccgtagtgatctgatgccaggtgtgaacacaatattaaattttgtaatagccacgttaaaaaagtaaaaagagctgggcacggtgctcacacctgtaatcccagcacttgggaggctgaggtgggtggatcacttgaggtcgggagtttgagaccagcctgaccaacatggtgaaaccccatctctactaaaaatacaaaattggccgggcatggtggtgtgtgcctgtatcccagctactcgggaggctgaggcaggagaatcacttgaacccgggaggctgaggttgctgtgagccgagatcgcgtcactgcactccagcctgggcaacaagagcgaaactctgtctcaaaaaaaagtaaaaagaaacaagtgaagttaatgttaatagtatattttatttagcccaatatatccaaaatgttatttcaacatgaaatcaatgtacatttttgagatatttgctttctttttcttttttgtgccacgtctttggctccagcatgtagcctctgctaagtctcactgcacagcggccactttgaggtgctctgtggctgtgcagggctggtggccactctcttagccagcggtgagggaggaggtagggcgggagccgagggcagacgggagctgcagtcctggcaggacatgatggcgtctcacgccaggtagtgaaaggaggcaggtcccattttacccgggaggagactgtggcagcacgttgagttgccaaggccagggctggggaggcagctgggatttctccggaagtttggcttggtcctgaggctgctggttcctagacagttgtgtgcctgtggggccgggtgagggcagagggaagggagggttttctggaccacggtaagtgagcctcacggtcctgcccagcctgggagctgtgattttgggttttggtgaagcactcagatctcggcccttcgtggggaaccaacccctcctggccctgccgtggccccgggtgtgcggcccacacaggggccgccctgtgtcctggctgaggaggcctgcctgctcccgccttgtttgcagaagctgcgccaggacatcctgctcatgaagccgtacttcatcacctgcagggaggccatggaggctcgtctgctgctgcaggtcagactgccagcaggactggcccccgatgggaagcgcagccagggtggtgaggcacctcaggctcaggttttttccggacagcttgtgcgtggagtgcctttagcagagggtcgcctcaccacggtcccaaggaacaaagcaaacaggtgttctgcctacaaaagagttctccagtcagttccgtttggcaaaccctgcagcccttatgtgaatctccatggggtgggtccagcccagccctcgtcaggcaggttgaccacaaaacacagttttcaaggttcatctaattatgtgctcaacagatacagatgttctagattctggaacagtgaacgaaacagacaggaatgcttgcccttagtgcctttcaagtagggaagacaagaaaaatacgttgtgtgctggggtggtgaactctgtgacaagatagagaaggaagggtggggaatgtgggaagcgtggggagtgcggggatgcggtgtggctgggaggggctgccttagggagtggagggcggggggctacacaggtcaggaaacgtggcccgggtccatcttcccctgtcggcttcctggggctcctggattctactcctggggcccagacccttgtgtagctcgtttctctgtgagcacctgggccctgaccactgcagcgaccatgggtgggcggtgggaggggccctccccggtgcagggcgtcacggctgctgggacttggcagctccaggatcggcagcattttgtggagaacgacgagatgtactctgtccaggacctcctggacgtgcatgccggccgcctgggctgctcgctcaccgagatccacacgctcttcgccaagcacatcaagctggactgcgaggtgggcctctgcccgagggccgctcttctccaaccccagccctgaggggggattggcaggagaagcagcccagcccagtgtgtccctggcctcagagtgcccagaggagctggcactgacgtgcccgtgccccaaccccacactgttccccccagcggtgccaggccaagggcttcgtgtgtgagctctgcagagagggcgacgtgctgttcccgttcgacagccacacgtctgtgtgcgccgactgctccgcggtcttccacaggtgggtgtggcctgggccccgcactcgggggctggggctctgcgctgtcctctggggagctgccccttggcctccggtaggatgatgccgtgggagctggcactgctcccccgagaaaggggagacataaagactctttgggtctttgctgaccctgagatatgaagtcagaccctgatgtctgtgactaaatgagaagttcccttaggagcggcacctgggggatgagggggctgccccttcccaggtccctcccggaccagcccctgaaactccagcttggtctctgatgtgttcacagcatcccagctgctccctttctctactaggattgaagtcactctttcagggttagtataggctagagattcccaaacctatagttcctgccaccctttaatgtctcagtaattttttcaaagtgtttctaagccagaagaaattcctaacactttgatttattaagtacttatgctctcgcgttttttttcctagccgctagaccaacagggaaaaatacttatgttcaaacaactttataagtatttgtatcctaaagattgagtggctcttggaaaaataatgtacacaaattagaagaaaaatattttaatttcattcttcagtaagtatgattacttactaatgatatgggtacaccttttgggcctcacacatcttccagacctggaatcagatggacactcccccccagtttctgtcccctgatttttgcctggaatttgctatttttcatagcaactgctgaaatcccagctctacagagcgatggtgtcacacagatgggactgtggcagaaactaaggttgagactgaactcgctcgagctagtcgtttgctcagtgtctgacaggtgttaattactgctacgttctgtttaaaagtttgaactaggctgcggtgccccagggtgccgtgatgtacagtttgggagccaggggagggataggaacaggtgggaatcgtgaggaagggctctgagtcgagtctggcgtggccacctggctcagcccctcagctgtgtgaactgggacctgtgtggttgggggatagcaggtagcgtgaggacccctggaggtccacatctgcacgcccgtaagcgctctgcacacggccatacagtcacttgcatctggctgcagactccgactctgccctttggtaacggctgtagaggggatgataggagctgacctaggacgcttggggggattcagtgctggagtttcctgtgcagagagccccgacctctttctgcccccagggactgctactacgacaactccaccacttgtcccaagtgtgcccggctcagcctgaggaagcagtcgctcttccaggagccaggtcccgatgtggaggcctagcgccgaggaacagtgctgggcaccccgcctggcccgccaggacccaccctgccaacatcaagttgttccttctgctccggagacccctggggtgcggccctggccccctccacccctgctgggccagagcgggtgggcagtgtcaaggcccgctgtctcccaggtgcttgctgggactcggggcggctgcacctggctgtcacctgggtgtgctgctgtgaggggtccttgcgtggcccccatccttcccccaatgcagaactccatgggcagggagctggggggacatctcacctcccccatggcacagagccctccacacccctggaccagggcatccgggccctagaaattccacagctcccgtcctggccaccctggaagctcatcaggccaagacccggacagagcttcagaggagtgttgagtgacacctgaggatgcggctgcacacactcagccaagggccgagtctcacctgcggtggggtgtcggctctgcctgggggctccatccctttcagccactcgtggccttggggatttctggttgtccccagctgggactgttcacagttgtcacctgcagacctgcctctccctggcctgaggttcaaaggcctcatcggatggtcagtacagtggggtcacctgttgtttctatacaacagcagggaaggggccatggagcttttccctgctgggtgctcctgctttggcccagcccacctttcctggtgctccaagctaggaggctgtggccccagcctgaggagggtgtcctggcctccaggtgtgcagcaggggctgtgtgctgggggaggttccagttaggcgatgggatcctgcagtggtctggtggcatttcttggaaccagatttacctgaggagctctgtcctgctccctgtggagggctccagatagctcagaaatgaccagccaatggccttttgtttgggggcctgaggtcaagagagctgagagtattcgctcgactgagcacattcaggaagatcagggcaggcgtgtgggaggtccctcactccacgggacagaggcccctgggcagcagaggaaacctacagctctgggtgaggggacacttggctttggtgtttgcactttacagatcctgcggtccacgaggggcctcaggagaggacgtgtcaggacgtggcttcccagccttctgccttgggcagtgggggtgctcctgtctgtccttttcccccacaccctggactgtgcttggctgttggtgcacatggttggcacacggtgggcagagggcagagaatgccactgcttggttattggtcccctttgaccaggaaacccaagaggagacacctcagtcagcagaaaggccacctggctcactggctcattccaggagtgggagagacggcagggtctcctctttgtcctccggcatcaggaaggggatggtgtccactccccactgtggtggctttaggcaaggttcttattgtctgctctgcctcggtttccccatctggaaaatgggggcaggggtcctgacctacctcaggtggaacggtgagcagggaacatgtcggagtccttcagagaatgtgatgtgaggttggatcaacagtgtgggttcctgtcctgtttccccttcctctttggggctgaggaggaggttaaaggccaaatgctgtttcccaacaccccaaagtctgcacacgtctcatgaatgcatcacatttctgtcatatggatattagccattccgaaatctgtgtaatcaacttcacattattcaagttacaaatcactgtgtccatagaaaaactgtgctggtatttgctggacaaagggttgggccccttttatttttacctgccacccagcatctcccccacctgccccttctgggtgacacagccggtaaacggaatcacgtatggttctttctgtgggtctgtggcacagcaggaagagcccggtgccgccagcaccttgtggaagaccacacatgggtggtcccacagcatgggaccaggctggcctgagggatgcccagttgtaacaatgctgctgtcactgtctcattaaatatacatccttt

SEQ ID NO: 38551 - DNA, 18532 bp, Homo sapiens
catcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccggtaagctactctatccattgcccagaatttctttccccagcccacacttctcatttcctagtgtgtccctttccatttcatgtccctttccatttcgtgtccccttccattgagggaaggatgtgacaagtcaaacaaaccaaaatagatttttctaagagtggggttgcttcctctttcttggcattttccaagaagaaaccagttcatgaggcatcttggttggcaagaatgattgtatgtgcacttgctgctggaaggtgtgcagtgcgtgtgtcttgagcctgggccttaaataacccctctaccatcaccacacacatatcagtgtgtcatgcctaagctgcagcaatatctctgtaagctttgaaaaactaacatttcaataaggttaatctgttccttactcaaattcaacatttgctaagcaccaactgtattcagggaacaatgccagaaatgggaggtcgggatagcggggtggttctcataacccctgttccctgccaaggcatcaagcaaacagccccacttgtgtttggggtagctgtatgtagccaggtagggagagtgaataccccttgcccacctttccatttccagttgttctattgaggttcttgaagactaagaagtcaagtacagtactgtaaatctgagggcccaacaatgggagaagagaagtgatacacctatctcatcaaggcttttgtggaagcaccgcctcttttggagaaggctgacagtcagatatgggcagaaatggtcttagtcaggatcagtgtatgcccagtcaacctggatgtgaatgttgggcattgatttcttctgagaaaacatcacggggctctgtgctacacacttagtaggcaattgtggatttttttatactgccctagtggctcttgagccccacaacccccactccaccagctttcttgagaccaggagaatgtgatagaaaaggtaagatggcaattagaaggctccaattccaagaaaaaaaaaaaaaaaaagcaaatccagataatactgccaaccacacaatggagaaaaaagtttgacaatgatgctaatggtactacaactaccactaatagtaataatacgtgtttgtgtattcatttatagaacctgaagtatcatgtatatatgttttgattttgtttgaactcagaggtcctggatagagtgagctaggaggggagacattttgtgagggtacatttcatttcatttattggtgaactgaaagtgtaaaccaatgcgattatttgtaaacagatatagatgtaaatacaaatacatataactattgtgaaaatgtttgcacctatagttccatgcttaaagacaatttagggaacttgctcattcatgagacccatgatgttatagctcgtctgttcaaaggaggaaattgagagcagcagaagtgctccctccagtgtagggtgcccatttgctggaagcatgtatggttactgtatagttcagttaggatagatttactgtgaacttgtataagatcacttcccagtgaaggggagaggggggcttgcccttggtgtagcttttcctggtatacttagcatcaaaaggctgagtcagaaattagacaattttgatttttttttttcctgcctttcaaggtttggagtaagagttttgttatctttcagtgtcaccctgtctcagctttgctgagctggacatagaggaaaaggcttctagtctatgactgggctctagttttaaaggagaatcactgaaccttgggctggttacagtaagggaccaaacatctcaaagcagcagacaagaactttgtgccaggaagtggggactcttgtgcagacttccacatctcacatgcacactgttctctagagtccttcactcaaacctcagaagtctttttgttttgttttaataaaggaaaccaatctctttcaaaactcagagagggaaagtgactttctcaaagtctatcaccctgttaagcagcgcttaacttagacgtttctctcatataaaattcaaaacacaaacttccatatatacaaccccctgagcaggcaactaactatctaagctattcatttaggagaagatcatccatcttccagtagatcaagaaggaagaagaaacagatgataaagggcacagcattccgatttaaatggcttcagcgagccacgaagatcattagacattatctacactctacggttgtcactctttggtggcttgcctgggtggccgaaatcctcgcctaaggagctgacatatgctgcagcagcgccattctcttctgctgtcttcctttgctatggaagcttttcagtgaggttttgatccccttttatggtgacacaagtgagtttgttccttggtttcctttgttcatttattcatccttactttcttgcttccttctttccttcttttcccccttccatacatatttattcagagtcttgaataaagctcctgtcttccagctttaggttgtcagataataggtgcaattgtttttttaattggtgctggtctttggtaatttgtatacacgcatgtatacctaggcattcattaagagcaaggctcaggagtgctgatatcccattggccaggacttatcacttgcctatgcctagcagccagggaagtagagaaatgttgatttttttctctgcagtcatgtgtccagttaaaatctagcaccattaaggaagagaagaaagcagatactggagaacagactgccacactggatttcccaggtctttgttcattctcatctttatctgcttctcaataccctttgcatccctcaaaattcagctcaaatgtcatctccttcgagaggtctgctgcccaaagagaaccaatctttctctctcctctgttactgttccacaatagcacctatcacattgacttgcagccagttatttatgtgcctgtgacttccactaaattgtgaaatcctcaaagacaaagaccagattgtgcccatctctgcattcccagatctccagaaacatgagagatgctccagaaatatttgtttagccaataaacctccagaaataatggaaggatatctcccccaaatgaacaaggtgtaccttagagatctttttcatcttccccctttgcctaatagaggcacccctattgcctgatataactcactttagaagagaggttaaagatgaaactctgagttttctgggcaggggtcgggttgggggaaggataaagcccatactggattctaatcttcttccagatgtggcctcacatctgaaatacactccctgtcctcaggcatcatcaatgacatgccatcagttctaacaagttctcatggaatgcagtctttttaccctgcaggggcagagcactaggctaggtacagccacaagggtacaaaggcaccaagcagcaatagtaaggctcctaaccccttaagttgtgaaaccaagcctgtggtcatgggcaagtcaagagcagttaatgacttaagacttaagacttaagaatattcataaaattaaagcaaataattcggatttctggctgcagccacagtaacccactctagccaacagaagggggaaaaaaggtctttatttaaaaaaatacaaggatttcttatgaaactcaaggaaagacatgcacctaagcctcaggtagtgctagaaacaagaacatgtcctactaggacattttatgtgatttcaagtttattttctctatagccaattgggacccatgcttttcaaagtctgagttacgtgataaaaaaaaattttttttagttccttcagggaggagtgtgttagttttgttaataatgcctgataattgtccccatccaaggcatgatttacacgcaattccatttccaaattcccagggaaggagtttgattggctcagcttgagtcaggtgttcactctaggaccatcagctggatagggtgcatgggatctcattgtctaaagaaacaagctgttattgtcacctacggttagagaggtccgggaaagggtcatgctaggagagtccactaccatctacccaaagctgtagtaatagggtggcaacatggtgttgtgctaagaacatagaattttagttccgccacttgatcgctatgtagccttaagctcgccactcaacccttctgagcaccagtttccttagctataaaatacagaaaagaataatctaccttgtggtgttgtgaacattatataagagaacactggtaaagtgtctagcagagtctggcatatggtagacttgccacttccttcaaagtctacaaagtggttaaatgtaagcatgaatcttcatgtagctaatgggaagggagaaaggagaatctgtggagcagcggatccaacagaactttctgtgatgacagaaacgttctagatctatgttgtacaacatggtagtcacaggccatatgtggctattgaacacccatattgtaattaggtaaggaactgaatttttaattttatttaattttaattaatgtaaatgtaaacttaaataggcagcagcattcttttctctttttttgagacagaatcttgctcttttgcccaggctggagtgcagtggtgtgatctcggctcactgcaacctccacccccgagttcaagtgattctcttgcctcagcctcccaagtagctgggattacaggcacccgccaccatacctggctaatttttgtatttttagtagagatgggggtttcactctcttggccaggctggtctcgaactcctgaccttaggtgatccacctgcctcagcctcccaaagtgctgggattacaggtgtgagccactgcgccgggccagcagcagagttcttaagcagtagtttctatcttggctacacattagaatcactggggagatgtaaatactaataatatccagttcctacctagagagattcttgtttaattgctctgggataaggcccaagcctaggtgcttttttttaaaagcttccctgggacttctactctgcagcctgaaattgagaaccaccagtaaggagaaggaggaggaaaaatgagggttctggaagtctcaatgggttccttttctgaactacttgcatgcagtaattaggctggctagtctagctttgggttttaccatgctttaggcaaagtatttctacaggaagattcatgttaatcagcgacacctaacttcagcataggtggcttggagagccattttccttttcccacatgatctcttctcttcccttgccagggttcgtgtgagccaggatgggcagtttctgcactacatctttccataccagttcatggactctcctgagtgggaatcactacagccttctgaggagggggtgttccaggtaacagggagcctggtggcagcaccgcctcaccccatcccactgtagcccagcaatatccgtgcctccatgtttcccctcttacatctgtccttcgcacccctgccagtgtgaagctacaggcgggggcactcttcctctgaaaagagttcctgggctcctagccataggtgaggtagggtaggaagatgctggcccctgggtagaccatgttacttgtatgcttaaactcttctggaagaccctagtgccacaacataaaaacccacacttgttatagggtaacttaaaccttttagtgctctctagtcgcatttccagctctccctccttcatattttttgctcatactagccatgctgaaccactagtacttccctaaacacaccacattgttttgcagctctatgccttggcccctactctcccctctgaaatgcatttccccttctagatgagaccacggaacctcacttccactgtgaagcctgcttccaccccacagcctcaccagcttccaccccacagcctagcactcctgtgtgcctgttctagtccttttacttatgctaactggtgcacatcttgctgtctgttctaataatctggtctcctttctgtcttctgcacagtgaactctgaagtacaaatctaggcttttccctctctgttcccagactctaaaggaaagtacctggagcacagcagctgttcagtaaagaattgcttgccgggcgcggtggctcacgcctgtaatcccagcactttgggaggctgaggtgggtggatcctgaggtcaggagatcgagaccatcctggctaacacgatgaaatcccgtctctactaaaaatacaaaaaattagccgggcatggtggcgggcacctgtagtcccaactacttgggaggctgaggcaggagaatggcgtgaacccgggaggcggagcttgcagtgagccgagattgcgccactgcactccagcctgggcgacagagtgagactccgtctcaaaaaaaaaaaaaaaagaattgctgaactggtttgccactgggcagctggtgtcccagaggactccatggggcattcacatacatgctccaatgcaggttcctggctgcctggcccctactcttcttatctctgccaatccctcaggctttggtcactttctttgtagctctcacttattgaatggctagcatgtggcaggcactacgtatcatattgcctcattgattctcataacaactctatgggttgaatatgattattactccatttaacaactgaggaaactaaggcccaaaaacatcaagtaatttgcccagggtcttcagctagaaagtgacaaagccaagttgcctggatctaccatttctgttctttattaaaatgggaaggtcaccagaagagtagagtttacacacacacatacacacacacacatgcacacgcatgcacacacgcgcacacacactcactcacccttttaaggactcccctgcctggatagtttgctggacctggaaacactggattccatgtgtctcctactacttttatcagggagtccctcaagccaacatatgagccaaccccggaacagacacacaccgggcagtgctacctggcagggcctgcttctgcccccaccctgacacttggctctgtgatgatggagcctgagaggcagtcctgatcccactgccagggtcaccagccacagatccacttccatcatgttcctaccctgacctccgtccacacaccctccctaactagtccagaaaccttcttcaggaactctctcaggcacatgagaacctccaggagggctcagtcaggacctgagccagctggaccaggcctctttctgacactgacacggaggaacaggtggtgggtaagccgggtgtcctcccctaagttacgctcaagaggaagggctgtaacctcacatggcctctcagcctggaatgtaggtatggtcatgttcctcccatttatatttttagcgtgtacctcctttgggagtaatgagagccacacatttgctattggctgtgtaaagtcccatttcctctttgcaaatgtcaagtgttatcttaagttagagttcatcctgtccttgccttttgcaattacatagtctttgttgactgagagcaatccacagtgacagcctaaattataattcacattgtacctaatataaatcaatcagcattccagcacacctctcgacaattcaattaagtcagaattcattgtgtgttcggcactgtgacactcattagtcaccaagaacacagcacaggagggatcacacagaaatcatcactgtttttctaatttgcatcctatcttactggacctaagtcctatttacataggttatctcatttaattcattcaaccaacatctgagatgagtattaaaaaaaaagctaaatacttgtcaaaacgttacaacagatatgtctatatatatgggagaaccaatcaagaagcagatttcaggaggacctttggggaaggattttatacaggacatgagaaagcaacattagaggctgggcgcggtggctcacacctataaccccagcactttgggaggccgaggcagttggattatgaggtcaggagtttgagaccagcctggccaacatggtgaaaccccatctctattagaaaatacaaaaattagccagggtggtggcaggtgcctataatcccagctactcgggaggctgaggaaggataattgcttgaacccgggaggtggacattgcagtgagctgagatcacaccgctgtactccagcctgggtgacagagcaagacttcgtctcaggggggcggtggggtgggggaagaaagtgacattaggttgttttgcaatatacaagattggctgtcttcccttgattcatttattcacttcaataatatttattgaaaacttagtatataccaggcactgttaaaaggatttgaaatatatcagtgaacagaacagatgaaggtccctcccctcatgcaatttacattctaatgggggagacaaaaagccataggcataatgaataagtaaattatataatttgttagaggataatcactgctagtttaaaaaaaaaaacctagagtagtgcaagggagaaatggtggcaattttaaatagggtggtcatggaaatccttgttaagcagataacatttgagcaaaaacctgagagagatgacaggtgaggtctgtgaatatctgggaaaagcatatcagacagaggaaagagccagtgcaaaggccctgaggtggggccagtgtgtttgatgcacagaaaggaggacagtggacctggaatggagagaggaaggggagggaatagcaggagagaaagttggagaggtgacgaggtagcaagatcatgtagggccatagcatatattgtctagatacagccaaaaggattttctaaagggttggatatagtatgtgagagaaagagaagatcaaggaagactctaaggcttttggcctgagcaactggacaggtggtgctgctgtcaactgagacaaagaaagctgcaggtagagctgctttcgggggactaggaagttcagtgtttgatgttaggtttgcatcatctgtggacatttgaatggagatgctgcataggcaactggatatttaagtctgaaattcaggaatgagatctgggcctgagacataaatttgggagttggttgtatgcagatgatatttaaagccattggataggatgagctcaccaagtgagtgagtgtggatggaagagggaatggttcaagagcggagccctgggatactttagtggtgaggagttggagaggaaaggaggaagcagcaaaggagcttgaaaaggaacaatcatgagattgggcaaggagtgtatggcatcctgggaaccaagtgaagaagatatatcaaagaggaaggggaaattgatggatgccatgaaaactgaccatcagactcagcagcttagaggtcattggtgaccttaacaggaacagtctttgtggactgctagggacaaagtcttattggtttaagagagtgagaagagaggaattggagacagttaagtataaacaggtttttttttcttcatgagttttgctaaaaagggaagcaaattagtggagtgatagctagccagggaagtgaattcgagaaaaagaatttttatttgtaaaattttgttttattttaagatggaagaagtacagcatatttctaagaaggttcacagtctttgtgtttggctttaagacattatttacattcggcgtagttcttgctcaaacacatgtgcttcatatttggtactctgatttcttgtttgggaattgttcataagtacatctaaggtacaggccatggcagatgtgacaactacttgctgaactattagtaatggacagattgtattattttcagaattctttctcatgaggcaagagagattaagtaatttatctgacatcatacaactgatagaggtaaagctgaaacatgaaaccacttctggcctcgataacgtagtttaggtcctgattgcagtgctagcaattagtggagaaaagttgagaggaggaaatgaataaaggacgtgggggaggggtatagcagaaaggaaagaagagaagaggagggtaatgggagatccagtaggcaatacaggaatgaaaaggattatatataatctctaataaagaatgtttggaaagctaccctactttaaatttgacaattcatataaagtgcttaacacaacgcctggcacctcttgacaaatattagctgctaacatcattatcatcatcatttccactgtctccatccacaaaaatatatcatgaactctgccagcccaaagtattagggtcaattagattattaaaaattgtgtgattctgcacccttttcctgcactgtcctaagcatgtttccattttaaccccagctttaccacttatcattattttaacaaggatttatcaaacacctgctgcatgctaggcacacgttattgcttatttcccatgcaagcgtaatttagctttgcatcatgggcacatagtgagtactcagaaattcctagatgaataaacaaatggagaatggggtgccctttgattttctaccctttagagtttgtcttccgctatgccctttttctgatttcagtcatcagatccttttggttacttgaaatggccaagttacgagcaatttcgtaacttgctcgtatcccaacctgaatcccaggcttgggatcctgatgtagcttggcatacctcatcagaagctttttctcaaactcaactttccaactctttttatgtccctaccccaatatcttacccttcctcattcttaaaatgaatagttgtcagcatttcaaccactcttcagagcacaagaaggccccttctttctctatcttaaaatcataagactcagaactttctgcagtcattagtggcattagccacggaaccacagaattacagttgaggaaagtggatgtggaaactgaggcttcaggaggtgatgggtgagtgagtgaatggctgatcccagggctcctgacacaggacccccccatatcagtgcacacaagtgaaagtcatccactagacctcctccaggcaaggccatagaggggtactcccacacagcttcttcagtaaaagtacagctgtttgccaagtgactgaatgatctctgtgctcagcatggacaaattttctagtttaaacttttattgtctgcttctgacccctctcaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactgggtgaggactccaccagtctggtgctggaggattttgaggaggtgtcaggatcagaatcgtttatggattataggagtgatggggagtacatgaggtgaagggagaactaacatgggcacagccaccggctcaggatcctatgtaagtactcagaaggcagccgctgcacattcctgtcaatggctggccttaactcagcttgttagggcaaaaaaaatcattcgtggaacatttcctcttagaggactcacagaaagtggcattaacccaactttgaagatagcaactcactccgggtgcatgcaaggcatgaagggattttaaaaactcattcgttattaacttgattgcattttagaaagtgggctggttgatacgttgagcaggaaggtagattgctgtttttttgcaagtttattctaatagctgaggccacagctggggcttaaggggcttttatttgtggcatgcattttaaaagaaaaagaatgtggcagggttctaattctgattgcttgtctttcctgatacagagcccgtcctggaaagcagttgttatttagcctagactgggcaggcatctctgttaaaactgcatattttaaagaggattgtgattatgagctaatagctcggggaggaaaatgtcctcatcttgctttcctctcacccagtggagaatgtgtttgttgatcacacagacagaggactagatactgctatgattaaatgttactatgatcagataggtatatggcagcctggctttccccagtcacccacacctgtgggaggtaggatgtgcataaatcctggagggcctaacagtgcgtgcaggatttccctcacagaatttccctcccagagagtctacaagaaaggctgtgcccagtggttctgggaaattgctctcatgtttccctggctgccctcataatactgtgatgtttttctctgtaactccacccaaccatgatgtaggcctgaatttcctgaggaaaatcccattgttcccaatttggaaggcgcctcccatggttcttcagaaagcaccaataaattacctgagaaactagcccagtgaggaaggcctccagagtacatgaaatgaatgagtgaatgtttgtctattttgaaaaacaggttatataaatgatgaaagaggccatagagatgactgatgaaaggttagagatttagttttgtagatatggaatttacaatctcctgtgttaccagcatccttagaaccatagttcagctcattctgaggtaattccaaggatcaatctaacaccccagatcactttgttgagttccccgaagtgtgcattgacaactctgatcactcctttccctctgtgcagctgttcgccttcctactcgttcatcctgcatccacgcatgctccttatgtcctatggatccctcttggtccaacttgcccatccacctatacactctctcttcgactcacagcagctctctgttttctcatgttgttcttcctggttttcttctcttttcttggttctatttttctcttctttcttctccaatttcttctcagtccttgattgcctcagtttgatgttctgttcttttttccttttctttcttgagacagggtctcactctgtcactcaggatggagtgcagtggcatgatgtcggctcactgcaatctctacctccaaaagctcaagcgatcctcccatcccagcctcccaagtaacagggattacaggcacatgtcgctgtgcctggataatgtttaatttttaaatttttttgtagagacaaactctccccatgttgcccaggttgttctcgaactcctgggctcaaataatcctcctgccttggtctcccgaagtgttaggattacaggcatgagccaccatgcctggccagtttgctgctcttaagtgtccattttctatgtcttctcagttcatttctccctcttcacttgtctcttgttttcttccattttattgttcatatatttatctctcctattacctccttttttctttttcccaccttttttgccttgctgtatctattcttcctcctaaacaccctgtacccccatcttattagtttttaatcctaactcttccaaagatcagtacttttccctctgcctataaagaaaaccattcaagtgaaggtgtaaaatccccagctttaggaatgttttccaaacatcaggaggcaggcagcatggtaaatgagaaagaggccaggactgggagtccaaagtcctggcttctatgtctggctttgctactaatcaaatatgtgactttttgcaaaccatacctcactaaaccttactttcttcatttgagcgtgttggaccagctgtccccaggaacccccttggattgatctgagaaggcaaggataagtttttcaaaggaagaaaagaggagtagtcagtccgcagtacagtagacacaagccccaggacatctgagtgtctttcagcaagaactctctgtgatatttcactacaatttctctggcaccttgggactctcctcagcccttgtggtggtgggtcttgtttaactagcagttccctccattctatgcctgtgaagaatctatcacctaccatgtgattacagtgcagatttttttttccttttccttttctttttctttctttttttttttttttttgtttgagacggagtctcgctttgtcacccaggctgcagcgcagtggcgcgatctcggctcactgcaagctccgcctcccgggttcaccgccattctcctgcctcagcctcccgagtagctgggactataggcgcccgccaccgtgcctggctaattttttctatttttagtagagacagggtttcaccgtgttagccaggatggtctccatctcctgacgtggtgatccgcccgcctcgggctcccaaagtgctgggattacgggcgtgagccactgcgcccggcctacagtgcggatattttatgagagaggagatcacaactcagtccccaagccctcaacccttaatacatactatcgtatgaaatgcctctttccaaattcagccttttctaaaactcaagatgagaaaactgctgatgaggctcactttctaaaataccggaatttgcaatatagggagaatagtttttcatgtttctttgtttaagcaatagagagaaaggaaacttatgtcgtttacttttcaggccatagaggttttcagaacaacttgaaaacatgatcaaattagccaaacttctgatagttttcaatgtagtctgtgatcatgggataatttagcctcagttctttttctgaaattgtgttttgaatgtttgatttgacttatttaccatcaaacttgctataaggttattactctaatgaataagcatattcccttaattgggagcaatttactattatttctttcataaagtagggcaccattcaccatctatttcctggctctttagttatcaaaatgttaagctcattgctattcatcccggcacagcacttatatgagaggcatgaagctggctgaattctgcatcattaggaatgacacagcctcatcacattgacaccagtgcttgtctctcacaccaatccaaattaagaccaactgaaaatagtcagagtttcctctggagctcctttttgaagagacatatgttttttagtctggtggtacccaaaattgaacaaaaaatgggtgctgcttctcttaataggcaaaactatgctgcaggataatgtattcatgcagggtcttccagccagaccccaaatcatccctcccttcactagaatttttctgtttaattcgatggccactctccacagggatccattctgtgtcttattacaggagatgctcaatgaatgagggacttatcttctagaaatgcagctccgaggtagtctgttgagtgaaataatgaatccattatcacaaaataaattgaaagctgtctgacatttggacaatttttattttgtttcacattgttctgaaaactatactgtttcttttctccctattatttaaataagcaaatgatgaacagattacaaaattgaggacactcgaggtaagggaaggagcccctcgacaggaggatcaggacatagtaccaagggcaagagaaacgattcaataaacactatttactatatattttaggcatggttctaggtaatcacatgataagtagttgaaagaactgaaaatgttttatctgcaagaaaagggcaagtgtaatatcttcaaattttagaaagaatgtaaattagaatttgacttaatttggtgtagttcttgtgggcagaaattgaattgaataggctgaaagttataagaaggattttagctcagtattgatactggattgctcatgggtggtgagagttactcatcactggaagagttcaagcaggggccataagaaatctcagggattttataaggtgattcatgctctgggaaaaggatgccttggattattgtgtcagggtaacttctaactctaggattctgtgtttctaagatctggactctagtcttgccactcacctgccatcaagaacatgttcctcatctgcaggacaggaccaagatggctctgtctaccttaccgggttgctgtgaggcgtgattgtgataaaatacataaaggcagtttttaagctctgaagcactagttaaatgtgtagcgtattttaagattctgttgtatgtacaattgtttagcagtctctctctctttctttctctttcttttatcagagatagatgattttccctcttatttccaccagtttggcttttcagggaaggtggcagctggcagaatcccctgacaacaaaaggtacagcaaaaagtggaggcctaaagaaaacatgtgctagctctttagcccctgaatagctaagtcacatgtcagcctgctctccttcatctgtttgggaggaggcagattagagtcacactgtcatcatgctcttcccctcagaagcagctgtaaggtttttggtagctgtcagtgctagcaaacagtgcttttctcacagaactactggaaagagtcctggctcggaaaacttgctcttgaaagtggcacggccagagcaggggtctctagagggtcgtgccacctctacctgccacaggttccattgtcggtcaggtaagttagaggcagcagttccccacctgccctctggataacagcagcctggggctgctcctgagtcatgtttccacttctgtcttacaggcctcattttcctacccatctttctgtaaaaatgaaagtcaggagtcttatgaaacttaccattattcaatacaggcttttggtttttttctttaaattagatagggttaggtaagaagtagagttctatagaacgttcataggaagcaacaaaagttgatctcttggtctctacaataggagaggattgggctagataccttcaaagctgacttgccctaatattctagtatgaaatgattcgaaggtacacctgcccctatcatgtcaggcagtgagtacagttaaaacattgggaattggtaaaggaaagaaaaaaactgaaaagaaccctttgaagttagacaaactgtccagagacatagtgctaaaatcctccctctttttctttccacagcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcct

SEQ ID NO: 38552 - DNA, 69579 bp, Homo sapiens
gcgcatgcgccttcctgggacccacggcaggcgcgaatcccagcggccggcgggcggcggggtaagagcatgggatcccggaggttccggaccccaggccagtgtggggaggtgccgggggctcggacgcgccacgagccggcgcagagctggcgacccgtctcccagctccgctccactcccagggacgcgacgcgaggcctccccagcccttcctgcagggtcgcttgtgggtcgggtgaggggacgcggtgatagtggtggcacttgcaggctggggcggtcctggcacccttgtccttgcggttctgagggcctggccctcaagaggaggggcggagaaacgcgagaagggatccctttcgccccatatacacgcccgggatagctgcactccccggtgttgtgtccactgcggtggaaggacctttcagactaaaaggagcaaagtcggttctgggatggggacggcgggcttggcatttgtcgagatgcaccgtcagggcaaaggaggacgaaaagcgcatctactgcctgcctagcaacttcgtggccagtggatgggttagaaaattactgttttctgatttacaggtggaaaaagtcgcaaataaccctttttctggtttaagcagaagagagtcgttaaaagcctcgcataatatctttaaccacacagggctcagtaaaattagggtacctccccgcttcgtacacacagacgcacacagctccattcagcaaatacttcttgggtacctgccttctgctaacactgttctacaagtggggaacagagagcaacgactaagacaggaggatccctgctcacagggagcctttagtcaacacatccaagtaatttccttttacactttttttttttttaattgagacagagtcttgctctgtcgcccaggctggagtgcagtggcacgatcttggctcactgcaacctctgcctcccgggttcgagcgattttcctgcctcagcctcacgagtagctgggattacaggaacgcaccaccacgcccagctaatttttgtatttttagtagagatggggtttcaccatgttgaccaggctggtctcgaactcctgacctcaggtgatccacctgcctcggcctcccaaagtgctgggattacaggggtgaaccactgcgcccagccccttttatgctttttaaattggaatataccatatagaaaaatactgtacgcaaattataagttgtaacttgttaatttatcctaaagtcaacacatttcctaaccactactcaaatcaagaaggaagattcacagcatttcagaacacctctctgggcacccctcccaaccaccatcccttctttcctccccaaaggtaacctctttcctgatttttaacaccatagattagttttgcctatttatgaacctttcatggaaccatatgatatgtattctttggtgtccagcatttatactgaaaattatgtgtgtgagattgcaccatgtcatgtgaaaatacaaatcctgttagtgaaaagaattaggaagcaaattgaaggtaatgatacaaacagtaaggggaggaagctttagtaggatagtcagggatgatctttctgaggggatgatttgagatttggcatcaatgacaaaagattagccattccaatcagttctggagttatcccgtgatgtttttattttaaataagaaaataattagggccgggtgcagtggctcacgcctgtaatcccagcactttgggagaccaaggagggtggatcacctgaggtcaggagttcaagatcagcctggccaatctggtgaaaccccgtctctactaacaatacaaaaattagccaggcgtggtggtgggtgcctgtaatcccaactacctgggaggctgagggaagacaatcgcttgaacccaggaggcagaggttgcggtgagccgatattgtgccattgtactccagcctgggcaacaagagcaaagctccatctcaaaaaaaaagaaaaaaaaacaaataaaataaaataattttagatcattaggtggaatgtaccaattttgccctaaattttttagttgatttattatattttctgaatatatttaaagtgtatcctgtggttaaaatggtccaacatttttcaaagagaagaggaaaatgtcaattttgtcgatttgctttttatttttttttgtttgagatggagtttcgctcttgttgcccaggctggagtgcaatggtgcgatctcggctcactgcaaccttcacctcctgggttgaagcgattctcctgcctcagccttccaaatagctgggatcacaggcgagcgccaccatacctggctaattttgtatttttagtagagatggggtttcaccatgttggtcaggctggtcttgaactcctgacctcaggtgatctgcccacctcggcttcccaaagtgctgggattacaggcgtgagccaccgcaaccggcatcaatttgcttcttactttaaaaccccaacctaaggaaaactgtaaaaaaaaaaaaaaagtaagtggttaattgagttttactgcttttgtatttttttctcacgatttgggattattcttaatgattcttaaaaaggctcatttctctaagatggaaagttggtgtggttaatgcaagtatattttggaagaaaagtaaaaaccaaactagataaattgtttattggaagactttcccaaactaaatacaaagacaagattcctctttctcgctgtaccaaagataaatcatgcctttgtctacggttgtggttttatatttacctgtaggtgaatgtgttctaaatagaattgactgtgtcattatctacatatgtgttgtttttcttttctcagaaatattcccttgtgagagtaaatctttactatatctttagatgtattgagtcccatttaatagggagatccaccttttgatgtatattcccaactaaaggactagggaataaggaacttaaaataccacgtttccttcacattccttcccactacccctcccctcgaattctctatccttctacttggtttactgggttcattgttgtaggtactgtactcagctgaatcttgatatctttttttttccccttaggatacttctacatagacataatcaagttttgactatttggaaaccaagcatcattaaaattctctcaaactcctaattgcgaagaatcgataacatttcaagaagtgataacatttctctgaacaagaaaagaagtgattgaccacgttttaaaagtactctggcactggtgctgtgttttcttcccctccctaaatttgaagaactatggagaaatggtacttgatgacagtagtggttttaataggactaacagtacgatggacagtgtctcttaattcttattcaggtaatacatttttactggttaaaaaaaaaacgaaattttcctttgaataggtgtttgtttggggaaaagtttaccattttctgaccagtacagagaagaatttcaggcctttttgatatggttgagaaaatacatttaaatgtccagttctaatagaaagaatatggataacagctaaatagaagcatgcgctttgtgatgtgagaaagcaaaaatgtgttctaacaggtaagatgacaaattgagaaatgattctgtattaaacattgaagaggaaaatgagctagcacttcaagggaggggtggagtctgtttagggtagagaagcatattactggattaaagggaagcgatcagtgaacaagaataaaattgggaatgagagagggggaattgatggagtgtggtcctggtgtgttggattggcttaaatgtaactctgcaggtacctatttagcacgtctcatgttcccggcactgtgctagcttctaaaaatacaagatgaatagccaatactcagagggcccacattttattttattttattttattttatttttttgatacggagcctcgctgtgtcgcccaggctggagttcagtggcgcaatcttggctcactgtgacctctgcctcccgggttcaagcaattcttctacctcaaccttccgagtagctgggattacagatgcacgcgaccatgcccagctaatttttgcatttttagtagagacggggtttcaccatgctggccaggctggtgtcgaactcctgacctcgtgatccacttgcctcggcctcccaaagtgctgggattacaggcgtgagccaccgcacccagctagagggcccacattttaatagttaaatggtcacaacagagggtgataattataatgtaggagtatgtgtgaggtacagagttaatagagaggtaaatgatcaagatgcattagagaaaacttcaggaaagatgtttgcattcaagatttgaaggatgagtcagaattttctaggcaaatgaagtggagaaggtattatagagtgcaggaacttgtgcaacagacatggtgtcacagagcatggttattataagtattgtatttgagttgcatgaaacataggaacaaaaaggatgaggagagagtgaccagagaataggttatacaattagctgggcaaattatttcgttgtagaaaaataacttatgttagtgaaaaagggtcataggaaaaagagataggtaaagagaaaaatgagacaataatattaatagttgtaagagctatgatatatacacagacacatatatatacacagacacacatttactctctacttacacatttactatatacgaagatacatatatggaaatttatatatatgtgtgtctatatagtaaatgtgtatatacacagacacacacatatataggtattttatgcatacctatatatgtgtgtgtctgtatatagtaaatgtatatatacacagacatatatatggatatacacagacacacatatatataaatatctgtatatatgtgtgtatatagcaaatgtgtatgtagagaataaatgtgtatgtgtctgtgtatatcgtagcttttttttgagaaaaaaaagctctgtcacccaggctggagtgcagtggcgcaatcttggctcactgtaatctccgcctcccagtttcaagctattctcctgcctcagcctcctaagtagctgggattacaggtgcatgccatcatgcccagctaatttttgtatttttagtagagacgaggtttcaccatgttggtcaggctggtcttgaactcctgacctcgtgatctgcctgcctcggcctcctgaagtgctgggattacaggcatgagccaccgtgcctggcctgtagctcttacatatagatgtatacacacacacatacatatatgttttgtaagacttttttttttggagacagggtttcactttcatcgtccaggctaaagtgcagtggcacaatgttggctcatggcagcctccgcctccttggtgcagtgattctgctgcctcagcctaccaagtagctggaaatacaggcgtgcaccacgacgcctggctaatttttgtattttttgtagacacagggtctcaccatgttgcccaggctggtcttgaactcctgagctcaagtgatctgcctgccccagcctcccaaagtgctgggattacaggtgtgagccactatgtccagtcaatattttaaccagactatagtttctcttttctcttaaaacatttttttttggggggaggctaaggtgggtggattgcctgagctcaggagttcaagaccagcctgagcaacatggcaaaaccccgtctctattaaaaatacaaaaattagccgggcgcacacctgtaatcccagctgctggggaggctgaggcacgagaattgcttaagcccaggagatggaggttgcagtgagccaagatcatcccattacactttagcctgggcgacagagcaagactctgcctcaaaaaaaaacaaaacaacacacttttttgggctatttttatttttcaatttaatttaatttacattttttttttttttttttttgagacagggtctccccctgttgcccaggctggagtgcagtggcatgatcttggctcactgcagccttgacctcttgggaccacaggcatgtggctaattgtctggctaattgttttgatttttagtaaagatgaggtctcactgtgttgcctaggctggtcttgaactcctgggctcgagcaatactcctgcctcagcctcccaaagtactgggattataggtgtgagccactgcgcccaattttttcaaatactctggcttaatatagtttctctttattcagcatgaatttaaaggatttatagaaagaacttgtaagaactactatattttgagtatgagtattttctttagtatttaccacaaccactgaagacaggtaatatcttcgatttacaaatggaaaatgagacaaccaataaatgacaactgggattcaaatatagttgtatttaattccacaatcagtgctcttatgactgtgctctgtggcttctgaatgagttcgaggaatatggaggaagtaaaatcacttaaatgtagcagttgacttgggctcaaatcttagctctttcacctgttagttgcctgatcttggggaatttatttaatctccttgagcctcttctatcaagtggggtattaatacatactttaagagggttcttggccgggccgtggctcacgcctgtaatcccagcactttgggaggccgaagtgggccgatcacatgaggtcaggagttcgagaccagcgtggccaacacagtgaaaccccgtctctactaaaaatacaaaaattagccgggtgtggtggcgggtgcctgtagtcccagctattccggaggatgaggcacgagaattgcttgaacctggaaggcagaggttgcagtgagccgagatcacgccactgcaccccaccctgggtgacagagcaagactctgtctccaaaaaaaaaaaaggattcttgtgaggattgagataatatgtataaattatgttttcttttttaatagtgcagggctataactagcacatttatagttcataactcatctcatttgatcctcacatcagatcatttagccctaaaatgtctgctatgcaggaaaaataggtcttgctggtgattaagtctttaggcctggtctttagggtgaccaagaataataaatggtatcttccttagagaagtttacagtctagtggataaggtggacatgtaaatacatactacataaaaatgtaggctgagcacagtggctcatgcttgtaattctagcgctttgggaggctgaggcagggggatcacttgaggtcaggagttccagaccagcctagccaacatggtgaaaccccctttacaaaaagaaaaattaggcatgatggcacatgcctgtagtcctagctactcgggcctctgaggtgggtggattgcttgaacccgggaggcggaggttgcagtgagccagagatggtgccactgcacttcagcctgggtgacagagggagactccattaaaaaaaaaatgtagtgtgatataggcaaatactttgtttcttttctttttcttttttctccctagactgagtcttgctctgttgcccaggctggagggcaatggtgcaatctcggctcactacaatatccgtttcctgggttcaagcaattctcctgcctcagcttcccgagtagctgggatttacaggcatgtgccaccacccccggcatttttttttttttttttttttttttttccagtagagacaggatttccccatgtttgccagcctggtctcaaactcctgaccttaggtgatccgccctccttggcctcccaaagtgctgggattacaggcgtgagccaccacgcctggcccatttcttttacttccttaaaatgcctttgtcaggtttgatatcaaggttaagctagcctcataaaatgaattagggagtattctctctttttgtaaaatctggaatagtatgtaagcttggaattgtttgttccttagatacttggtagaacttgatagtaaaggtatttgggcctggaattttctttgtaaggaaaatgtttagtgatttaatttgtttattggttataggaccatttaggctctctcttttttctcgaattatttttgtaatttatatttttctagaaatgtttccatttcacctaagttttaaaatgtattgacataaaattattcataatgttttcttaccttttacattttctgctgtatcaatgattatagttccttttttatttcttatatagttagtggtgtttcattttttaaaacaatcagtcttattaggggtttattaattttattagtacagtcatgcattgtttaatgatggggattcattctgagaaatgcgtcaattggcagtttagtcattgttcaaccattgtagagtgacttacaccaactcagattgtacagcctactacacctaggctgtacattatagcctattgctcctaggctacaaacctatacaacatgttactgtactgaatactgtaggcagttgtagcacatggtaagtatttgtgtatttaaacatatctaaacatagataaggtgcagttaaaatacagtatgattatcttatgggaccatcattgtttatacagttcgttgttgactgagatgtcattattgtggtacatagccgtatttttcaaataactaatctgagctttgcccattctctcagtgatatccttggggttgttcttttttaaatttactaaattggatgctttagctcttaagtttcagtctctgtaacactatcatttaagctatacattttctttagagtaccatcccacaagtaatattttctaatttctaatgtgacatctactttgacccatgagttatttagaattatgtttaaaattttttaaatatttaggctttaaaaattacctttttgatattttaaatttaagtagatggtagaaagagaatctttctgtgtactactaattctttgaaaagcattgaaacttgacctagtatgtaatcagcttttgtaaatgttctgtgtgtgcttgaaaagaatgtgtaatctctagtttaatattctgcatatattcaataacccaatattattgttttgatacaatcgttttttatattcttactgatattttaccaattgatctaccagttattaagagagctgtagtttctctttgtagttttgtcaacttgtatgtatatattttgtatctatattactaggtgatttagaattgtttttcttttttttttgagatggaatctcactctgttgcccaggctggacggcacaatctcagcttactgcaacctctgcctcccgggttcaagggattctcctgcctcagcctccctagtggctgggattacaggcgtgcgctgccacacccagctaatttttgcatttttagtagagacggggtttcaccatgttggccaggctggtcttgaactcctgatctcaggtgatccaccacctcggcctcccaaagtggtggtattaacaggtagaatttttttgtgtgtgacctgaatttcatatcactgttgcttccctgtttgtttacagtaatgcttttttgttaaagtttgtttcctctaaaattaatatagccataatagttttctttagtttgatttttgcttgttatatctttttctgtccttttattctttactgtatgtttagatatgtctaagcaatttccttccgcaattgctgtttcccttctctattggtttgaaagctatatttttattttcttctttcaggacttatctggaaattttcagttgcatatttaacttaacaaagcctaaagttaatatttatatcctcttgaacaatgcaaagactttagaatgttttaattctggttacagatcctcacttcccaagttaaaatgttactgtctaggattttgtttcttccatgatttttaatcctataaattaggcattaatgacttgttttgtacagttaatattggtttattatttattatttatttatttttagagatgggatctcactctattgcccaagctcaagtacagtggcatgaccatagttcattgcagccttgacttcctgggctcagaggatcctcctgctccagcctccccagtagctggaactacaggtgcttgccaccacacccagctaaatatatgtttttttatttttagtagacataaggtcctgctgtgttgcccaagctgggctcaaactcctgggctcaagggggatcctcccaccttggcctcccgaagtgctgggatgacaggttgtgagccactgtgccctgcatatttatttagttttacccttgtgtttagcattttctgttcacccttcttacatattgtatctttctttgagatcatttttttcttcctgaagtacacctttgggagttttttttggtgagagtctgttggtggcaaacccagtttttgtctgaaaatgcctttatttggctttcagtcttaaagttttgctgggtatggaattgttttgatggttgttttctcttagtattttgaaaataccattgtcttttaatttgtgttgatgtttggacatcagctgtcattttaactgttattcttttgtaggtaatttgcctttcctttcttgctgcagtttcactatgatatatcttagtgaatattaaaacatttgtcatcctaggattttctgtgatttctgtctctaaggaatggtattttctgtctgttctagaaacttttcagctactgtgtcttcttatttttcttccttttagaactctgattagatatatgttggatctttggttaggaattccacagatagtataggccattcactatgtgccaagggctggtgatgctgcagagaataaaatagacaataatctcttcccctcattgactttatagttctcagttatctcttcaaatattgtatcttcctcatttttattcttgtacaactcttgttagatgtatgttgggtcttttcattctgtcttctgtgtttcataatctcttgtattttccatctcggggtttcttcacagtgcttcctttataatcatcaaatttggtttcctgttcattagtttttagctgtgcttaatttgtttgttttttttttttaactccccattgaatgttaaggtttcagttattatattttttatttccagaagttctctttggttcctttttagatcttgatcatttctgatagtctcttgttccttcagcatactttcaaggtcttcttttgtattgttaagcagttgaaccatgcttattttatgtttcttatctaaaaattctcgtatctgcattctgatttcatagttttttgtttctcctgacccttgctcatggtattttgtttcttcatgagcttagtgatttttaataaaatagtgagtttatgtaatttggaacttttatctgtgggaattctttgaggcttgagtttcctgtgcatttttccacatagggtttatgttgcttcctggtaggcacctggggcactattaacaaaaatcaaactaaattagcaacttaaagtttctttgggtcatgtacttggtgtgaattcaggccccaacctgggcaaatgcaggcatatggttaggagttttcataggactctttttcgtttttcctgtactaccaggagccaaggccgagatgagtactatcttcactatctccctaaaggcattgtattttaaattgtagtagagggttctctgaccttgaattcctacctgttcaggtcccaggctttgcctccttactgactgcacagggctcctggtagccaggctattgaccaccagagatcattggataccctcaaggcaaatgcttacttctctgaatctacactttgctgttgtttctggggcctctaaggaattctttcatgttactgctagttcagccatatattaaaattatatatttataaaagtaggatacgtaatactatattattaattatataaaaacaaatataaatcatacattatatataaaacatatataaaacattatattatatacattatttattcaatgttaactaggatttttactggagatgtttttggaccctttgtctggcatattgctggaaaccgaagtgccatctatatttttaaaagctccataagttattctagtgtttacagagggttaatagacatgatggttgaagccaggggttgaggggcaaaagcaacaggtttaagagttgcttttgcccctcaacaaaagcaacttttgtgcaagaagaaaacagatttaaccactaatcatctccagagagaagggagaatgattaaaggagactgagaagaaactgtgtagtaggcttagcatctggagagtttgtttttctagaagccaagaaaccagacaactttacaaaatgaggaccggccaacagtgtcaagctatagacatgtcaaaaaggatgaaaatttaaaatagacaagggatctataggagaccatgtgaacctcctggttgccagactgtaatgaactgaggactgaatggtagttatcaaatggacatagcaactttcaggacgtttgttcgtgaacggaagaaaggaagtagtttggtggctgaagtgggggaagaagggctgaggaaaggtccaattagaagttgttacataaaatatgtaacttataatattacttttagtccataattggtccattggaaagtcatccccttttctgaatttggtactaattcatggtgattatttagtttgcaatcttttttccagttttccttttgtctcctaattgtgacacatatattattttctcgtttattttaaggtgaagttgaaaagaactaaaatcagagtataggataaaatactacaaatttttaaatgatactatttcagtattgctggtatatataatcaaatgcttaatgggaattcaggaggggacaattcatccaatacttctctattcctgtgacttacatatattacttaacctgacatttctttcatgaactgaatttactcaattacttttctcatctggaaaagaaaacaggactccagctacttattttaaaccctgctcttaaattgtccctaggaaaatcaacagaatcagattccttttgggttactatataagaaaaatattgttattgcacattagtagattatttgaaggcatcttgtagatggctatgatatatttttgtcatttttcagataaggaaagtaaatatgctaaacattaagaaaaatggtggctgggcccagtggctcacacctgtaatcccagcactttgagaggccgaggcaggtggattgcttgagcccaaaagtttgagtccagcctgggcaatacggggaaaccttgtctttataaaaaatacaaaaattggccaggcgcggtggctcacgcctgtaatcccagcactttgggaggccgaggcaggcggatcatgaggtcaggagatcaagaccatcctggctaacacggtgaaaccccgtctctactaaaaatacaaaaaattagctgtgcgtggtggcgggcgcctgtagtcccagctactagggaggctgaggcaggagaatggcatgaacccaggaggcggagcttgcagtgagctgagatctcaccactgcactccagcctgggcgacagagcgagaccgtctcaaaagacaaaaacaaatacaaaaacaaaaacaaaaccccaaaattaggtgggcatggtggcgcatgcctgtagtcccagctactgatagtgggggctgaggggggatcccttgagcccagaaggtcaaggccgcagtgagccgtgatcacaccactggactccagcctgggtgacagaacaagaccctgtttaaaagaaaagaaaagaaggaagggaggggaggggaggggaggggagaggattccattatagaactcaactccatcataaagaatataacatttttagcattcacgtgtgagggacttaatgtgtcattggaggttgggagaattaatgaataacatctgtgattctgctgagatattgttccttctgttgattaaaatactatttttggtatcctaatttgtattgttttgtttttaagaagtgagttttcactatgttgcccaagctgcagtagagtgactatttacaggatgtgatcatcaggcactgtaaccttgggctcctggcctcaagtggtcctcccacctagcctcccaatagaaatgcatcatttttatgtattgtaaaatatctcagcttgtaccactgctcccagctcataatttctttttttgttgttttttaaaagtttttttgcttttaatttgtatgggtacatagtagatgtacatattcatgggtcacatgagattttttttttaaaaattttatttatatttttattattttaaatttttattttattattattttttgaaatggagtcttgctgtgtcgcccagagtggagtgcagtggtgccatctcgacttactgcaacctctgcctccccggttcaagcaattcttctgtctcagcctcccaggtagctgggactacaagcatgagccaccacgcccagctaattttttgtatttttagtatagatggggttttaccatgttgaccagactggtctcgaactcctgacttcaagtgatctgcccgcctcagcgcccagctgattatttattatttattatttttttgagacaagagcctcgctctgtcacccaggctggagtgcagtggtacggccttggctcattgcaactctgcctcccgagttcaagcagttctcctgcctcagcctcctgagtagctaggattataggcacgtgccaccatgcctggctaagtttttttttgtttgtttttttttgtttttttttttttgttttttttttttttgagacggagtctggctctgtcgcccaggctggagtgcagtagcgcgatctcggctcactgcaagctctgcctcccgggttcatgccattctcctgcctcagcctcccgagtagctgggactacaggtgcctgccaccacacccagctcatttttttgtatttttattagagacagggtttcaccatgttagccaggatggtctcgagctcctgacctcatgatccgcccgtctcggcctcccaaagtgctgggattacaggcgtgagccaccgcacctggcctaagtttttgtatttttagcagagtcggggttttaccatgttggccaggctggtctcaaactcctgacctcaggagatccacctgccttggcctcccaaagtgcagggattacaggcgtgagccaccatgcccagcctatttttatttttttgagatagagtctcgctccattgccctgtgctccagcacaggctggagtgcagttgtgaaatcttagctcactgtagcctctgtctctgggttcaagtgattctcctgcctcagcctcccaagtagctgggattacaggtgctcaccaccatgcctagctaattttttttgtatttttagtagagatggggtttcatcatgttgtccaggctggtcttgaactcctggcgatctgcccaccttggcctcccaaagtgctaggattacaggcatgaggtaccgtgcctggccattattttattttttagatacagtatctcactatgtcacccaggctggagtacagtggtgccatcatggttcactgcagccttgatcccctgggctcaagtgatcctcctacctcagccttacaggtagccaggactataggcacataccactgcacctggctaacatgaaatgttttgatacaagcatacaatgtgtaataatcacattagggtaaatgaggtattcattacctcaagcatttattctttgtattataaacattccatttatactttcagttatttaaaaatggtaaaataaattattgttgactgcagtcaccctgttgagctatcaaatactagatcttattcattccgtgtaattatatttttgaatccattaatcttccctaccccacccactcttctcagcctctggtaaccataattctgttcttcatctccaagagttcaattgtttcaatttttagctcccactaatgagtgagaatattgaaagtttgtctttctgtgcctggcttgtttcacttaacatcatgacctccagttccagctatgttgttgcaagtgacaggatctcattcttttttatggctgaatccattgcatatacattttatttattcattcgtctgctgatggacacttaggttgcttgcgaatcttggctattgtgaacggtgctgcaataaacataagagtggagctatcttttcaatatatggatttcctttattgcctgtcgtttggataaaagccattttacctgggtgagatgatgtctcattgtagttttgatttgcatttctctgatcatcagtgatgttgagcactttttcatattcctgtttgccatttgtatgtcttcttttgaaaaatgtgtattcagatcttttgcccattttttaattgggttatttaattttttttcctattgagttgcttgaattccttatatattctggttgttaatcccttgtcagatgggtagtttgcgcatattttctcccattctgtgggttctgtctttgttgattgcttcctttgctgtgcagaagcttttaaacttcatggatcccatttgcccgtttttgctttggttgcttgtgcttgtagagtattactcaagaaatttttgcccagaccaatgtcctagagagtttccccagtgttttcttggagcagtttcatagtgtgaggtcgtatatttaagtctttaatccattttgatttgatttttgtatctgatgagagataggggtttagtttcattttctgcatatagatatccaattttcccccaaagagactctcttttccccagtgtatgttcttggcacctttgtcaaaaatgagttcactgtagatgtgtgtatttgtttctgggttctctattctgttccatggtctaggtatctgtttttatgccagtaccatgctgttttggttactgtagctctgtagtaaaattgaagtcagtgtaatgtaattcctccagttttgttctttttgcttaggatagttttgactatttggggtcttttgtggttccatataaattttaggattattttttctatttctgtgaggaatatcattggtagtttgatggagattgcattgaatctgtagattgctttgggtagaatggacatttaatgatattgattcttccaatccatgaacatggaatattttcccatttttttgaatttctttcatcagtgttctatagttttttattaagatcttttacttcttctttttttttttttttttttttttttttttttttgagacagagtctcgctctgtcacccaggctggagtgcaatggcatgatcttggctcacggcaacctctacctcccaggttaaagcaattctcctgcctcagtctcctgagtagctgggattataggcgcatgccaccatgcccgacaaatttttgtattatttttatttttttttagtagaaacggggtttcaccatgttggccaggctggtcttgaactcctgaccttgtgatctgcccatctcagcctcccaaagtgctggcattacaggcgtgagccaccacgcccggccttgagccactgtgcttggcctgatcttttattctttagttaattcctaggtatttaattttatttgtggctattgtaaatgagatttttcaaatttctttttcaaattgttcaccattggcatacagaagtactagtgatttttgtatgttgattttttatgctgtgactttactgagtttgttttacagttctaatagtttttttatggtgttttaaggtttttccaaatataaaattatatcatctgcaaacaaggataatttgacttcttcctttccagtttgggtgacctttatttctttctcttgtctgattgcgctagctaagactaacagcactatgttgaataacagttgtgaaagtgggcattcttttgttccaaatcttagaggaaaggctttcagtttttccccattcagtatgatactagctgtgggtctgtcatgtatggcttttattgtgttgaggtatgttttttctaaactcaattttttgagggtttgtgtcaggaaggggtgtggaattgtatcagatactttttcagcatcaaccaaaatggtcatatggtttctgtccttcattgtgttgatttgatgtaccacattgattgatttgcatatgttgagccattcttgcatccgtgggatttatctgtagggttatggtgaatgatctttttaatgcactgttgattacagtttgctagtattttgttgtggatttttgcatcaatgttcatcagggatattggcttgtagtttttttttctttttttaatatgtctttctctggtgttgttattaggagtactgggctcgtagaatgagtttggaagtattctctctattttttggaatagtttgaataggactgatattaggatttttctttaaatgtttagtgaaattcaacagtgatgccatcaggttctaggcttttctttgctgggagacttttaattactgctttgatgtcattgcttgttattgatctgttcaggttttggatttcttcctggttcagtcttggtaggttgtacgtgtctaggaatttatcagtttcttctaggctgtccagttttttggcatataattgctcatagtagtctctggtgatcctttgaatttctgcagtattggttgtaatgtctcctctttaatctctgattttatttatttaagtcttctttctttttttcctagtctggctaaaagtgtctcaattttgtttatcttttcgaaaaccaactttttgttttgttgatctttcaacttcgtttatttctgctctgatctttactatttcttctactaattttctgtttattttgctgtagcttttctagttctttaagatgtatcattaggttgtttatttgaagtttttctacttttttgacataggcacttattgctataaactttcctcttagtactactttcatgtatcccataggttttggtatgttgtgtttccattttcatttgtttgaagaaatttttaaattttcttcttaatttcttcgttggcacactgggcattcaggatcatattgattaatttccatgtgtttgcactgtttccaaaattcctcttgttattgatttctagttttattccattgtggttagaaaggatacctgatatgatatcagtgttttgaattttttaagacttgtttgtggtctatcgtatggtctatctgtgtgccaaggagaagaatgtgtatattctctagccattggatgaaatgttgtataaatatctgataggtccacttagtttacactgcagattaagtctgatgtttctttgttgattttctgtctggatgatttgtccagtgctgaaattgacatctctagctattaccctattggagacactctctttagctctaataatatttgttttatatatctaggtgctccagtgctggatgcatatatatttaccattgttatatctcttgctgaattgacccgtttgtcattatataatgaccttctttgtctttctctttttttttttttttttttttttttttgagacagagtcttgctctgttgcccaggctggagtgcagtggtgtgatctcggctcactgcaacctcctgcctccagagttcaagtgattctcctgcctcagcctcccaagtagtgggactacaggtgtgcaccaccacgcccagctaatttttgtatttttagaaaagacgaggttttgccgtgttggccaggctggtcttgaactcctgacctcaggcaatccgcctgcctcagcctgccaaagtactgggattagaggtgtgagccaccgtgcccagcttctttgtctctttttatagcttttgtcttgaaatctgttttgtctgatgtaagtatggctactcctgctctttttggtttccatttgcatggaatatctttttccatccttttattttcagtctatgtgtgtctttataaatgaagtatgtttcttgtaggcaacagactgttcaagcgattctcttgcctcagcctgtggagtagctgtgattacaggtgcacgccaccatgcccggctattttttttgtatttttagtagagacgagttttcaccatgttggccacgctggtctcaaacttctgacctcaagtgatctgcccaccttggcctcccaaagtgctgggattacaggcatgagccaccgcgcctggcctaagtgaggtgatcttggctcactggaacctccgccttccagactcaggttgtcctttcacctcagcctcccaagtagctgagactacaggcacatgccaccatgcccagctaattttttgtatttttgtagagatgggggtttggccatgttccccaggctggcaaataacatcttataactcattattttaagctaatgattacttaatactgattgtaaaaactaacaaataagcaaagagaaaattaacaaaaactctacactttattcccctgctttttaactttttattgtttctatttatattttattctgtgtcttgaaaagttatggttattatttttgataggttcatcttttagtctttctactcaagatatgggtagtttacaaaccttaatgacagtgttaaaatactttgtgtacttactattaccagtgagttttgtaccttcagatgatttcttattgcttattaatgcccttttctttctggttgaagaactccctttagcatttcttgcaggataggtctagtgttgatgaaatccctcagcgtttttgtctgggaaaatctttatatctccttcatgtttgacaggtatttttgctggatatactattctaggataaaagctttttttttccttcagtactttaaatatgttgtgccattctcttctggcctgtgtggctttctactgagaagtctgctgccagatgtattggaactcctttgtatgctgtttctttcttcttgctgcttttaggattctttctttatccttaacctttgggagtttgactgttaaaaagtcttgaggtagtcttatttgcattaaatctgcttggtgttctataaccttcttgtacttgaatattggtatctttctctaggtttggaatgttctcagttattatccctttgaataaactttctaccctgatctctctctctctctctattacctctttaaggccagaagctcttagatttgtccatttgaggctatcttatagatcttctaggcatgcttcttttgtcattcttatttttctttagtttccactgactgtgtattttcaaatagcctgcctttgagcttactaattctttcttttgcttgatcaattctgctgttgagagactctgatgcattccacagtatgtcaattgaattttttagcaccagaatttctgcttgattttaacaaattatttccatctctgttaaggatagaattctaaattccttctctgttatatcttgaattttttgagtttcttcaaaacagttattttgaatgctctgtttgaaaggtcacatacctctatcactctgagattggttgctggtgccttattaagttcctttggtgaggtcctgtttttctggatggtcttaatgcttgtggatattcatctggatattgataagttaggtatttattgtagtcttcacagtctgggcttatttatacccatccttcttgggaaggctttccaagtattcaaagggagttgagtgttgtcatccatggtcgctgcagccatatttgcattagggggcaacccaagcccagttacactgtgactcttgcaggctcatagaggtaccactttgatggtcttgggtaacaaatctgagagaattctttggattaccagacaaagactcttgttcttttcccttactttcccccaaagaaatggagtctgtctctccatgttgagctgatgggagctggaggaggggtgacaaaagtacccgtgtggccatcacattgggactgtgctacatcagacctgaagctagcacagcactgggtcttacccaaggcctgcggcagtcactgcctgattcctgccgatgttcactcaaggcccaagggttcttcatcagcaggtattgaatccagccaggcttatgccctttccttagggtggcagcttccccagtccacagcctatgttgggtcagaaatgctgtctgggagccaaggcctggagttaggaaccttaatcaggagccaggcctggaatccgggactccaggagtctgcctggtgctgtgctccactgtggcctgaagctagggcctggaatgtgggcctcaggactctgcctggtaccttattttgctgtggcagagctggtatttaagttgcaagacaaagtcctcttttactctccagtctcctttccttaagcagaaggcatccttaagccatactgcctggggttgagggaggggtgatgcaagcactcccttggctgccttagctggtgtcttactaggtcatgtgcacccccagtccactgcgtctgagtccaacacagcaccaggacttgcctaggaagtccttgtggtctaaactgcctttcaaatttatttaagaccccagagtgctttagcctacagtggtgtgcctatctggaactcaggttcctactgctgggatggaccattcccttctggctaggactagcctaaatgctccctccataggtaccagctgaattctgccctgtgttgctttctgctgtgacaagcaagactgagttccagtgcagagtcccatagtcactgcactctccctccccaaacacacagattctctcttcatgccatgcagctgctgctggggaatggagaagtgatgttgacaattcaatactgtctttcttaccctcttcagtgcctctttccttgatatgatattaaaaccaggtactgtgattgctcaactgattttgattcttatgaaggtactttcttgtggggatagctgttgaatttggtgttcctgccagggggacagttgctggagggttctatttggccatcctgctctgcctcctctgtcatagtttgttttttaatatgcttattttagtttgcttttggtttatcttgttttaagattgtaattaagaagcacttacaggagaggaaaaatacattttccttctgtccttctaggttctctaatgtgcccgtgtaacaaaagacagattaacaagacaaaaacataacgcatttattgaatataagtttgaaaccttcagaaggaaatgaagacccgaagaaacagttaaacctgagtgtttttatactaactttgatgaagaggggagagttgtagaaaatgtgataggacaatagagtatgagtcaagagtagtaaacgggaaacttggcaaaacctgttcattttggttcctctgggtatccttttacctttggagataaagatgcttcttttctctgggtatagggagggcacctctcacatgaggattttatgatctgcttcaggggatggtcagttcttcctgcacctgcccttcctcagattcctttagcttaaaatattcaatatgccaaggtgccagattttgaagttgaatgttcagaactccatcacactcaagtgtggaaactcaggttagcttgcttagtattaatgcattattcctcctttggaaatgtatgtattatttaggaaaatggcttatgtatattattgtaatttgattttttctgaaatgtctatcccttacgcttttagagatgcttatatacattaattttcagagacctaaaaatattgaataaatactgtttgttgcttttaaacaatccatggggagtagaaaaattttgattttagtattgattgtttaccgtttcttgtagagattcacagttcctctatacttgatccaaagtgttaccagtgtctttaaggcaaatggcaacacttgagctggggaaagttattttattttaataactttttttttccccaaagctgcattggctgtttgatgagaaagttgtagagaatcagtttttgtagcacatcattactaaagtatgactgtgttccatttaactgcttagtttctttctacttacccattgctatggaaaatataaaaggatgattttttttttttttcttcagacaagtcttgctctgtcacccaggctggagtgcaatggcatgatctcggctcactgcaacctctgcctcccaggttcagttgattcttctgcctcagcctcccaagtagctgggattacaggcatgtgccaccacacccaattaatttttgtatttttagtagagacggggtttcaccatgttggtcaggctggtcttgaactcctgaactcaggtgatctgcccaccttggcctcccaaagtgctgtgattacagacataagccaccacaccctgccaaaaggaagattttattatggaaaattttagccaaattctcttctctaaaatgtttaaaattttaatttaaaggcagttagtaggtattgttaacaacaaaactacttgtttttaaaattcaaacataattatgaatagttcaacaattaataaaatgaacatttaagtagtgcttaagcccatttttctgagaatgagacagaattgaagctgagtaaatatacattagtgtgttttctttatgtaattctgaatcttatgtaaatgaatttgtagaattaagcactgtggaaggaatcgttttttgcccttcccaagtgaagctcccataggtacagttgggttgtccttctgggttgctttaagggcactttagctgttttaaaaacttaagtactaatttcatactcagtgtcagctgaatttattgaagtaggtcagactctggataggaacttgtttcccaaccctaaagagagtcattatccattcttctatttgttagagaatggtaataaattcttccacattgaccacaagtctagagcaatttcagaaaatctagatagttggatttcttcaggtataggaaattacttaagattctctctgacttttattatcccagtggaccaaaaacaaaaacaaaacaaataaaaaggaaagtcaactcctttccacccccaaagaagccatattcaatggttgtattctttaaaatagaaacttatatccctccctgcccccaatcccgccacccagccaaagaatacacatgcaaaaatgcaattaattctttggggaattcttttcttaaaaaaatttttattattgtaggttattcttcctctccagtttaattaagcaaacttttaatgtactatatgcctagcaatgttttctctggacactggaaaatcagtttctctgcctatgggatataaaattcttatctggttagcagttaagaaatagtatagtcatatgataaaacatgggaactgaaagtataagtattgtgagaagtcagtagttagtgatcaatatgtttttaatttatgaaggaaggcttcatggaagatttaggatttcagatgatgcttgaaggttggatatgagttgatagaaatagatgtatagaatatggaataagaagcatgaacagaaactttgaatttcaaagtgccagatagtaacttaaaaatgtttttgggtgagaactcatatatggcactgtgttaaagcaacctcggcaaaattaattggtctgccatcacaaattaatgttgcagatcagtaagtgaaaaatcagggactcacaaactcaagtcttttgaacttaaacgtccttgctgtattaacattcactgataacctatgagggtggcattaagaatctactaggtgctattacattctgagaatagaaaacttattaagtttctttctgagagatagagagacagagacccacacacatgcgtgtatactatggttaatttcttgtgcaaatcactcaatgtatatatgctatagaaaagttaatctgggtttcccatgattgtctcatagtgggaatatcttcttagagattatagcgtttaaagaatattggtataattcaacaattaaatacaaacacttcatgtaatgttgtaaaactggagaaaatctggattagatttcagtgagcaataatatgtcattcttcaatatggcacaccttcctaatgggttaattagtatatttgactctatgtgatttttaccttacatgccagtttaaaaagctgtgattatactgtacctctttgggccttctcacaattttgtagtcaactgttagttaaatagtgagtgggtgtttactctttactaaatggagatagctttacatcttttttttttctttctttcttttcttttgagacggagtctcactctgtcgcccaggctggagtgcagtggcgcaatctcagctcactgtaacctctgcctctcgggttcaagtgcctcagcctcccaagtagctgggactgcagatgcccaccaccaccctggctaattttttgtatttttagtagagatggggtttcaccatgttggccagatggtctcgatctcttgacctcgtgatccacccacctcggcctcccaaagtgctgggattacaggcgtgagccaccacgcccggccacctttatgtcattttaaatgatttaagaataaaagctacttaaccaacttatgaggcattacagaataggagctaagagcatggattatggagccagtctgcctggattcaaatccagactttgctgcttattacgtgaatggccattgcctttgttttcccagctataaagtgggtataatgataatacctatttcttttcttttttttttttttggatggagtctcactctgtcgcccaggctggagggcagtggtgtgatcttggctcactgcaacctccgcctcctgggttcaagcgattctcctgcctcagcctcctgagtagctgggattacaggcacgcaccaccatgcccggctaatttttgtatttttagtagagacagggtttcaccatgttggtcaggctggtcttgaactcctgacctcgtgatctgctcacctcggcctcccaaagtgctgggattacaggtgtgagcctccgcgcctggccagataatacctatttcataggttcattgtatttggtatatagtaagcactatcaagtgttagttattacaaatccattatcccttatttgcaattttgaaattaaagtaatcaaaccgtaaagcaatagtttttatacaacttatttgacagcaaagcctgatctaattaatgtctttttaacatatagtctgtttttgaccctatacttgaccttaagttatttatagtttgtaaaagtcctttgtaatggctgggcatggtggctgacgcctataatcccagcactttgggaggtcgaggcaggcagatcacttgatgccaggagtgtgagaccagcctggccaacatggtgaaaccggtctctaataaaaatacaaaaattaggcagttatggtggcacacgcctataatcccagctactcgggaggctgaatcatgagaaccgcttgaaccccagaggtggaggttgcagtaagctgagattgtgccactgcactccagcctgggtgacagagcatgactctgtctcaaaaaaaagtcctttataaaatgcagatactcgtgttactattttatggtacatattgggcagtatagttgacagccttatgaagtaaaaataaacctggatataattattattgagtacagtcagccctctgtatccatggattctatatctgtggattcagccaaccatggattgaaaatattcgggaaataaaaaaggatgattgtgcctgtactgaacatgtagatttttttcccttgcattatcccctaaacaatacagtataacaactatttatgtagcattttacattgttaggtattataagtaatctaaagatgatttaaagtatacaagagaatgagcagaggttatatgcaaatactatggcattttatataagggatgagcatccatgaagtttgatttctgtggtagtggggggtcctagaatgaatcccccacagatactgagggatgattgtaatgttaataatagtgtctatttattgaatgtttaccatgtgccaggcactatgctgggtattttatatccattatcttatttattccagtagtctgcagtagggaagttgtattgatcctgtttttaatgtgctcaagtttagggagattaagtaatttgcccagcgtcactccagcagtgtgccagcagtgctagattcagattttatctctctgactttctcggtaactcctgtgttctttctgtaacctacactgcctctctaatttagacaattttcataaggaaataaaaatcactgatatgctaaagtacattgttgttttgctctttttacctttgatcttaggtgctggtaaaccgcctatgtttggtgattatgaagctcagagacactggcaagaaataacttttaatttaccggtcaaacaatggtatgataattttaacttgtttttcttgtttatcatagttaatacagattgtttgaaaatattaaagggacaacacgctattttcttcatcttgaacatcctcatctcttgcatgctggtgccacatatgtattgccttgcattttgtaggcctgtctttgaaatttgatagtcctgaaagttaattcatatacttagttaggtgggctatgatgctgaactagaacgttgatgataaaactctgaatgtctatatgtcctctgtacataaactatggaagcaccatcataggctaaaaacatttcttccctgttccctcatccactgtttctctcactaaagatcactatgattgtaactatagataaaaataaaagagagctttggcagtagctgatggctgaatttgcagatctgaaaaggggaccaaagggagaagcctacaatgataggacttgttttcaactctggaaatttcgcatgtgtccttttgattcacctttgaataccgtgcatctagtatagggcatggcacattgtagaccctcaataaaaatctgtggaaggaatgagtatttaggtgttcactttttctttttttttttgagatggagtctcactctgtcgcccaggctggagtgcagtggcgtgatctcagctcactgcaacctctgctgcctgggttcaagcgattctcctgcctcagcctcccaagtatctgggattgcaggtgcctgtcaccatgcccggctaatttttgtagtttttagtagagacagggtttcaccatcttggccaggctggttttgaactcctaacctcgtgatccacccaccttgacctcccaaagtgctgggattacaggcttgagccaccatgtgcggcctaggtgttcgttttcgtatggtctcatttccatagctttctctttgtattatgaaggaggaggtcagctctacccttcattgttatatgatacagtatatattgaaccgtctgtttctgaaaactcagagaacttcatagacatttttgttaattattattgctctctatcataattgagcagtggtgattaaccttaattttgtatacaaatctacctgaagtataaaatagcagtagcttagtggtaaagagtgtaggtgctagagtcagactgtctgagttcagatcccagctctactatttattagctgtgtgacctttggcaaatcatttaactttctcaaccacagttttattacttatagaatgaaaatagtagactacatatttcactgggttattgtgaggactgaataaaatgatacatgtaaagcacttaggccagtccctagcatgtaacgaactctcaataaatgttagctctggttatagcatcatagaaattcatgcctgtgtcatttttattgaacatatcctgataactgttgatgacattatttattgacttactagatggttggtaggttattctcttagagactggctatataaactgttcatattatattgttgactgctttggctactgcttttatatagctctttatcagagagttttatgcaagaacttcatattgagttttctattgataggttgcctgttccctagtcagagtttggagtgtttcaaatggaagaggaactcgaaacactttaaatgtctcttagtaggggaatgattaaataaagtctatttcttatgtgctcattttttctaggtagattcctagaagtggaagctctaaagtaacaccaggatatctcattctacgtaccctgaccaacatttagtaataccggacttttaaaattggcacttccttgagtaattgtgacctgagcatcttctaatgtatttattgataattatatttcttttttttgagacggagtctcgctctgttgtccaggctggagtgcagtggctcgatctcggctcactgcaagctccgcctcccaggttcacgccattctcctgccttagcttcccgagtagctgggactacaggcgcccaccaccacgcctggctaatttttttttgtatttttagtagagacagggtttcaccatgttagccaggatggtcttgatctcctgacctcgtgatccgcccatctcggcctcccaaagtgctgggattacaggcttgagccaccgtgcctggccgataattagatttcttttcaaaattgcttgttcatttctttcccccgtgtttgtagtggataatcatttttgtaatgatttgtatgatttttaaatagttatactaattttctatgctgtgtaatgaatgacctcaaatgctaattgctaaaacacacatttattatcacagtttctttagatcaggagtttgggcacagcttagctaggtattctgctcagagtttcgggaaggctatatttcaggtgtcagctgggctgcagacttatcagaggctcaaatggagaaggatccatttccaagttccctcaggctgttggcagaattagtttccttgcatctgcaagagtgagggcttcagtttcttgttgggagccactcttggctcctagagctcacatgccatttgttgctatgtggcttctccaacatggccatgcactaaaatatgccagcttgcttctttaaagtcagtgagaggcagtctgtctagtatatctgctagcaagacagaatattacatgtacgtgaaacagaagcacaagagtgatatcctatcacatttaccatattgtattagttagatgcaaatcacaggacttgcctacgctcaaggggaggggattgtatgcacgcaggagtctgaacagcaggagatggtgttctcagtggtgaccttaaagtctgtctaccacgacagtatagcagtactgtacactttaatcattttcctcatgtgtgtgtatgcgtgtataaaataaacgtcttctttctgtttgttcttgtcttgttctgtaattggtgtctgttgtcttataaaactttctacattttgatgtatgtaagttatttcaactattcttgcaacttttctgtaactttgaaactgtttcaggctaaaaatttttttctttaaacaaaaataccaaatatgactctgtgggttgtctgttagagaaaactacatcttaaagttaatggtaacactcttgaatgtaattttataattcgtgtggcagccattttttttttacttactaaacatctactgagattacatgggaattcagtggaaaaatacatttcaatgtataaatagtatttagacaactttttgggtattgatatatctaaagtaaggccgggcgcagtggcttacgcctgtaatcccagcactttgggagaccaaggcgggcagatcacgaggtcaggagttcgagaccagcctgaccaacatggagaaaccccatctctactaaaaatatgaaattagctgggcgtggtggtgcatgcctgtaatcccagctactcaggaggctgaggcaggagaatcgcttgaacctgggaggcggaggttgcagtgaaccaagatcgcaacattgcactccagcctgggcaacaagagcaaaactctgtctcaaaaaaaaaaaaatatatatatatatacgtatatatatatatatatatacgtatatatatgtatatatatatacgtatatatatatacgtatatatatatacgtatatatatgtatatatatatacgtatatatatatatacgtatatatatatgtatatatatatgtatatatatgtatatatatataaaatataaagcaggagtatcaactaattgctttattcctactgatatattttgatgctttacttgaaacacttctaagctatcttctcttatgcctctttgttctgctttatgaatttccataagaatggggagcactgttataaatcctatatttttttcctcctaatccaaccaatgactttatttttagtatatatcattgcatgcttgcagcttactgtcaatgcctcttttactcatctccagtggatctcaaggttaaactaaatgaaaaaataggttttgtctattttcagaagctgaaaaccaaatcaagttgtattggacaaaatgtgattcttgaattacttgatggttttccattgctgtatccatcttagttgttttgtggctagtagccaattggaactactattgagcactttgtgtcagtcactgacctcacagctttacttgtttaactcaatgcttcaacagctctgaggctgataaaataaaactttatgctatatagtaacatgaatttggaaatgatataattggtgcctgtcttcaggtatctctgtctagaaaagtgggtcctttggtctccattatttgcctggcccggtttcccagattcaagctgccaaaaggggctccaactaacccagagattcttagactcgctgcttcttggcttcaagtcccagccagacatggaacccaagattgttcacatggatgtttctggagggacaatggccaccagctggtaccatactgtagtactctatgcccagatgtcttggctgtctaccatgccttgataattttaatccccatctcttccatacaaacctatgttttatgtaactgacactaagaatagaccttccgaagatgattaataggttatttgatgggatcatgttgaatgctaatttaaagaaatatttttaattcaaaaagtaagagattgtgatagtgaggaattgtgacccatttgaaataagttaggccgggcatggtggctcacccctgtaatcgcagcactttgggaggccgaggagggtggatcacttgaggtcaggagttcaagaccagcctggccaacatggtgaaaccccgtctctactaaaaatacaaaaattagctgggcctggtggtgggtgcctgtaatccaagctactcaggaggctgaggcaggagaatcgcttaaaaaaaaaaaaaacccaggaggcggaagttgcagtgagccgagattgcgccactgcactccagtctaggtgacggagcaagattccgtctcaaaaagaaataagcttatgaacaatggttatttatgggttatatagtttggcttgcactgttgtattcttatgattgagaaaataaatggaatagaagaagaagctgcctagttgtaaaggacatgattaagaaattattttaacttaacttttagttctcgagtcatgatagttgtatatatttccttcacattctggctaaccagaggagcctatcaatttgtggacattagacctacttttcttcctaaaattcagagagccttgcacgtaacgaggctctcgttacatgttggttgaattggttacaaacaatcctattctttttgttgcatattttttgttgtatgagtgttagtcattgatgaagtctactaatagtaggatgacagtaaatcccagtttgcctaggagagtcctggtttgtgtctattgacatggcttaattattaatagcttaataattagtaaattacattattaagcttagataagtgaggtgcaatgttaaattataagtctacttcttgaatattgattaacggaatggtgctttcttctttttttctttttcaggtattttaacagcagtgataacaatttacagtattggggattggattacccacctcttacagcttatcatagtctcctatgtgcatatgtgtaagtttttctttcttaatgtaactctaaatttttatgcccttggcagatttagtaagaagcagtgtgatggggctttcttgactagaggagagattgcttgtagctgctattgtattttttttttttttttttttttttgagatgaagtctcactccatcgcccaggctggagtgcagtggtacaatctcggcttactgcaacctccaccttccaggctcaagtgattctcttgcctcagcctcctgagtagctgggagtacaggtgcccgccaccatgcctggctaatgtttgtatttttagtagagacggggtttcaccatgttggccaagctggtctcaaactcctgaccttaagtgatctgcccacctcagcctcccaaagtgctgggattacaggcatgagccacctcacccagccactgctattgtattgtgtattacaaatgggttttaagaaataactattggctgggagtggtggctcacgcctgtaatcccagcactgtgggaggccgaggcgggcggatcacgaggtcaggagatttagaccatcctggctaacatggtgaaaccccatctctactaaaaatacaaaaattagtcaggcgtggtggcacatgcctgtagtcccagctacttgggaggctgaggcaggagaatcgcttgaacccaggaggtggaggttgcagtgagccgagatcacgccactgcattccatcctgggcaacagagtgagactccatctcaaaaaaaaaaaaaaaaaaaaaaaaaagaactatcaaagtttgaacatttctataatttttttggaggacatctagcaagaaatgtgaaaaacctagttttgttttgaagtagagatgttatccatatgtgtagactactaagaaatatatctaatatgtgttgtgtataagaaagttttttttctggaacagctcaaagtaaatgaaaaatatagatccagatggttaccaactaatctgtcaagttagaaactagaataattgtagtgtttcatttgtgattgaagatcaaaatgggaattcctcctccttttaaagaaattgaatagttatagaagataaggaacttctgttttggtaaagacccagttctactctgtagtggtattccatcttagatttgaagtatgtcagcaaaaatttgaggaacctcttcacaatatctcgtgaactcatcttgtttaatttctacttacagccctgtgtcacttcacgatggggatacattctgagaaatgtgtggttaggtgatttcatcattatgcaaacatcatagagggtactttagtaggcaaaatggtatagcctactatatctaggcgtatagcatagcctattgttcctaggctacaaacctgtacagcatgtcactgtactgaatactgtaggcagttgtaacacaatggtatttgtatatttaaacatatcaacacatagctagcgtaaaaatatggtagtacaatcttatgggatcattgtcctacatatggtccattgttgactgaaatgtcgttatgcggtgtcgttatgagtgtatttaatatttgcaaaaataagcttcatggattgaaaataaactcccaaacatcatcattatagtattcagggtaattgtaatatggttgaaaatttcatttaacaattgtgtttagttttatgcagtgatttatgattattatagctgtttattgtagccaattgttatgataactaaaatattataaattgtaaagatgatcctctggtcaacactagcatattgctttttataaagtatgtgtttggtaaatgaaatgtgacatgccagattgtttttacactggaagaactgtgaagatagggcttgtagttataccttacatagttttgttggaaggtaagcaatgtagatgctgttttatagcttaagtcagtttcacatgattaaataaaaagagtaaaacttaagcattgactctgttgctttataagagaaatggccaattctcaaaatattaatacattcatatatccttcaatatctttattgctaaaagggatgaggaatgaagtatctgtatatatgctttgatttgcagggcaaagtttataaatccagactggattgctctccatacatcacgtggatatgagagtcaggcacataagctcttcatgcgtacaacaggtaaaagagcaatgggtagtgaatataaaatttgattttttaaaaattttggacaaactggtaaaggtactattattgttcttactgactttaaaattgtgcaattacacaaacacatatatttacaaatatacatatttgtatacatgatccaagaccaaatgtatatgtaagctaaaacttgaaagagtagaaaggaataattctgggtgctttacattttttatctgacttaattctttgaacacctaaatgagataaatactattattcttattttaagctgaggaaactgaggcatagttaaatgaagcaagatagctataaattgaatctttagttttttagggtgctgctttaatatcctaattctaaatttctttcattttttcttaaagcaaaccttgcagttatcatcttatacattgtattgttgtgcagtttctaaattaaataatccacacaacaaatgtttattgagcatgtgtgtgtgctgttgtaggagcttgaaagtaataagcttagatttctttaagagctttacatgacttatgctttaatgctttaaaagcccagtccttttccttaattagtctaaatgtagtcagagtttgttctccttacaattcatccagtcatggaatcttaggcccaagagataacctgtttttcctgtctttccctctcccacaccactgcccttccctctccaatgctttaatcctttctgaaccacatacacaccatgtgattatttggcttctgaaccaatatccatacttgcagggaactcacaacctttagagacagtctattctgttttcagagagctccagtcattaaaaattactttctaaattgaacttccaccagtcattacagattatgttttctagggttacagagaacaagtctgatcccttgtatccctaacatcctacaggaatttgaagtcacctcttctctaagttaaagattcctatatacttcagctattccttagatgagcaatttgttgaatgtgattatggttttgaggactctcgccactcttttgggtgtgttccagtttgtcagtgtcatctttaatgtggcatctggagctgaacatattgatagatttcagttgatagattgatagtttactgtcacctttttcttgacactaagtgagatataagaaaaaaataagctctttagacagctatgttatacatttgaagaacttatgtatttatttttctttgttctaaaggactgcatgttcaaaattatgaattgcttttctttttttaggatttttttttcagttttctcctcacctgggtttctcaagctctttatatgcattaattagcaaaagtttatattttttcaataaagaccaacatttaaaaaagattttcttacacatcactacatttcagttattctttatactagaaaattcagagtatatagattgaggaaaaaaatatttccttgctttgaatatttttaagtccaagttagagcaaagagagaatgttagatacatctgattgattaaatgtgtgaatttgttagagaaaattaagagactcctttgcaatacagcaattgaaattagtcacaggtgaagggattgaaaagtgctgactgtgtaaaggacttgtccatagtagggcaagaaccttgtgttaatgaattctcaatgttggaggaagggaggcagttaatgggtagctgtaaatcctgatggactcatgtttaaagttatttacttgtgttttcagttttaattgctgatctgctgatttacatacctgcagtggttttgtactgttgttgcttaaaagaaatctcaactaagaaaaaggtaggttttcaagcagcctgacagttcgtctctgaaatgtattctttattagtctaactattaagtatagaccttagagaagccatgcttttggaaagagagtaattaggaatattgtatcttctatcaattttcacttcaaaagcatcaacttatcttacagtaattaattattttagtgtactactaagatacactgaatcttggaagttatgtactgttgaactacatgccttgctgaatttgttactttactggtaaagctgaattttgagctggcttgtgagattgaccaaactgaaaggcattttgaaaagttgttgtatattcttaattcatagttatcaaatattatttttggtcattttagataggttaacattagattgacttctccagtttgtgtatctgaaagtacttcctctgacaaaaccttttagtggttttgtttttcctttttatggaagtgtccaatgtcaccttcatgaaaacttcattgtctaaagagttgtattataaaaattgaatattttatgaaaagaaagtgtgacacctctggaaaaggggaacatttgctaatgtgttagataaaaaccacacttttaccctgcttgatttgtgtaacagattactttcttatctcacaatatttgtctttacagattgctaatgcattatgcatcttgctgtatccaggccttattcttatagactatggacattttcagtatcctttactaatgcagaaatgaagtcagttgcatattgtgaaatctagactcaatgtgtacattgctgtcatctagtaatgtcttatttgatagagtgcttgcttatataaactatttcacaataatataaaagaatctcttcactaagcttttatttgaaaggtaaagtacagatttattaaaagtagaattgctttttcatgttgtttgattgggaacaaaatgttggtaaatgattagctctttctggggtgttggaaaaagagtgccaagtatggttatactctagtaattctaaagtgtaacatgtcttctatcctttgtaaatgttatctgacgtgaaaaaaggagaatgatcttacagttttatgagtttaaaaattttttttctatcagatagtagtagctagaagcttcaggaaactaaaactgataatcaaaatatggcttttatatgtgtatttttttgatgcctaaaataaggaacattcaaacaaagcttagatgagaataaattgataaaaatctgtatatatctatctaatttgtcttataatatattgaatgttattacctgtctccatctctcttaaaggaaaaaaagacgacattacacagcaacatgattatttaattaatagcttttccttttgatgccagtcttgttttagttataataacactaataggtatatctgtcaaaggacttacaaataaaagatattcaagtctgtagttgtttttatcatatattttatattctgtccactttactaatttagttttttaaaaattttgacattgtttatgggatcatggctatcagatactctgataatatcaagaacagtgatagaaaaggaaaaaatgttatctaccagagttttaaaactatatttactttgaaatgtgacactcatgcagaaaactatgcaaaatataaatgtacagctcagtgagttggcaaactaccactcatgtcaagaaatagaacattactagtatccaaaaactacccttgtacacctccccatccttctccctcctcctttcccaatggtacccctgaactaactactaatcctatagttttccccttttttgaattttatatgaaagggacagcatagtaagtattcttttgtgtttgatgttttgggctgaacattttgtttatgagatgtattcatgtagttgtgtgtagctgcagtttgttaaaaaactatgaaagtgaattcagtgttcactttcattgctttacgatattccattgcatgaatacatgtaattctatcactgagagagtaatttgggttgtttcccagtttgggccatgacgaataatgctgccatgaacatcttataaatatctccttgtacatatataaacattcttcttataagtggaattgttgagttatagagtgtgcacatgtcgatttttagataatcccaagttgtttttagcagcatgtaccaattaagactctcataacaatggtgtaagagttccagatgctctacatcttgaccaactgtcaatggttttcgatttagccattctggaaaatttgtagtagtatgtcccctgtgatttgagttaaactctgaaggctttcaggcatatgttatcttgtaaggatacatttttttcttttgagacggagtttcggagtttcgctcttgtccgccatgctggaatgcaatggcgtgattttggctcgctgcaacctctgcctcctgggttcaaacgatactcctgcctcagcctcctaagtagctgggattataggcatgtgccaccacaccctgttaatttttgtatttttagtagagacagggtttcactgtgttggccagactggtctcaaactcctgacctcaagtgatccacccaccttggcctcccagagtgctgggattataggtgtgagccactgtgcctagctctaaggacacattttttaaccattatgtacttttctcatttgcaaaatgtggataatagaaaccctgactttgtaagcttagtttgataattaaatgaattaatatttgtaaagcacttaagacagttcctgggagacactaagcattatataggcatttgttgctattattaccatttttataatttatttttgtggttctgaaattttacagtgatttgtttagacataggtgtttttcacaattgttttggatatccaaaccgtatatgggtccatacgttttgaagactcatgttcttctgttctgctaaattctgttatattatttctttgatgattttctcacttttttctttcttgagcctattagtcagatgtttgatcttttgcatccctttctcttttgttttatgggttgggttatcttgagtttatccccaacacttctatcgaatttcatttgtattgttaggtatatttttaatttctaattagaatttactactttttgtttttttggtaaagttcactactgttccctgagtgattttaattctttcatggtcatttagtttccctttcatttcgattctttttctgtcataggttttctataaatgtttattttatcctagtgtatctatttttatttaagaataaggcaagaacacctgcatatgacttctatatatcattggtccactctaggataagtggggagcaagctggccaccacgcattgagatgcttaaatgtcagaatgtggaggggtttgcattatagtgctaacctctacactggatagtttagttcatttcttcagaaaaatatgccctcttttgttgccttggggtaaatgtttggctgccagataatctttgcatgggagtggggtaagatttgacttctacctctagggattttcagttaatctcttgttttcttctgcacatactactcaaagactgtaacctacttggtgtttccaaagttctctagggtcttgcagggtggattggctttttgctaccctgagtctcctctatgtatatactctaagctgtggcttccttcatcctattttatttgttatcacttctgtcttccagaaatatgttgaaatctttatctattataacagatcctcccattctctttatggctgtgaatttatactttttgtttgtttgtttttgttttcttgctctcttgcccaagctggagtgcagtggcatgatcatagctcactgcagcctcaacttcctgggctcaagcagtcctcctgcctcagcttcttgggtaactaggactccaggcttgcaccaccacactcggctaatttaaaaatttttttgtagagatggggttttgccatgttgctgaggctggtctcaaactcctggctcaagcaatcttcctgccttggccttccaaagtgttgggtttacaggtgtgagccacgacttctggcctgaatttatactattaaattccttttcctattattttaagagtctctcgggaaggagaggaggtaaacattagtgcctagctcaccattttgaactgaaaatctaattgtgatattgttttaattaacaatgttgttagtttctaattaagtacatatattactttatactattaatatatataatagaggaagtgtagcgatctcagtaaatttttttttaacttgctgttggaacattgttttattctctagattttggtatgttataataatattgtgaagtaatctaacagaaacaaagctatgttttaaatctttagagctcttttaaaccaaaacaaatcagttgctgcttagcagtagatttaatgtatttgatgctgttatacataatttcatgtttgtttatcacttcagtactttgaatttctattgggaaatagctttcattgtatatgttattttaaaatcacataagagatatgctatgagcttgcatttcctagagcatatctcttgtgtgatttgctttttaaaagctctatctttttaaaagattattgagataatttccttgacacaggaacatatataattctgtgagtcttggctttgctttgtggggtgttcttggaatatcttgtgactgcgacctcctagggtcactggcattttgcttagctataaattataaacagatggaactttaccacgccttgccatttttttgctttttacttggcaagtgttttaaaaaaggcctcaaaggaaaggggtgagtgacttttaaacactagaatccaaaaatttacttcagataatttttttggcatacttacttgcagtaagatgatctttcactttgccttttggtgatttcttataaatattttggctgtagggtatgtgggaagagagagattaagtcatgttctgtattttatttttaattttcctaactagagaaatatttcaattcatgtatatttactggtagtgtggattgggtagttagaactttgctgtaggattttatcactttagagcttactacattatatacttattagaaatacatccccatttgatatttttcttcatgaatgcactctcttattcctataggaatggcatctaacataaatgttaattacgatggtgataacagtccttttgttgaagtgcacgtcttagctgttgtgaattttttacctctgatttgagcacactcccatcttaagcctatattggtaacatagatttggcattactatacatgtgcatgtattatgttcagtgagactcaggttgattttgcagaattactgacctttccctatcttactgcctacctttgtttttgttttaggtttgtgttgctagttaagctagcttgtattgttgtggcttccttcgttctctgctggctgccattctttacagaaagggaacaaaccctgcaggttctaagaagactcttcccggttgatcgtggattatttgaggcatgtttaaacactttcctctcctttctgttactgtaccttacctgtgacctttaggggtttcatgtagaaggtacaaggaataggaacttcagctactttcctcctgtaatcattccttgccagttattgcttgattgattaattgattggttgagacaggatcttgctgttgcccaggctggagggcagtggctattcgcaggggtaatcatggtgcactacagccttgaactcctgggctcaagtgattctcctgcctttgcctcccaagtagctgggacaacagggtgtgtgcaccttgctagttatttaatccattatataacccctagctcaggtggcattttttagtatgttccatcaataggtaatattcatgccatcatcagatccataattgaattatatgtttttgtaatgaaatagggtttgtaatgaaagacagcatgagaagtttcagctacaattttaacagctgtgtaattttttggtgtatattctgtttttagtcttaggaaattatttgtaaaactaataatcatgttgcttcaggaagatctcataatttcttatgagatatataaccttcatccatagtaatttttaatgagaatctttcatttcatttcatttaatgctagtttaatcactcttgttaaacttttattatgtgaataatttgatcatttagatttggtaattaaattaaaccatttttctgaaacaaaaaggccttttaataaagttagacagaaacaacatatttatagataatttgctagcatttcttttaaaaataattttaaaagcatattttcctaagttttgaatatataaatttctatagaatatctttcagtagacttataggaagatggaaccagcattttgaaagcgactaagatgggagtttggtgttgtgaaggaacagaaatgtgtgactgtatgtcaacaggatgatggtagtgatgatctaaataatcactattgttataaccaccacttagcaggtgccagacacttccatgtaattttatttgatctttacagtagctttgtggtagctattgtctccactttacagattagaaaactgaggtcaaagattcctataactagtatgtagcagaactgtgacttgaacttggaaaattgttttcctaacctcttctttatataaactctaacacttacataaagaaaagtttaactctctatgtaagctgcctaattatttgccttaccttccatttcagaaatggcatttatcatgataattataaaaatgagtatcagacatgtttgatggtgttgccagtctcttccattcacttcttgccttcaaaatctgaaaagcattttctttgatccagcagaggaaagtgggatgatatagttgtcagtgatagttacttttttgatgttaagtctgcacagctgtaagtcaagcagctgtgtagagaacggatttcaccaccaggagagctgtagttacaaacttaattttgaaagtgatcctagcacaactgctaatgtctttagactttgatttattagcaattagctcttgtcattgctagtagctagcaggttactctgttactctaagtaaattcagttgtgtgataaaaatgggtcaaatgtaatatgtattctataaattgtagaaaaaacatttcttagaaaaatttccaaagatgaaggactttagtattcagggatagtgcactgctctttgaaaactattaagtatttgggaatgtctggattatggtgggccaatgcttttgatcaactgccctgcacaaaaatgaaaaatgcttgagacagtgtatgcgtatatgtttattcctggaggatttaatctatttagttataattgtgactaaaagtttcacatctcaaaaagtttattagagattatgggctgtacttcatgggttttaatatttctttcaattataccagaatgtaaagctaacaaatctcttttaaggataaagtagccaatatttggtgcagcttcaatgtctttctgaagattaaggatattttgccacgtcacatccaattaataatgaggtaagagaaacaaagtttgtatgtagtattttataagttactctttaaaagcattatggtattatttcatttatttggcatcattagggaatgaggtgtttttcttttcttttttttttttttgagacagagtctggctctgtcacccaggttggagtgcagtggcttgagctcggctcactgcagtctctgtctcctgggttcaagtgattctcctgcctcagcctctggagtagctgggattacaggcgcccgccacatggccagctaatttttgtattttagtaaagatgaggtttcaccattttggccaggctggtctcgaactcctgacctcaggtgatccacccacctcggcctcccaaagtgctgggattacaggcatgagccactgcacccagccgaggtgtttttctttagaggattttccacataaaagacctattgctctgtacaataaaactcttcaacttgaattattttatgtgaaaatttctgaattgttaccttgttctctccttgaacagagagtacattaaatacgattaatattatgttgaagagtcatgatattcagtgtgtatcagtcaggatcaatccaagaagtaggagtaggagatcactgtgtactgtgtgtgtgtgaattcgtgacaaggaattggcttatacagttgtagggcctagctaagcaaaacagaagtcacaaggcaggcagtcaggagggaatatctaggggggaaggaagagcaattcagacccagatgctgttagggaaggcctcagccgtcttttaaagggcttttatttgattaagttaggcgcctcaggacaagatcccttttgattaatttaaaatcagctgagtaggggtttcacatctgcaaaattctttcacagcagattagtgttcaaataactgggagatgagatgggtgtggcctctctgtcttccaaatcttatgagaatttcccttgtagcccaccctaacaaaggcatacaggaagggaattctagggacattagttcagcctagccaagttgatgagtcaaaatctacaactgggaaaaatcagttattgtattaggttatatacttgttttcagggctttcaggggctatttcccatagtactaaatggttccaggccactttgcttgttgagtctgtctgctttttctagttctttttcctcccacccattagccatcattaggagaagctctagtagcttcctgctccctttccaccttgttctttatgatttaccatgggcttgaaaatcagataatcaatgtttgtgaaatgagggctagagagactcttttgtgagtaaagtttatgaatgtttgtgttacagatatagcattatctcttatacttcattatgttttcttattttgagtgtttgataattgaccttcaactatgtatctttgtatattttctatacatgatattaaatactaaaataacagaagcaatatttagttttatcatgtttggtctatattatgtaatcgtgtataaaagtatatatatatatcaatgtgtagattttgtttaaatgttatttcatctttaaatttaataaataaaaatatagtttgaaataaacttaagttgataaataatatgatccttatatttaaaaaatatttccttatttaagctagatttatacctctacaaagaagacaaatatttgatttgtattaattttttagcttttgttctacgtttttgagcctgcttcctgcatgcataaaattaatacttcagccctcttccaaaggattcaaatttacactggtaagtttttcattactttagatacttaattcttgccacaactgatcttttaaaaattattttcatggtctgcacaggatttattgggttgggaaacaagacattcatttatttggcagacatttattggatgtttcccatacttagcttctgtgttagacactaagctaagcaatcaatactctttcagttaattcaactatttaatttgtttcgtattagttaatgagggactacaaagtagaaaacagtggcaatgaacttaagtagcttaaatagttatgctataaaacagatggtattaagttctatcaggtacaaatgaagtcctatgatggtgtgggaaagggagatattatctcggggggagattttagaatgctgtttagggcaagtgggatttgagcccaaatttgaaagtggggcaaggttagaacagcaggttatatagcagaagagaagttcaaaacagaaggaagaagttgaaggtccagaggtgggaaaggacacaggatattctgggaatagctattaaacaatataacttgtgtgagttttgtgtgtatgtgttgagagtaggagaggatatagtgaaagataagggtaaaaattgaccaaattattgaagaccttgaaaatcttggttgaaaaggtttggagtttgatttgtgtgcaagagaaactaaaaaatatttttgagaaggagagggggcagatctctgttttaggaggatgacttgtgtcagtttgaagatggactaggtgcattttctacagtttagggtttttctgagtagctttacaaagtcttcttggttgtgtttctatggcatttaaaattttgttcctgtgtgccatggtctataaaatgacatttaaaaaataaccttttaaactatcaagaacatttagtttctgaaaacagtaagtcctactggacttatgtgaggcaacatttagaaattagggttccaagtctgggactgccatgtaagtacgttggataaaaacaagccagaaaagaacataacagcgaaatacttcaaaagtgcatctcattaccacaatgcaaaaaggatagctttatgttcctcttttctttttcattatctttttattgatgatttgtgttgtttgattctgtgaatgaactctgagcataccaagtcatctgttgttaatattctattggatagttagaacagaatggatatggtgtaatgctctgatgtcttcactaggcttaacctgaaatatcttccaagcttgtgatagattgttgtttttctaggaagtagaatgctaaataaatgtacagttcaaagataatagaatagaatttcagagtttgggtaactttagcagtgttagagatgattacttttaggattataagccagaaaaaacattttctttttcttagttttgtaatttttttcagtttggtatgttttaaaagaagccattgtgttaaaactttttaaatgtaagatttttgttattttgtttttgttaatcatgctttgaattcttattgtatacttctgagagttttaagaacatttcccattataattgttttaaaagtattttcctttcaatcatgtttgcctgaattatatctcaatataaatctataattgaggtaactgatagcatgaatactggtgcatgtatagcagcaaaaggatttatatttaatttttcaggtattgagtgccttctcatatgccaggtcctcctctaggtactggcatgtaaaggaatgacagatgacatccctgctctcttacttggggccttccatgctagtggcaggagagggacaataaacaagataaatccattaacaagaaagcatctgggagtaatgagtgctatgaagaaagtagtgttggccgggcacggtggctcacacctgtaatcccagcactttgggaggccgaggcaggtggatcacctgaggttgggagttcaagaccagcctgaccaacatggagaaaccctgtctctactaaaaatacaaaatttgccaggcgtcgtggttcatgcctgtaatcctagctactgggaggctgaggcaggagaatcgcttgaacctgggaggcggaggttgcggcgagtggagattgcgccactgcactccagcctgggcaacaagagtgaaactccatctcaaaaaaaaaaaaaagtagtgttatgtgaaaagagagctgatggaatgaggttaggggacacttagattgagtaaaggaaacctttctagagaaggtttctatagtttagggtttttctgagtagctttattattaaatattaaatttaataatttaatatttaataaattattaaattattaaataataatatttataaatattaaatattaaaatagtatttgagccaagaagtgaatgaccaaccagaaggagccaatcacaagaagatctgggccctgacttgatagaatcatatttttccttaaggcaggaacacatttggcaaaaggagatgaatgaagtggctgctgtaaaatgagtgagggagatacaagagatgagttggaagggaaggcaggaaccagatcttgtaggcattgggatttttttctaagtataataggaagctattggaggattttaaacaggaaaattacatgatctgatatggtagctgtttggagaatggactatcaggaggcaggagtgttaccaattaggagattattgcactactacaaagatggagggtggcttagaccactcctctgccacccttagcagaggggaatggagagaagtggatggatattgtatttaggaggtgctgtagatagcatttgctgatgggttagatgtgtagcatggataagattcaaggtttttgcttgagcaactggatagttatccatatctaatttgcagaatataaacttctcaaaatagataattttttttaaactctaaatagcacattattaatttataaaacattaatatattttattgaagtgcatgttttaaaacaccaaaatagatttgttttgccggttttagattctgaccttcttgtctttcatggttttaaatttaagttgtctgagattccaggggaggatgaatgtatgattgttgtgtctgaggtatttactagttctgtttattaataactgagttatgatgaacttagatggttaaataaagctttataatcattgttttttgaaaaaatatgtcaattttttaatttgattaaaatatgcatactagtgttgtttgtattttacttctaaatagagctttaataaactttcaactttcatttgaaatgatttttatttagattctataattaacttgatatgctatttcacaagttgttatatctcatttcccccccttttttcttaaaggttagctgtgcgctatcattctttttattttctttccaagtacatgaaaaatccattctcttggtgtcactgtaagtagaaacatttgaaatatgtgtttatttgtttataatataactttataatttacatacaaatatacatttgaatgcaaaacaaaactacacaaatgttatatctttgcataaaatgatttcatagtcaggtttttttccagaatttttgattttctttataaagtgtattttaaactgaaaaattttggtagaatgttattgacataatagtaatttcttcctgttccttcacttatattttctacatgctaataaaaaatatatccttcaaagaggttttcatcagattggagcctgtttgtcatctttgctttttcatttcattcatttccacatctattcggtagccttcttctttccatttacttccatggggtcttttgtatgttgccttctttctctttttttgccacaagcttagtttaggccctattggcaatctgtaaccagactactttgttttagaagcattaaatttttttcctgatgttcatagaaagcagtggatgacagctgggagtatgatatcctaatattaaaatagtattcacatagaaccctttggaatactgaaatcctcctctaggtcaatcccaacccactactgctctacccctcaccctatgttcactaggatcctgtggaagatacatgtacagaatgaccaatgacaaatggcaggcagtattgcttttattaggtggagctttggactaaaaccttcgtgcagagctgggctggcctgtgtggaaggcttcttggctctaaataaaacagtctcatatcattgtagactgggaagactgcttaatgccatcctctgaggcccaaacctgagttagagcttaccactattgtatgaggctaggctgaccctacacaaatcactggtaccaggggatgaaactgtggagaggcattactttcaaacatgtattaatatatttccccagaatttatactcatagaaaggcagctcattcaggacctataatctgaccagattagttctcagacactgaacttctaggggttcattttttacaaatgcacctagattatttgtaacagtgcatggctttaatctatttttggtaaatggttttacagtttgcattaaaagttccttttgggctggacctggtggctcaagcctgtaatcccagcactttgggaggctgaggcaggcagatcatgaggtcaggagatcgacaccatcctgactaacacggtgaaaccctgtctctactaaaaatacaaaaaaattagccgggcatggtggcgggcacctgtaatcccagctacttgggaggctgaggcaggagaattgcttgaacccaggaggtggaggttgcagtgagctgagactgcaccactgcactccagcctgggcgacagactgagactctgtctcaaaaaaaaaaaaaaaattaaataaaagttccttttgacctggtcccagctaatcatatcattaaacaaatatttcattcagtaaatatttattgagtgccttctatttatcaggcactgttttgtgcacatgggatatattccagacaaaaatccctgccttcttagctatcattcttaaagatagacacttattaaaaaaaaaaaagaagtgagtgtgttagaaggtaataaataccatgatggagaaataaaacagagcaagagtaattaggagtactggaggatgggatgcaggtagcggttgcaattttattttattttattattatttttgagatggagttttgctcttgttgcccaagctggagtgcaatagcgtgatcttggctcaccacaacctccgcctccctagttcaagcgattctcctgcctcagtgatcattaaaaagtcaggaaacaacagatactggagagtttgtggagaaataggaatgcttttatactgttggtgggagtgtatattagttcaaccattgtggaagatagtgtggtgatgcctcaaggatctagaaccagaaataccatttgacccagcaatcccattactgagtatatacccaaaggattagaaatcatttgacctagcaatcccattactgggtatatactcaaaggattataaatcattctactataaagacacatgcacatgtatgtttattgcagcactattcatgatagcaaagacttggaacaaacccagatgcccatcaatgatagattggattaagaaaatgtggcacatacacaccatggaatattatgcggccaaaaagaaggatgagttcatgtcctttgcagggacacagatgcagctggaaaccatcattctcagcaaactaacacagcaacagaaaaccaaacaccacgtgttctcactcataagtgggagttgaacaatcagaacacatggaaacggaagggaacatcacacactggcctgttggggggtgggggctaggggagggatagcattagggagaaatacgtaatgtagatgacaggttgatgggtgcagcaaaccaccatggcacgtgtatacctatgtaacaaacctgcatgttctgcacatgtatcccagaacttaaagtatatatatatacatatatgtatatatataatttatatataaatatctatttatataaatatctatataaataaatatataaatatataaatataaatatatataaatatataaataaatatataaatatatataaatataaatatatatataactatgaatttatatttatataaatatatatctatatgaatataaatatatatttatataaatataaatatatatataaatatatatatttatatagatataaatatatatataaatatatatatttatatagatataaatatatatctatatatgaatatatatctataggaatataaatatatatctatataaatataaatatatataagtataaatatatataaatatatatctatataaatataaatatatatataaatataaatatatatataaatatatatataaatataaatatatatataaatatatatatataaaagaaggtgtattaaggaaatgaggtggtaagttgcatcagatgctgcttataggtcaaataagatgagggctgggaatatattatttgccttagcaatatggaagtcactggtgactttggtggggccagtgttggtggagcaatgcacggagaagcctgattaggtagggttaagaaaaaatgggccgggcacagtggctcatgcctgtaatcccagcactttgggaggcccaggcgggtggatcatctgaggttgggagttcaagaccagcctgaccaatatggagaaaccctgtctctactaaaattacaaaattagctgggtgtggtgatgcatgcctgtaatcccagctactcgggagggtgaggcaggagaattgcttgaacccaggaggtggaggttgcggtgagccaagattgcaccattgcattccagcatgggcaacgagagcaaaactccgtctcaaaaaacaaaggaaacaaaaatagaaaaaatgagaggagaagaactaaagacaagtagggataatgcaatttttttttttttttttgaggcagggtcttactctgtcacccatgctagagtgcagtggcgtgatctttgctcactgcagcctctgcctcccgggttcaagcgattctcccacatcagcctccccagtagctgggactacagacgcacaccaccacgcccagctaatttttgtatttttggaagagaaagggtttcaccatgttggccaggctggtctcgaattcctgacctcaactgattcccctgccttggcctcccaaagtgctgggattacaggcatgagccactgcgcctggctgataattcattttttaaaagaaatatttaaaattatatttttaaaattgtgttaaagtacacatagcataaatgttacattgtcaattagtacattcacactgttgtgcaagcatcaccactatctacctccagaacatcttcatcaccgcaaaaggaaatcccatacccaaagcagtccctctccattttcccttccccgagtccctctaaccactaatctgctttctgcaaatctctgtggatttgtctattctggatattttatataaatggaatcatattatatgtggtcttttgtgtctagcttcttaatattttcaaggttcatccatgttgtatcagaactgtattcttttttatgcctgaatagtattgcattgtatcgatacactacattttgttcatcattcctcagttgatggacattgggttgttaccatgttttggctgttgtgaatagtgccactgtgaatattcatgtacaagtttttgtttgagtctatactcaggagtagaattgctgagtcacatggcaattctgtatttaacttattgaggaaccaccagacttttccatagtggctgcaccacttaacattcccactaataatatatgaaggcttcaatttctccatatccttgatagcacttgttattttccatcattttgattatagccatgctagtggatatgagtggtatctcatcgtgattctgatttgcatatccctaattactaatgatattgaacatctctttatgtgcttgttggcacaatatgtctatcttcttcagagacaagcctatttaaatcctttgcctattttttttttgagacggagtctcgctctgtcacccaggctggaatgcaatggcacggtctcagctcactgcaacctccgcctcccgggttcaagtgattctcctgcctcagcctcccgagtagctgggactacaggcgcgtgccaccacacctggctaatttttgcatttttagtagagatggggtttcactatgttggccaggctggtcttgaactcctgacctcgtgatccacccgcctcggcctcccaaagtgctgggattacaggcgtgaaccactgcgcttggccgttttgcccaatttttaattgggttgtcattttttgagttttaggagttctttatgtatcctgggtactagcctttatcagatatatgatttgcaaatattttctcccattctttgggttgtcttttttaccctcttgatagtgttcttttgatgcacaaaagtttttaattttgatgaagtctaatttacctatcttgtcttttgattgtacttttgatatatatctaagaaaccagtgccaaactcaaggaaataaagatttaccctcattttccttctaagagttttatggatttagctcttatatttatgtctttgatccattttgagttaattttttttttttttttttttttgagacagagcctcggtctgtcaccgaggttagagtacagtggtgcaatcttagctcactacaacctccacctactaggttcaagagattctcctgcctcagcctcccaagtagctgggactatagttgcccgccacaacagctggctaatttttgtatttttagtagagacagggatttaattatgttggtcaggctggtctcgaactcctgacctcaagtgatctgcctgccttggcctcccaaagtgctgggattacaggcgtgagccactgtgcccagttgagtttttatatatggtgtgaggaaggtagactgttcttcagaggagttttgttgaaaaaggaagcagaaaaatagggcaataactggtagagaaaatggggtcaagataggtttgtttgtttaagagaggagcaataaaggcaggggaatgatcagcagagaaggaaagctgatggtacaggatctcaagaggaggagctgctggagcactgtcattgggaaagggagatggggtaggatctagagcacaaatggaagaattggcattggacagatgtgtgaagagttcctctttagtaaaaggggtgaacaggctatattggtagagatgctgggaagggagtaaatgtgatggtgggcatctgtgaaagttctgttttaactgcttcagttttcttattgaagtgagagggaaagtcattagccaagagtgggttgaagctgttggaagtaggagggagaagtgtgaaacattttctaaggagagacagagtgtaaacagatcagggaaatatatagtaattgcagggcacttgaatatcatgatcatgtatttaaagtgagaccagttagtatgggtagctgtttttctcttgagcagttgttcagtatggttggagtaagcactggtggagagttgagtatttccaggtttatggttttgtctggtgaggataactcccttgcttgagggcttaagagtgaatgtatgggagtgattataatgattgaccttagaatttaaggtaggtaaaaagggaaaaggccatcgaagcgatgagggaaagtgaaaacgtggtaggaacaatggattgaagatctcggtaggatcaaaagattgtcggagttggaatatccaaaaggcaggagatagtggtgagagtcatggaggaggtgcagtctaaagtatgaccgtaagggacaggattaaagatgagatcactagaagagaggcgttatagcaaatgagagggaagatctatgtatatgttaaaattgccaagaattaagtcagtttgtagagagtgatagtgagaaaggagttgaaatctttgggtaatggaggaagcggccctgtggttggtcagtatttacaagatggggaataatcggggataaagtgtgatgagaagagtttcaaagctggagattattagggtggagagagggagaactggtaggaaagtagtgaggaagatcaaggaggttacttcccaccatcaggccaagtcacttgaagactgtggaaacaacaaaaacaggcacagttgagagggcagagggcagtactgtcctcagaggagagagccaggcattgtttcaaacaaggtggtaaagggaggggttcagagaagaggttgaggatgtagggcatttcactgtttggtgatgaattgtaagtactttgaggttaggagctgagttataatcatctttgtattcctttcagagcagtgcttatatgtagtaagtttttttaagagacaaggtctcacttagtcacccaggctggagcaaagtgacatggtcatagctcactgcagcctcggactcctgggctcaagtgagcctcccacttcagcctcccaagtaacaagtaccccaggcgtgcgtcaccatgccaggctaatttgtaaattttttgtggaggtggtgtcttgctatattctctaggctggtcttgaattcctgggctcaagtgatcctcccaccttggcctccaaaagtgccaggattacagttgtgagcccctgcgccggctgtaatacattttttgtcaatgcttgtgtttggtaaataaatattgaatgcataaatgggaaagaattaaaccagaaagagaaaacagtatttattgagcaccttcaatgagcttgctattaatatgcgtccattctcaagcagtgaaatggaaagtcctctagtaatttctttctttgagatggagtcttgctctgtcaccaggctggagtgcagtggcacgatctcggctcactgcaacctccgactccctggttcaagcaattctcctgcctcagcctcctgagtagctgggattacaggcacgcaccaccgtgtccagctaatttttttttttttttttttgtatttttagtagagacggggtttcaccatgttggccaggatggtcttgaactcctgacctcgtgatccgcctgtctcagcctcccaaagtgctgcgattacaggtgtgagccactgcgcccggcctagtaatttcttttagtagttttcagtttataatcccagggtttaaatctcatatattagttgacataggaaaaagtcatccttctgggaaagggggagaatgcccaaatctttatagagcactttttaaaataaagagattcaaaataatgataacaattattcaacaaccaccatcattaggaaagtttattgtattttaaaaaagtaaacactagatgatacctgcaaagagttctttcaactatttaagaatacagggtattattattatttccatttccacttaagaaaatagattaatcatttgctcaaggtcacacagtaaataaagggcaaacatggggaccaggactcagggcttcacactagcaatgctccttctttgagcattgccacaattgaatcccaaaggtactggagcaggagttgtggtaaggaggttacagggcttagagctatgaccctaaacaactttttttttttttttttttttttggagatggagtctcgccctgtcatctcactctgttgcccaggctggagtgcagtggtgtgatctcagctcactgcaacctcctcctcccgggttcaagcagttctcctgcttcagcctcccaagtagctgggattacaggcacgcaccaccaagcccagctaattttttttgtatttttagtagcgatggggtttcaccatgttggccaggctggtctcgaactcctgacctcaagtgatctaccagccttggcctaccaaagtactgggattacaggcctgagccactgtgcctggcccctaaacaattctttgataaagccagtggttctgtttattggcattgtgcttcctgttcctatactatttccctttttatgtagctcttcctactaatttcttcctccttttaattttattattatcaatttgttttcctttatcctcttgtctctcttgtcctctccagtggcatgatgatgttgtctgccatatctttagttttaacttagcggagtaatatgtaacatgaaagaacataaaagagatgtttgaaaacaatactgggaattcatatttaccaagtactacgaaatatgtgacaaagccttctcagatttgtttatctgatccttttcttaagctacttgtttgtatgatagagaaaaaaagttccattaacggcatactggaagcagcagttttccaattattatgaggagttgacacctctgtgcctgtgtctaggctaatttagtctggactgttaacaaaatgaatcagtagtccatatgaagaccttcctggctgtttttaagctaccgctgaaaatcagacagataaaatgtatttatattttttacaattaggagttgaagttatattctgtaatattaaaatatttttttctttacgattttagaccagtctgcttagttttaagtgaaattccttttatgtctacttggtttttacttgtgtcaacatttaggtaagtcatatcaatttccatatattttcagtataattcttgtaaactaatttaaaacttttttatgaagtggttatggtttgaattgataattctcttgtgatttttaaaaattttcctttacagtatgctacctcttctattgaaggatgaactcctaatgccctctgttgtgacaacaatggcattttttatagcttgtgtaacttccttttcaatatttgaaaagacttctgaagaagaactgcagttgaaatccttttccatttctgtgaggaaatatcttccatgttttacatttctttccagaattatacaatatttggtaagttcaatttttaagaaatgacacatttttcagcatgtcactattttaaaaaattattgaagtagtgattttcttttatacctttttgagatataattcacataaatccactcatttaaagtatacaacttagtggttttaagtatgtaaacagatttgcacaactatcaccatcatctaattttacattattttgtcactcccagaagaaattctgtacccattagcattcattcccaattctattctcactcctaactcccttccttggacagccagtttctgcctctttagatttgcctactttggacattgcatataaatggaatgtattagtctgtgatagctgccataacaaaatacaacagaaatttattttcttacagttctagagactaaaagttcaagatcaagatcaaggttctaccatcagggttggtttctggtgaggcctctcttcctggcttgtagaaggtctctgctttatgtgtcacacatggagagagacctctgttgtctcttccttttcttgtaaggacaccagtactactggattagggccccattcttatcatctaatttaaccttatttacctcctaaaaggctatatctccaaataacagtcacattgggggttagggcttcaacatatgaattttaattcagtccataacatgggataataaaattgtggtctttatgactcggttctttcacttagtgtgtgtgtgtgtgtgtgtgtgtgtgtgtgtgtatttatttatttttttgagacagagtcttgctctgtcactcaggctagagtgcagtggcatgatcttgtctcactgcaacctctgcctcctggattcaagcaattctcctgcctcagcctccctagtagctggaactacaggcatgcgccaccatgcccagctaaattttgtatttttagtagagatgggatttcagtatgtcggccaagctgttcttgaactcctgacctcatgatctgccggccttggcctcccaaagtgctgggattacaggcatgagccactgcgcccagtcacttagcatatttttgaggttcatttgttatagcatatatcagtactttattcctttttattaccaaattatattccattatatggatataccacattttgtttatccattcatgaattaatggacatgaagttgtttctacttttttagtgttatgaatataataatgctgttgtgaacatttgtttacaaggtattgagtgcacatatgttttcatttcccttatgtgtatacctgggagtagaattgctagatcatatggtaattctatgtttaacatcttcagaaactgccaaactgttttccaaagtgcagcacaattcttcattctcaccaacaatgtgtgagggttctaatttcttcacatctttcacagcatttgttgtctttttaattataaccatcctagtgggtgtgaggtggtatttcattggagtgctgacttgcatttccctaatgactaatgatgttgaacatcttttcatgtgcttatcggccatttgtatatcttctttggagaaatgcctattcaaatcctttgcccattttaaactgggttgtctttttgagttgtaagagtttttttaatatatattcttgatatgagttccttaccagatatttaacttgcaaatatcctctcccattctgtgtgttgccttttcactttcttgatggtatcatttgcagcagaaaagttttgattttgataacatccagtatatctatttttttcttttgttgtgcttttggtgtcatatctaagaaaccattgtataaccagtggtcacaaatatttacccctgtattttcttctaagagttttatagtttttaaatctatgcctttgagttgctttgagttaatattgtatatggtgtgaggtaggagtctgactttattcaattatttcagttccattgaattgtcttggcactcttgttgaaaatcagttgttcttaaatgtaagggtttatttctggaatctcagttctgttccattgatctatatgtctatccttatgccactgccatactgtcttgtttactgtagctttgtagttagttttgaaattgaaaatgcaagtccactgattttgttcttttacaagattgttttatctattttacatccctttattttcatattatttttagaagttcatcagttttctcccaaaactcagctgagattttgatagggactgagtcgattctgcatatcaatttgtggaatattgctttatttttttgagacaaggtctcactttgttgcccagattggagtgcaatggtgtgatcttggctcactgcaacctctgcctcccaggctcaagcagtcttcccacctcagcccccttaatagctgggactatgggcctgtgccaccacacccggctaatttttttagagacggagtttcaccatgaatattgccgtcttaatatttagtcttccaatgaacaaacacaggatgtgtttccatttatttagatatttaatttctttcaacaatgttttgtagttttcagtgtataagttttggacttcttttgttaaatttattcttaagtataacgaatgatcctaaagcataattctttatgatgctattgtaaaggaattgttttcttaatttcattttcataatgttcattgctactatatacaaatatatttttgtatattcaacttgtattcttcggcataggtttttaatggatttcctacagttttcaatatacaagataatgtaatctgcaaaccatgagttttacttcttcctttctaatgtggatgacttttatcttttatttctcttacttgcctaattgccctaggacctataagacagtgttgaatacaggtaacaagagtggacatcttctcttttacttgatattagagggaaagcatctggtctgtcaccattaactatgatgttaactgtgggctttttaaaatagatgtcttttatctggttgaggaagttctcttcaattcctagtttacatgtttttctcatgaaaaaatgctggattctgtctaattctttttctgcatctttggtcatgtgtgttttttttcttttattctattatatgacatatttcattgattgatttttgtatgttacactaaccttgaattcctaggataaatcctactggatcatggtgtataattctttttatctgccactggcttcagtttgacagtattctgttgatgatttttgcatttatattcataagagacactaacatgtagttttcatgtgacgtctttgtctactcataaagttcatatatttaaggcatatcacattacattcaaggctaaaatgctagattgcaatgtatttgaggtcaagaactctgcattttatacatgccattttatctgtagcatctatcagtgcctcacaaagaataggtgctctgatttttgtttgttgaatgaatgaatattcatctaattattataatgaaaaattagaggcagctcaattatccagtagttgaaaaatgatacatgaataagtatataagctccacggaatatttgacaactactacaaatgttatgaagttgttgttgttgagacaggatctcactctgttgcctaggcgggagtgcggtggtgcatttttaactcactgcaacctggaactcctgggcccaagtgatcctccttcctcagcctcctgagtagctaggattataggcatgcaccatcatgcttgcctaatttttattttttattttattctttttgagatggagtttcactcttgttgcccaggctggagtgcaatggcacgaacttggctcactgcaacctcaacctcctgggtttatgcaattcttctgcctcagcctcctgagtagctgggactacaggcacgtgccaccacaccctgccaatttttgtatttttaatagagacggggtttcaccatattggccaggctggtctcgaactcctgacctcgtgatccacccgcctcagcctcccaaagtgctgggattacaggcgtgagctaccgcgcccagcccaacaggctatacttatttatatttttgagtactacatagaggattgcccaaagtacccagataacaaagagaaaagaatgactaactctattaggggagtgtaggggaaggtttcaaaggagatattttatatttagatcttgtaggaagacaaggcaggtattctcagggcagagttgaatgggtgtcctgagggttttgcactttaggtaatgaccatggaggatagtggtgtgggaggtaggaagttaagaggtgaacaggaaagacaaggagaggattaactttactcaggggttcaaatggaaagtagatataaagttcattttttgttagtataggcccagattcctgagtgtatgtcaaaatctagccctattgtgatattcacaatctggtccagtaatcttaaggtgaggaccgctatgggctcccagatttatttgttctttaatagtttttgagcacttactatatgcaagcattgttctggaggctgaggatacggtagtgaccaaaactaacagaaatccctgctcccatggaggttgcattctagtggagaaatccagcaccagcatatgtaaaatatatggcatgtcagagggtgataagtgctatggagaacaacaaagcaagggagaaatcgatatgatatgcaggagggatgaatgcaattttaaagtggcagggctttcttgagcaaagaaccaaaggaagtaaactgcagataattgagggtagaacatcctagaagagaaaaactgcaaatgcagtgaacatcatggaggtcatagtgattggagctgggtgagggaaagaaataataggacctaagattagagaggtaacagtgtagtttcttataatgggactagaatctgacttacatttttaaaaggtccctatggtagctatgtggagaacagattgtggataatggaatccatgagatgatggtgctgtggaccagggtagcagtggaagtggttagaaatggtcagattttttatatattttgaaggtagagccaacaggaattgctggggttgtgaaagagaggtgttcaagatgactccaaggtttttggcatacataactgaatgggtggggttgccatttaccgaattggaggaagcatgttgaaggaactttgtgtgtggtgggggcagtcgggagtatgaggagaccaagagttttttacatgtttagttttagatacctattagatatccaagtagagatattaagaagtacctggatatatgagtccagagtttagcgcaagcttgtccaatctgcaactgaagctggctttgaatgcagtgcaatacaaattcataaacttcttaaaacctggagtttttttgcgatatttttaaaaactcatcagctatcgttagtgttggtgtattttatgtgtggcccaagataattcttctttttccagtgtggcccagggaagccaaaagattggacaaccctggtttaggggaaagggccaggctggagacgaagttgagtctttacatatagttggtaattaaagtcatattactggatgactcactaagggtatgagtatagattaataagaggaataggtacgaagccccagaatgcagacgtaggggacatgaggaaccagcaaagatgtctaagaattaactgggtgagataggagaaccagaagagtatgatgtcatggaagccaagtgaacgaagtgtttcagtgagaggagagtgatttcaaatgctaatgagagaatcaagtaaggcagtaagaactgaccatgggatttactacactggaggtcattatggatgtttgactatagcagtttcatcgtgattagggtgaaagcccaattggtatgggttcactagtgaatgggatgaagactggacacagcatgtttataggcaactgttttgggaaacaagtgtaaataggagcagacaaatggggtaatagttggagcaagagagggtttttgttctgtttaacactgactcaagatcgtggtattatgacatttcaaccagtcccatatttcttaagtttgaaacttttattttaaagatttcattccagatgtttgcacttcccactaaggttgcctcaggaatttttcctttaacgacactggcagcctttgtttgtatctgcttgtaagctttcttggcgcctatcctcgcttttccatttggaatgatcactgcattactctctatttagatcttaccaatactgtcataatgtagccagcagttaaggcatcctttagggttctgtgtcccacccacttcatggaagtcactactgtttctcactgctttctacatttatttatactgcttttgtatacctgtgtactgtgctagggataaaatgagtaagatcttgctggtctttgtcttaaaggagctcacagtctagagtcacagtctgtccagtacggtagccactagacatatatataaatttaaacttattaaatttaaataaaaattctgttcctcagtcacagtaagtacatttcaaatgcccaatagccacatgtggttagcagctactatactggagtgcagacaaaacattttcattactgcaggaagttctattgtatagcacattggcctagagaagaccacactaactgatgaccacacaactacaataaatgtgctaattatttttactactcagcttggtatttaagccagtgtgactttgtgattttatttaacattcccctcagtagatggaaaactctttgaggccagaggacctcattttctttcatgtgccttcgtgtgctttactcattgaaagcatttagcgaatatgaaatgtaattttccatttgccatggaaaactttttcacagatgggttctcaaggttagcttagaattttaaaaattgatacagaatagatgtatatattttgggggtatatgtgataatttgattcatttattcattcatgtaatgcatgaagatcaaatcggggtaactgggctatttattaccttaaaaatatgtctttatgctaggaacattcaacttattattttctagctattttaaaatgtacattaatgttaactatattcagcctactgacctgccaaacactaggttttatttcttctagctacctatacatttgtacccattagcttagaattttatatcctgttggaccccaggggatgttataaatttaaccctgactagcattaatatttgtcccagatacctttgttcagtgccttggtggtaggaagtataagaagacaggggtcctcaggttttggctacacatgggaatcacttggagagctttaaaaagtactgaggcctgatttaattggtctggggtgtgatgtgggcattgagattttaaaaactcctcatatgattctaataggaagtcaaagttgagatacaccagaataaattagaccctcaaccctcacctttaattctgctcatttaatagctacaagtcaatgtttccagcacatttaaatttcaccttttatactactcagtaatcctttttttccttgcagtttcttatctcagtcatcactatggtgcttctgacgttgatgactgtcacactggatcctcctcagaaactaccggacttgttttctgtattggtgtgttttgtatcttgcttgaacttcctgttcttcttggtatactttaacattattattatgtgggattccaaaagtggaagaaatcagaagaaaatcagctagctgtattcctaaacaaattgtttcctaaacaaatgtgaaaatgtgaacagtgctgaaaggttttgtgaactttttgctatgtataaatgaaattaccattttgagaaccatggaaccacaggaaaggaaatggtgaaaagtcattgttgtctacacaaaataaatgtatatggagaccaaagacc

SEQ ID NO: 38553 - DNA, 101036 bp, Homo sapiens
ggcggggctctcggggccgctgccgccgccgccgccgcgcattgtgcagcaggcgggcccccgcgcggtagggccctggacccgcgcggctcccggggatggtgagcaaggcgctgctgcgcctcgtgtctgccgtcaaccgcaggaggatgaagctgctgctgggcatcgccttgctggcctacgtcgcctgtgagtgcgcgcccgctgccagctggggagccccattcattccccggcgccgcggtgggccgggcggcggtggttcggggccccgaggcggccctgcagccccgcgttgctccccgccccgggcggggccggcgctttctgctcccacccctttccactcttgcagcaaagcgggccaacttgggcgcacaccccctaccgcttaggcccgggcgcggaccccgggcggaggggcccctagcagtcctcgggcggccccaggtctctgcctcctgcccgggcgcgggggactcggcggcggcgctgtcgtccatgtcgcgctgggagccggcgagggtcccggtcggggactccggagcgtgccgcgtggggatacccttggggacagccgaggtcgcgccgcggtgtcggttaagtcggataaaaatactgtggccattggcagagcccccgctccgactgtttgctcctcaggaaaattactcagcgtttaactcttggggagccaagtgtgggcggctccccggcccgcggccgtgcccaggtgtcggggcgcaccggcatccccattctaggttttcccccggggctcggcggccgggcgaagcaggcaggcagctgggtggccgggcagggcgtgcctgcagcttctctgtgcgcgggtccagtttctgtcatcgctcacagcatgctgcctggagacagggcaggaggggcacttcgcaggcaggtggtcggccctctgcttgttagggaagtcagaaaccgtccttttaaagatctattcgttgggaatgttttaattgatgctattaatacgttaccaagtagcaaaattggactagaaatagctcccagtgtgagctgcgtttgaatgctagccacccagacacacactgaaatgaaatcacctgctaacctgttggcgttaccaagatctgattccagaggtgagtgggtacttcacttgtctgaagtgacttcagttgagctctaggaaggcaagtatgagtagatccagcctgtgtgctacagcccagctgttcaggaggtggagctggaaaaccccagcaggactccgggttgctaggggaggtttcaggcgtcggatgggtgttagatgtgtgtagttttgcaagggaggaagaactagtctaaagtgtgtgtgtggtcaatcttgagtaagaaagctgagacccaagaggaaagaccatttaaagttgaataactattattatggcagtaatactacctacatttgttgagtgcttaactgtgtgagtcatgattcttagtgccattgtctcaatcattgagcaaccctgggaaatcggtactataatgattcctattttagaggtgaggaagttaaggccaagagagattaggaaatttatggatgatcacacagatagtaagagaaggagggccaaaatttgaacccagaaaggcctgggagcaggagctagaacccaggtcttcgaacagcagtttcaatgtttattttgggggtattctatagtcgctgcaagggtttagaattaataaagtaggggatttatggagccatgggaagttttttttttttttttgagacggagtctcgctctgttcagcccaggctggagtgcaggggcgcgatctcggctcactgcacgctccacctcccgggttcacgccattctcctgcctcagcctcccaagtaactgggactacaggcacccgccaccacgcccggctaattttttgtatttttagtagagacggggtttcaccatgttagccaggatggtctcgatctcctgacctcgtgatccgcctgcctcggcctcccaaagtgctgggattacaggcgtaagccaccgctcccagcaggaaagttttttaaccaatcattcatctgaccaggaaatcttaccaagtccttactgttgtccctgaatttggcactaggagacaccatggggtgctaaaacttaactggtctgtgctgtgatggtacagaccctataccacatagtgtagcacgttgattctcagacttaagcatgcatcagaatcagtagggttttttttaaaaaacacagactgcttgtctcccacctcaagtttctgattcagttggtctgggatgtggcctgagaatctgcatcactaataggttgttctgtatgctgttgctgtgacctgacaccactttgagacccactggccaagatggtgaggtgggcatgaattggaaatgaaggttaaattacaaactggtgtgaggaaaaggaatgcatgagaactatgccaggaactcctgagtgagagcaatcaggtacgtttgttttgttgaggaatcaaaagtgagctgagaatggacggcttatgtaggagttaacagggaagtcataggagagagcgtgttctaggaggagcagtgtgtgcagaggtcctgcggcagccaagagcaggcagtattctaggaatgcaaagaaggatggtattgttggagtgtgaaaacaaaattacagccatgaggctgcccaggcagacaggggccagagcaggcaagcaggcaggcaggcctggggtgcagcccacgacatggttgattttagctatgaggggtttaacacagggtggaggcagtgttaataaggagcaggtatgctaagtctgagccactctgcagggaaaaatgttacagggcttgtgattgataacaccgaaggacactgaaaatgtagtccctcaaccgtgatgtctgtgttttctaatctctgcttttcctaattagtaatcttgccctccctgttacaagtaaaatctcaccactgtttgaaaaaactgtccatacttcccaattatatacaccctcactgttagccagcctccgttgcagaaatgccctccctgtttcgggaacagaactcaagttctgttagcctttctccttctcctccttacatctttcccaaagtctttgttacctactctggccctgagtctcctccttgataccacataactcttcttcatgtcttagggttgaccacctgctaacttgcattgtacttgagttctttcccattcatatgttggcttttttttctcaatgaaatcccgattctgaggacagggattgtgtcttatgtgtttcagcccttgaaacatttatagcagtgctaatggctcattgaaagaactcagtttctgccctttgtgctgaatcaaaaatcaggccaacctactaggtagctcctgggcagactgcttgaattacctttaacgtatttttttttaacatgcatatagtgtaaaaagttaaatagcttctgcagggccaaacagtatcccctgccaccatttccctctccccagaagcaggcacttcatttcttttttttttttttttgatacagagtttcgcttttgttgcccaggctggagtgcagtggcgtgatttcggctcactgcaaccttggcctcttgggttcaagcgattctcctgcctcagcctcctgagtagctgggattacaggcatgcgccaccacgcccggctaattttgtatttttagtagagacggtttctccatgttggtcaggctggtctcaaactcctgacctcaggtgatctgcctacctcagcctcccaaagtgctaggattgcaggcgtgagccaccgcacccaacccctaggcatttcacttcttttagttgattattttggtatttatcattgtgccattgaatcacctggcttcctgatttttcagttgtagatattacctagtgactttgttctttgggagatgatttttttcttctctttgcccctgtacatgctctccaccctcctatatagatgtggtataatctcacggagctcatcatgcagtgtttacaagcatgactatgtaaatgctgttcctagtgagtcatgttgtaggttactttttgttttctccagcgaataattggctggtgttctaatttgcttgctttctatgtagtatgacagatccaactccaaactctttgccagttgtctgtcgcgtcttcccccatgatgttcatgagcatcaggatgccccttggtcagcaccccttcctgaagaagggccccggggccttctactgcaacttgtggatacatctgagggtcagctgccagcctcaccacctgcacccacatcagcctggacctacccactgcaggacttctgtttcctgacttcctcttcctgactccctcttgtttcactccctggtttggatgtgatgggaagtgaattctgagactttacccataagtatattttctgccttcatgtctgatagattgatagtgtagaattatagaaaaaaagttcctttagaatttttgaagcattggtccaatcctttttggcctccagtattgttgaagaatttcaagccagtccttctctttctgaagattgtagcatcttcctttcgggtctagttgtcagtgctcgccacacatgtccagccccctgtcccccaggctcttggtaggattgccctcccttcctcactccctgagcttgatggcctcacatggttgttgtgccagtggcctgcccaggagctgagcggaagtgctacttccacttctgggcctgcacttcgctgcgagtgtaagttgctgccagagttttccttccctctagttaggttctgaactcagcttgacaatgatgatactcagcttgcagaaccccctcccacccatgctatgaccctgttcgattgaaataaacttgaagaataaatcttggttgttgtaggcctctgagggcttttgggctgctcattgctgtagtttaacaatgcctgccctgactgatacatccgtggtgttccaagatccacagtgctaggccttggtgtattttatccagcatgttgggcattttttgtgccctggcaatccagaaacacttattcttcagttatgggaattttcttgaattattctttggtgattttctcccctcccattttctatttcatctctttctgggactactactattctgatataggattgctggaccaatcctcttatttcctattttctaccattttaaggttgttgcacttttgggacgtctcctcatttttgtatttagactcttctagtgatttttttacattttatttttgccatactttttcatgtataagagttcttttttgttctgtgaacttttttaaaaaactaaaacatggtcttcatttcatggtatattctctggatttttaaaaaatttgttttcttttctctttactgaaggatctctttcctctaggctgccttcccgtttctgtgtgaggctctcctcagatggcctgcccatgtttaagagtgggggactctgtagggatgggcactgccttctgtgagctgaacctttccttgttggggccttctgaccttagtgctgcgggttggtcctcccgggctattgtcacaagactctccctggtccctgcaggaaggggaggcttggctgcctgcatcctggagcccagtgagcgagggctgtagcctaatcagtaacctgattgtcccagggggatctgggctcctctgtcagagaccctgattccaccctctccagagatggagccacctgtcttctgccagggtgggacaggagctggaacttgtcctgcttcttagatgtctttgaaaatcagacttcctgtctctgctgcctccacacccattgcagatgctccaggcctggcccagttcttgaccctaagtataaatgggccattccactgcccgcccacgtccgtgccctctccatgtccccatattcacctatcttctttttcctatccagtagcattttggtgcctgttctcccttccccttctccctgtccacgtggattgattccttaaacaagaacaaaaaagaagtcagggaggagggatatggagagaggggcagggaggaaaatagattgcctatattcaaaaaaagaaaagaaatcaaagacaaaagacattttctgatgttttagtcgggtttaggagccattatcttttcacctttagcctttgaaagttagagttaaggctggtcgcggtggctcatgcctgtaatcccagcattttgggaggccaaggcaggtggatcacctgagatcgggagtttgagaccagcctggccaacatggtgaaaccccgtctctagtaaaaatacaaaaaattagctgggcatggtggcgggcgcctgtaatcccagcaactcaggaggctgaggcaggagaatctcgtgaacccggaggcggaaattgcagtgggccaagatcgtgccattgcactccagcctgggcaacaaaagcgaaactccatctcaaaaaaaaaaaaaaaaggaaattacagttgtgacattgtgacatctagtaacatttatgtaatttttggtgtattgtggattttgttgtagtgacattttagttgtggtacctttctttcctgtcagtgttacttaacaagaaaagagataaaacctgaaaaccatatgaaagagtgttttatgtgtcttagttttgtgtttatggtaatagacttcaaacttccctgaggttgggactttggttacggtacagttttgcccttaatataatcagctcccacatgatcggcaattgccctcataaattcattcgggacacaattgttagcctctgccttggaggatgtgcagcaagttagatatcactgtgacgccagaggaccctgggggacagcagacagctaaaatccaacaacctagtaccggtggcattcccaggctgacccgagcgtgagatcagcttgggcttgtcaaatgcaggttcctaggatcctcctaggcctgtaggagcctgagggttggaggcacaagctggaaattgtgaattttcaacattttcaaaatttcctttcagattttctatcttttctactaaaagaatattttagtgaacacccaaatactctctgcccagattcaccagatgcctacatttttttccacatttttctttttcttactttttttgtatatattttatatatactttttttgttgaaatatttgaaaggtgcagacgtaacagtacttcaccttcaagtactttacatatatctcctaagaataaaggtattcttctatataatctcattaccattatcactccctaaaaattaacaaaataatatctaagatatagtctatatttaaatttccccccattgtaccataaatgactgtgatagcctttctgagattttttttttgcttctgtttttttgagacagggtttcaatctgttgtccatgctggaatgcagtggcatgatcttagttcactgcagcctcaaaatcctggactcaggtgatcctcctgcctcaggctcctgagtagctgggactacaggtgtgtgccaccacagccagctaattaaaaaatttttttttgtttagtttaaaatctaggacccagtcaagatttacatgttgcatttggttttatgcctctaaatttctggagccatagtagcctgatttttttttgtttgtttgattgtttctcataacatttacctatatatgtgtgtgtgtgtatatacatatttacgtatattcatgtatatgtgtgtgtgtgtgtgtgtatatatatatatataaaagcccagagcagttttcctataaatgtcccacattctggatttgtctgattgtttccttatgattaagttcagttaaacatttttataacaatgcttgctaattggtgtcgttgggaacatgtagtgtctgggctggtcccacttgacactgttcagtgtgacccctggaaggaatggcctctatgctgcttcattttgaaggtacatttttgcagtatgcaatctgtggagtgattcttgccacctgtgcgaatatcttgttctccagccagtgcatttcatgtccattgacgatccttgcctggaccgatttttctgttggggattgcagttagtgattttctaattttgtaaatcttttgatagttattaactggtggtgttttgaaaagaactttccctccctttttcttctctcactgtattagtttcccgtggctgctgtaacaaattactccaaattaggtgcctttgaaacaagagatatttattatttctaaatctggtggccagaagtctgaaaccaaggtgttggcagggctgagctccctcggaatgctcctctgtggctccagggtttcttgtcttttgcctgcactgctccagcctctgcggtgacatggcctcctccttttctgtctgctaaatctctcctgggtgtttcttataagaacatttgtcactagatttagagcccaactggataatccgggatgatctttttgtcttgagatctttaattacagctaaaaagaccttttttccaagtaagataacaatcacaaattctaggaattggaatgtggacatattttagggggcaccgttaaactcatggtgatctttctttaatcactgtggacccgtagcttcttttagtctttgagcacttccttaatgtctagatgtttcaggctcattttctttttctaccccaaacctggaatcagccttctctccaaggagccagaattgaatggaatcattggccacttgcttggtgtctagagagtgggagaattggttggtagtatgggaaaagcacacacacgtggtatcagaagtgttctgtaggtagaaacagggtttaagacttgggcatctttattttcaacaattttcccattttccaccatagttcctaagaaaatggacaaggtaaagtagtcaaggtaaagtgctgagtaccatgagagaaatgagatctgggacttggagagaatgggatgcccttaagacctggggcattgagttggcatttagcagaaggatacaatttgggcagtggagttgaaggtgaaagtgatggaatgagcagaggctggagtgacacaatgccaggagcaggagtctttgtggcccataaaggcagaatgtggaagtctgacctgacataaacttgatttaatgacatgagtaagccctccataagaatttgtgcagcatgagagagattttgatgaacatgcctgaagtgttcagacattagggcagggcaaagtataatcagttttgcattttggggttggcccgtgtggcctgaaatgtgctttgtggtgtgcatgtctcctgagctgcctaccttttgtagatatgtgactggattctagtcctggtatatgatatgtatggtacttctgtacaggccagtgctgtgatctgaatgtttgtgtcccctggaattcacatgttggaacctaatccttgaagtgatggcattaagaggtggggtatttgggaggtgattaggtcaggaggcagagccctcatgcatgggatagtgtctttgtaacagaggcccaagggagttcattcctcccttccaccatgtgaggatacagcaagaaggcaccgtctgtgaataggaagtgagccctcaccgccagtgtcttgatcttgcacttcccaaccttcataactgtgagaaacaaattcctgtttattagccacccactgtgtagtatatttgtgatagcagcctgaacatggactaagacagctgagaagtcaagaacatgtctgatgtgaagttggagagctttcacaaatagatatgttgaataggtgaggccagttaccagattcttcatgtgtactgaacccacattaatgtctactgcaaatttcttgtcttgctttttgtcttacaaatatgacaagtcctaggaattacctgaagggtaaatgtggggaggattaattcagggtcagcccttttctttttctttttatacttttatttttttctgagatggagttttgctctgttgcccaggctggaatgcagtggtgcgattttgcctcactgtgacttctgcctcccaggttccagcgtttctcctgcctcagcctcctgagtagctgggatcacaagcgtgcgccaccacgcccggctaatttttgtatttttagtagagatgaggttttaccatgttggccaggctggtctcgaactcccgacctcaggtgatccacccacctcggcctcccaaagtgctgggattagaggcatgagccacagtgcctggccagatcatcccttttctgaataaagcggtctcaccctatcacgtggtgcaagctttctaaccttctgtttcaattttttttttccatttgtaaaatgaaaatactcctttgccttgcaggtaaaaataatttgttttaaatactgtgaggaattgaagggatttctctaaagagctgataacttcacttgatgagcttcaagggaaaaaaggtgtgggtgtgtgttgtaaagtaacctgcaacatggagggactccttccaggcaggaagggcagtgacggccagcaagtgggaacttctcctctgaggggggctgagggtttcctcatcgccctgcatttagaagggccaagagtgaatttggagttaatccatcagtttctttttggttaagctttttagagttgctgtaaccaaaataaataagtgaagtaaagcaacagcagaaaacgtttgaacttcaaagcagtctttttcagagggagtctggatgtgctagaaaaggaaaacaattttgttagggtggtgagatcttggaatgttattcttagtatctttgaatatttttatagtatttttagaaattgaaagcaaagcctgctggttctaagttagaatttggttgacatatatactgggggtgaccttgcttttttttttttttttttttaaaaaagacttgagcaggcagctgggttttatcagcaacagaacattggtggtgtaggatggcttggttgtaaccaagggaaagaaccaagttattctgacactcatcaaaggggctagtgatggctctggtggaaatggccattagctgtgaataatggatcctcgtaaacagggcttctcagcaaaactcatacattgccaaatcaggatctttttctttttttcttttggtttcttttgctgttctgtggaatttaattctgattccctgctcccttaccccagtgcatcctaattatttaaaaaacagaatttctatcctaggttcttaattcaatgagaggaccccactatcccaacggaagcgctctctgccctccttaggcttcaccttgcctgcgttcccaccccacccccacccaccagtgtagatgctgaaatgcagccctcattttgggcaggagaagcagcacccaactatcctgcagtgaggcgtgaagaggggagatgttctctccatttcataggtggggaaactgaggcatggagaatgagcccagagcactgacagccctctgggttggggcacagctgtggtggctgaggatcatgcccgtgggtgctgtggtttggagatggtcctcctagatccctctctcaccttctttccctctctgccctttttgaacacaaaatgaaaaggctagcttaaaaccattattaaaattttttaagctcccatttgaaaattacaaaatacaggagaaatgagaaaacaaggtgctcaatgtggaaaagctagagaatgaagtgcaaagaagagaaaaatcccagacctcataatttctgcatattaaattgccttcccatccagaaatagcgcctagcttttctttaccaaacttgttcaagccactgcccgcgggctgcatgtggcccaggacaaattcataaactttcttaaaacattatgagttttgttttgctttttttgctcttcagctattgttagcgttatatgtggcccaagacaattatttttccactgtggcccagggattccaaaagattggacacccatactttagatagacctttcttttggccctcagcaaagttttgtaatttctttcttttgtgaagtgtatttccatcaaatttctctttcgcattcattctacatcaagatcaagtatcaaatatattactaacaaaacttcttaacagtaagcaataaaatgagccctgaagtcataatccatcttttaaaaaaatttctcctttgccttttgcattaatccttaagttgtatactttgttcccatcttcttcttaacttttagaaagtgccctactttcagaaagaaataatagagctttacatgttacgttggatcccagcgttagcactcctaggtttcttagatcatagtagttcctcctaaaagtcgtggtgagaagtctgaatttactttttcttcttaactagtatggatttttaaaaaaatttatttattttttttgagatggagtctcactctgtagcccaagctggagtgcagtggcgccagattggctcactgcaacctgccctcctaagctcaagtgattctggtgcctcagtctcctgagtaggagactacaggcgcacgccaccatgcccggctagttttttgtattttagttgagacagggtttcaccatgttgcccagggtcgtctcgaactcctgagctcaggtgatctgcccgtcttgacctcccaaagtgctgggattacaggtgtgagccaccacgccccgcttgccccagctttctttgccttaggcattctaaaaatagattcattaacggttattctcaaacctaatcggtggtgctcgctggagcctgctgagaagggagcatgtgccgggagctggggcctgttagcagttttcagagagagatgaggttccagagccccgccctgagccagggacgtgattggcagcggggaagaagagtacagggctgctgagggatgtgcctgtaaggatgagggccctgatgcttagcctcactggtgacaggtgtgggagggatgaaactccagtgacctctccgcagcccaccctgtgggatgcccccatgaactaggagggattccctccccttggtttccctctttttctttaatgtatctgttcgttccatcagaaaactaaggagattcattcatttggtaaccttagggaaagtatatttcattttccattgttatcgtttgaggtaaaatattgtcacatatccttaggtggagcctacatctctttaagtagaaaaaggcaaaagaaatagcatggtaacattttctaccatgccacaccaggcatcattgatatttgcgaagttgggaggagaggaggaaggagagtccacttctttgttgtctgtagtaatttgcaggatcaaagtccatttttgctttctggagttcagaagtggtctggaatttttctatttctttctccctattctccccaaatttgatggtatcctctggtatttcagatgaagagatgttttgtgcttgttaaatggtgacgctggactagaacctcgagtgaaatgtgtgagtgcaacgtgtttccaagtttattggtgtcctgcttccaatgacagaaagtacttgattttctcaggtggagatgtgcagatagtgtatcttatttccagctctaagaattagtcacataattgttactgaaatacttattgcagagctttctctctgtagtatttttgcagccaaatcctaagttgaggtggagaacctgggaaggtacttggtggttaagggtggtttataatttggatagtgacatgcaagggtcattgatattttacatatctttctggggcttagttttaattcataattttaacagtcaaacagtctggaagtatatggaaagcatcgctcccttccagctaatcctgttcaccttcccgtgggttactggttgtttcctttgcattgtaccatttgtagaatgtcttaggtgcttttaaaatgtaaatggttttatgcccttgatttttctgtgctttgcttttttactttatatgtggaggaaatctttcttttttgagacggagtctcgctctgtcgcctaggctggagtgcagtggtgtgatctcggctcactgcaatctctgcctcctgggttcaagtgattctcctgcctcagcctctggagtagctgggattacaggtgcacaccaccatgcccggctaattttgttattttttttagtagagatggggtttcaccatgttggccaggctggtctggaactcctgaccttgtgatctgcctgcctcagcctcccaaagtgctgggattacaggcatgagccaccacacctggccgtggaggaaatctttcaacacagagatctacctcatgaatctatggttgcacagaactcattggtagatttatatcatagtgtcttctcatgtaaacaaaaagaaggctttgtatgagtggggacttctagtggaaaatcctgttccttcaaactgttgttcttacagccttcttgaataagagtgaaaccccttaaggatagaatgcaatatttagaactttaaagctttaccttcaagcctgtcttgggatttgaaggtcagtcatattaaagttctcattgtaatcttccatttcctctgtaatgttgaacttgcagagtaaagtagagaatgaatcaaacagggaccttgtcctcatcgtgaaggtggagacaggagcaggcggaagactccatggtgatacaaagaaagggtctgggcgggcatctgagagggggtgaggccgcacagggttgggaaagatgacagagccagagagcggagagcaggagaagtgcagggcagggcctttgtggagagggtcaggggaagagccagggtttgaagtcagagcaagagcgggggttcagggtggggtgggggagaccatggaggcttcatcacaaaggatcctttgggcatcctgtccaggaacatgagcagggagccttgggattggccttgatttggagagggtgcctcacctgtgcctgatgcatgatggagccacagagggagactgggcaccctcaggaggaggagagagccagacaccagtgaccatgcagggctttgctgcacagagcaaaggtaacatgaagccctgctcccaagctgtgccccgtccagcccacagggacctggtgctgagcaagctttatcaacaccgccctgctgtccgttagagaaaaggcccattaatgatcagacgctgattatttcttggtcaggaagtacgaatgtgatagaagaagctggaaggcattctgtggttcaggaaggctggggggcactgggtgtgctcagaactacactgcccagcttgccgcaggtgatggaggagtagacatagggcgggggaaagggggctgggggtgggggccagtgccaggcatccactagggtggggcagggtgtgccccatgggccctactccatgtggaatgttgtaaaagagatttgtggagctgctatatatacacacacacactctaacatatatacacacacacatatatacacacacatacatgtacatatacacatatatatatacacacacacacccacttgtatatatttacagacacatacatatacatagacttgtatatgtatacatacacatacttatatatatatacacacacttgtatgtatatacacacacatacatatatacatacacatactttttgccttgtccttttacattatttctgttgttataaagaacataatatagtggtacatatacatatatgtggggtgcatgctcaacactgataattggaagcgggtgaccagattgttctggagaactcagaaatcttgaacaggaaaaggacaaagactttttggacaaaccgtgtaaagacgggagaagtgccacgtggggatggcatagacagaagggcccggaaggaggtggcatggtgatgcagtggccagggcccccacgcggcgggcacagagatgggggacacatggaagaacacattgtcagcatctgccaaccacaatggaagagcagtgaagagggagaaggggcgtctagaatttagtagcgcctgcgatggaagaggtttgtacagaggagttcttctggcatttgactctgttctttgtcttactaaaatgtggaatgtcttcagaggaactgagcaagtgagaacacaggtgggtgcccagagcagagggtctcagatttgggtcacgtcagcaacacctggaaccttgctaaggccagatggccagaccacaccccagagtttctgctttgggagctgtcctaccccaggctgcagtaacaaaataccacagacagggtggcttatgagcaacagaaatttatttcccacagttctggaggctgggaagtccaagatgaaggccccagcagattcagtatctggtgagggcccaattcctgttcatagatggcgccttctcgcagtgtcctcacatggcagcatcctgtacagacttaaaaaaggtgttcaaaagtttcttcttgtgatttgcggaaattaaagtaatacaaaagtataggaaggtcgtattacctggtgtccccagacttctaaaataaacaaatacatgaatagctttaaaaatgcatgtagctaggccgggcttggtggctcacgcctataatcccatcactttgggaggccgaaaaaggtggttcacctgaggtctggaattcaagaccagcctggccaacatggcgaaaccccatctctactaaaaatacaaaaattagccaggtgtggtagcacgcaactgtaatcctagctactcaggaggctgagacaggagaatcgcttgaacccgggcggcaaaggttacagtgagccaagatcatgccacttcattccagcctgggtgacagagcaagactccatctcaaaaaaaaaaaaagaaaaaagaaaaaaaaaatgcatgtagctttaaaaagcaaaaacattgaccctgctgtatgtattatcctctaagttgtcctttttacttaacgttggcattttatgtgcaaaaagttgtaaaaggtgcagatatcatctacaaaacccatacttttaaccaccctttaaaaaaggtgacatcttggggcaaaattttttcccctgggcatattggtaggattttattgggtaagcctatgggaaggtgtgcatcacaagggttttatagctggatttcagagcctgccagctggggttgcagagagctgctcttttgcctgcttctggagacaacaaattggagttctggcttcctggagggctcagagcagggcgaggaccacagggaggtctgataagcaagcgccctttgctttaggcttggagcatgccggttgctagagcctgctcaggcaccccagattgactttttatttgggccacttttcatcctgtgtaaccgcttagaatgagcacaggcctggaaggctgagggcggctgcagagtgcttctctagtctgggcatgctccaaggtttagggctaaggctccttcaggttcaggagtaggcacggcttcccgttcagcagctgccactctttggtctatcatgatgcctgacctttgagcacctcattcttttggtgggaactagcaactgcgaagccccctcaccgcagggacacatccccctttcttatttggagaattaaacacagagcagtatcttctaattcgaaccttctggtcagcttaagcaaaactttgaatgcttttcttcttagaagaatgatgcatattcttatctgctttaagcaaacatttcagttgtgccacctcagggtttatccaaggaaagtcgaagatttgcccttttccagagtgctaggatgattggggttcttcagaggtgagtaaggatgcatctttcctatgtacacttgttttcttcagatgggaggtgggaggactgcagccaggtggggagcagccaggggtggggggatagggatcagaattttctgaggacttcagacttggcccttgccttctacccaggcgggccagtctctatgcaaagcagtgcctttgactggaggagggcacagatacacttggtagggcaagctgtgggtgaggagggatttagccctatatttggcttgatttgagggctgtgacctgggcgtatgagcatcaatagattaaaggtggtgacaggtctggcactgttttggttgtggttatgtttcactgcttaaccaaccactttaaaacatagtggcagaaaacagttaccgttgtatttatacccatgggcttggtggatcaggaatttgagacggggatggctcttctttgtttcgtgatgcctgggaccacacccaggttagagcatccacttgcagggggcttcttcactggcaggtctggaccttgaggacagactcaggcttggctgttagagtgcccacaggcaacctgtctggcctcacgtggtcagacttcacgcatggtggttcagggctctgagaccaagtgtctcagcaaatgtggcagaagcactggcggccatctgtgaccatctaaaggcatcatatagtgtatcttttgctcttcactgtggtccaagcagctcaagacccccagacttaaaagaaggacacagagacacttctgtccccccatgcaaggtgtgccagataatttttggataggttttaaaagtgtcactttggagtatccctttgggtataaaggctccatgtagctttgctgcaagcacttggcagagaaactgtttttcaacttagatgaagcttttcgatacagctcacatgttcagaaaagcttgagaggaacagcaaacagtccagcattggaatgcatgcagcagcagcattctggaactttctctgccaataatactttcagtgtgctcaaggtgccctctgtttgtacaagatttccattttgaatgtctctctaaattaaagtgttcctgctctgagcactggaaggttggaaatcgctattcattctcctgaaatggggggcatctttcacattccaggaggcttcgctgccccactgaggatttcatggaggttgatgtcactcagtttttgtttgagcatgtgccacgtggcattgaggatgggggattagcttagaggatgtgtttggaaatgaacaagatgcgtttcttccatgcagatgggaaggaatctggagcccttgacaggtcatgcaggccttggactgaggcctaacttttggaagggtggcccagggatgggtgggcgctagctgtgtgtcctcaagcaagtcaccggctacctcttggggcctgtcttccgctgtgggatggtggtgataccatgacgctgtgattagaaccaacataaaaggcccacgtggagtaggtgctcagtaagcagcagtgatgctggcattgccactcttactgggcacgtgccttggttctgttactaggccctccccagggctgtggcctctcactacgtgcgccccacacaggccctgggttgcacctctggctgatgcgggccttcaagccccagccctcaggttctatttgcctgtgagacatcttcatgtgggttgctacaggatgccctgagctaagcatgtacttatctcagaccatcctcctctgccccaactatctgcctctggtgctcttatcttgtgacattactgtcctcaccctcaggaccggtgggctctgccctctgcattatttactctctgttcacctcctccctcgtccatttgtctctcacaccgctgcttccagatttgctcagactacagcacctcactgtctcttcatgctctgaacagctgttcattgcctgctgtccggagcccagctttcttggaataatataaaagggaacacagtggtgcccatatttggttcatgaacagaatctcctggggcttgttatgaaaacaaccatcctgcccatcttgaccttgctgctgcatcttcccctccccaggggcctctgctggcattgccatcccgcccccgccccccccaatcctcttcctccaccagaatctccttctccgtccgtaagtcatcccacagccatcttcacgctactccccaggactcaggtgactgcagcctttacttctccagggtgcattatatataggtggctgctgaccattttccttcaaggacaagaactccttggactggaatcaccttagtcattctggtatcccttagagcagaggtcagcaaactgtggcccatgggccatatccagcccagtgctagtttttgtaagatccaagagctagaaagttttaacaattcttaaatggttgaaaaaagtcaaaaagaatactagttcacagcacctgaaaattgtataaaatgcacatttctgtgtccttcaataaagttgtgtgggagcacagccatgcttttacaaattatcttcagctgtgttcactctccagtggtagagttgaatagctgggacagagatgtcccacaaaactgcaatatttgctattctggctcttttaatagagttttgtgggtttttaattttttttttgagacagagtctcactttgttgcctgggctggggtgcagcagtgtgattatggctcactgcagcctcaacctcctgggctcaagcgattctcccacctcagcttcctgagtagcagggaccacaggtgtgtgccaccatgcccagctaatttttgtatttttttgtagagacaggatttcaccatgttactcatgctggtctcaaactcctgggctaaagcagtccacactcccaaagtgctgggattacaggcatcagccaccacacccagcctacagttttctgacttctgccctagagtagcaattcccagtcatttgggggagctttttagtcaggctttcagcaaatatttagggagcacatactatgttcgtctgtctcagtaccctagataacagcactgaacaaaacaaaattgttgctgctgtggagcttacatttttttattgggcacaaacaggcaataaacagatataaataggtatattagctggtgataagtgctgtgaagaaaaagaaaggctaagtgggctgttggggggtgggtgctctcacagatagattggtcagaagacctcttttataaggtaacttttgagctgagaccttggatgaactgagggagggggaaaggtgaagaggcagttgggagaagtgtaagtgcaaaggccctgaggcaggcaggtgtggcaagtctgaggaatgacgaggcagatggcctgagcctggactctgaacattcagagagatgggcaataggtggtggcagcaggtccccagatcccttagggtagaggtcctcctccctcgccaggggtcacagtcacctggggtacttaaaaaatacagctgctgggaggcctctgtagagattctgattcagcaggtctgaagtacagacctgtggcctggaaggtcctagattttatcggttgagatgggagaatcagatccacactgctccacccccagccccatctctgtcagtgttggggcctgcagagcccttgcaatgctaaaaggcagtgtggattaggaaccttggctaccggacctcacacattgcttggctcctagaagatactcaaataaatgtttaaataatttttaaaaagagacctgcatttgccctgtgactgatggcctctgttactgttattttggggcatgccttttctttctctgtgcatggttccgtctagaggcctaggtctcaataaaggggtaagtcctccagcatctagccagtggtggctgctccaccttttattgcaggaatgggggcacactgtttcccgtagtctgaggtggatccaccccgccccccactgcttgtcacccagccaggcctttgggaagggttctccacgccctctcagggggtcctccccatacatgctgcatttccatcacagaccccatgtcgcctctggacagtaaagcaatgtgtgcagggtcttaacttgtgcatccgcaagcgctgagtttgttgaatgaatgggggatggaggagcaaggaaggattttaggaaacattggaaagaaggcaaagcctgcatgaggaccccgcagccaggggctgcctgatttcactgagcatccagcaggctgctttataggatgtcatactataaagaagggcgtgccttacatacagtgttacatagataacgtagggtaggagagcagtctccctaaatcacactttcttcctgtgacttagtgtaaaagtacatatgctttccagtttgaaatagtgatcggaatgactgagaaaaacatgctaaagcatactgtagccatttaaaatggacaggtataaaacggaaatggtgattttgcctgatccagccttgtaacattacttgaaatagggccattgaaattgctacccagatctggattcctggtgaagaatctgtactttctgtgtggcctggcattcagggactcaggctatatccctattctaaaacaaatgtgcctcttaaaatcccgggcttttatggattctgaattgatggtttttcatttgttcggggtcttgaattcattggaggaccttgagacctgtgaacacacaatttcacatgtgctttcacatgagactcccctctagtctccctgaaacccattcagggatccatggagatccacagacttcagattggaagactgtattctaaaaggattgatctcatgatagctgatgactatttaagaaatcaagttagactcagagattatgaaagtgttgggttagcatttgaattttttctttgttggaaaaggacactcattttaatcatatcctttaaaaaactcaatttttcactctaaatgaaaatttttatgagttagattttcttgaactgggttccctgcatagcttgaagtctggataccaacataatgagaactatgaagctgatatgcctcagtttacatacaaagtattttttaaatttatattaaaaattaaaatatcttgaaagctgtgtaagagcattcagttataagccctttgtcaataactgaataattatctttcttaaaatacttactttacttaatattgattcctggtactatataaatgggtttaattcagttcaaatatttgtagagtgcatctgttagtaatgcccagctatctgtttgaagcaccgtaaggtgggtcaaaataactcaagcaggttgcaaaaacttaaaagcaatattaatttaaagtaatgtttaacttttaaggtctatgccctgcaaccttccaggctactctacacaaaactaaagcttcataattgttggaaattgcttgtgtctttccctttggaatctgtgcagcaacgtgggggtttgtcctgctttgctgtgtgtgtgtgtctgttctttggtctgggctgggtattgaattatctctcaagcaaagcaggtagagcttttgataatttgaaaggaggccacaacacttgacatgaaaacattgtaaagattaattggttatagcgcgtctgaagataaaaagtaataagcaagagataaatgtaagaaaagggaaaaattacttggcatgcattcaacgaattttagtgcttggaccatgtatgcctggtgtaacaaatgtaaatatgaaaacgcctcatcttgcagtgagacccacctgtaaggtaccaattagaacaaaacatgcagcagaccttggccacacaggagggccaccagtgtctcctggagcaggagggaaggttgaaggtgctttctggagaatcagatgctcagatgagtcttggaggtgcaggtgcccaggacactacctgtagacgagctgaagggttggggacagcaagtggtttagggaaggtggagagtcacatgcagggggctgcttgcaggggcctgctctggaggtctgagtggcgaagcgtggaggtctgagtggggaaggaagggattcatgaagcctcctttgcagcatgaatcaggaggtgcagctggggaggagagggcacgtctccaggtgcatctccagcctccaggggcagtggaagaggtctgagacacagaagtggatctggtccatatctgcttacatccattcttatccatttatgaagggtggtaaagctttggctgtggcttggacatcattccccagggctgatcctgggaagcatgggcgtcacctgcttccccaggaagagatgattaaggagaagcagtgggcaaggggaaagggctcaggacatcatggtcaaggaaacagaaggtgtctgggatgggtggcagccttcactgctgtgaaatggactgaggatagaaggattgagagatttttgtgaaatcaactttttttcttttttctgagacagggtctcacttttgtcacccaggctggagtagtggcgctttctcagctcactgcagcctcaacctcctgggctcaagcgatctttctgcttctgcccccgccatgtagctgggactgaaggcacaggccaccacccctggctaattttttgagatggggttttcaccagtttgcgcaggccggcctcaaactccagagctcaagtgatttgcctaccttggcctcccaaagtattaggattacaggcacaagccaccgcaccaacctgaaatcaacattttaaagtgagttgaaaaaaggtttgaaagaaaaaactgaaaaagcaaataacgatggaatgatttgaaaagtctgccaaaaggtgctacccacccagaaggcaataagagaatggatgcttccatagcatggaatacttattctcagtaaagcagcttaatcctgtagccaaaatgagacagtatacttatttgagatatatagcacagtaaagaaaagcgcacatgggttgggcaactggtggctcacaggtgatctttgtggactctggtggcagcagtgcgtggtgtccgagctgaggactgacccaggtgttcaccaggtgtctagaaaaaggcaagaacaggacaacaaggacatagagtttagtaagggttaaaatctcttccctccttttttaaaagtaactaaacttttttaaaagtaagtaaacacttaaccacaaggaaaattaaacagttactcatgtcaccatttaaactcagtattttggaaatttcacagtctttttttcccaatgcattttacagaagtgagagtcacactgtatatatactttttcgtctggtactgtcataactgcatcatgttacagtgtagttccgtggtcatatttaatggctttctgatttcatcaaatggctgtatgacaatttatacagcaattctctaattatgggatattttggcttattccttttttgtgtgtgtgattataaataaggccatgacattggtgagggcacttttcctgtatgtttactgatttcctgagagtaagataaaagcaaaatcacatggttcaaaggtataagtgttacaggaaaggggtcccgatccggaccccaagagagggttcttggatcttccacaagaaagaattcaaggcgagtccttaaagtgaaagcaagtttattaagaaaatgaaggattaaaagaatggctactctatagagaggtcagttctgagggctgctgattgcccatttttatggttatttcttgatgatatgctaagcaaggggtggattattcacacctcctctttttagaccatataggtaacttcctgacgttgccatggcatttgtaaactgtcatggcgctggtaagagtgtagcagcgaggacggccagaggtcactcttgtggccatcttggttttggtgggttttagtcagcttctttactgcaacctattttatcagcaaggtctttatgacctgtatcttttttgttcttgagacggagttttgttcttgttgcccaggctggagtgcaatggtgtggtctcagcccactgtaacctccatttccagggctcaagtgattctcctgcctcagcctcccaagtagctgggattacaggcatgcgccaccatgcccagctaattttgtatttttagtagagatggggtttcaccatgttggttaggctggtcttgaactcttgacctcaggtgatctgcctacctctgcctcccaaagtgctgggattacaggtgtgagccacagtgcccggcccatgacctgtatcttatggtgacttcctatctcatcctgtgacttataatgccttaacagtctgggaatgtagcccagtaggtctcagcctcactttacccagctactgttcaagatggagttactctggttccagtgcctctgacataagcagtttttattttttttaatgaataatgaatctagttaatagctttattttaatttctcccatttccctgctttcttgccacttttatttatttggtcatatattgctgtcttttttttaaaccaagttttctcctctgtttgaagagagatgtgcttctatggaattagcaacattccccttcttgagagtgggaatttcatgtgggggtgtagtttggatactgaatcctatttgatgagtagctattaaactcctactacacacaagaggatggcaatgggaagatgcctggggttatgagatcctaacctcagggccttcccaagctcacaaatttaacagcccgggacagggaggacgtttgtgtttaatctctctgttcttcctcggcacctggaagcacctaaatgcacctggcacttagaaggccttcagtatctgctgagtggccacatgagggccaaataggagtgtgtacaaaatattaggaccgcctatgctcaggaaaggcttccgtagaaagaatcctgctcagtaacttaaagtgagtgctcatggtccagtattacattttaaagtcatctgctgttgattcagggctgacttatacacatttactgaaggccagctgtatacaggcaaaggagagcctgcccaccaggtgcctagagtatagaagggagatgtggtaagtgctgagaaaggatggcactcccgttggagttaagccgcactgcaggccactgtttaacctctctgggtttgctttcatcatcattacaagggagaggttagactgaaccttaggacttctttcagacatgtgattatttgatttttgtgactagctcttcctcaaacaaaggttgagaacatactgtttatcaaaacacatgcatccttagctaggtgtgatggcgtacgcctgcagtcccacttactcaggaggcggaggcgagaggatcactagagaccagactgggtaataaagggagatctgtcacttggaaaaaaaaaaaaaaaaaagcttcacctgcactgtccaactctagaccccaaaagaggtattccaaaactgcagggatagatagaaaagaaaaacagctcagagcagtgtgagccatgtgaggtttgcaaaatttatcaggctggagagtcatgagcacggaactaaagtcatgccctgccatgcccagggccggttctttaaaggtattttgtttctgcccagctgcctcaaccaattatctttttcctgggatttttgatacaaaaaacaatatatggccaatcagtagcttatgttattttaatgtaaattcttgataacttagaaactgccttttcctttaaaagcccacttgtcactgctgctgatgggagcatatattcagggcaacttgaattgatgttcctgggttgcagttctcaaacttggcctgaataaactctacgatcctgtttttacttattttgtagtaagatttaattgttttgaaaacaaagtatgcattttgttgtcttcgtaagttaattttctttgtaaaatttaaaatattggttaaaatttaagattccatccattggaatccctgaaagttgtggacttaaacattgacttccttttttctttctcttacagctgtttggggcaacttcgttaatatgaggtaattgtttttaattacttgggtactgtggttggattttatagacacatttcagttggtacatatataccatggatgtcatgggttaattgaaaaatatttttaaaacaaaagtgggttcttgctattcacatatctgagctgtttcttttctcctatgggtattctcaaggaatgcagctgattttaacaattaccaagtaaggcccacaagtaaaacaatggtcggccacccccgcttccctccttgtgtagataataaagggttgaccctagcttatgtaaattgtatttctgggtggattgagcaagaacactgaggggcttttgcaaagccttctgagaagggagctgtcttcgggaagccatggcaggcccatgacctcagggggccagctagtgggtatcgatgcagagaccacctatttagtccagcgttaggcctgtatgcatcgtgtgtgcttcttcatagggcaggaggcactcttgtaaaaataaaactcgtgttatctctttaccaaataaaaaaaaatagcctttaaaaaaatcagcaaaaagaaataagcacttattgtaaaaaccatttggtactgttaatagttttccatgtaaaggaaaatttgctccacttggttatgttgtgagaatcactattgtgatgattaggttggtattgtaatgtaatgcggctgcacatgtctaccagggtaaaaggttactatgccctcaggaggcttttcatgtggagttgggttttgcaaggtgggtgggatggtgtcgatttgattcctaccaccagggcatgtgtgtgtctcctgacaaaggctgctgtgtatgactaggtggggtgctcagatcccttttaaaggagctctgtggttttacttaaaagactccatttttacattaaatccccaggaaagcccagcaggcacaaacacatactcctacagacgcacttcctgcttcaaatttaaaatcctgtgttggatgtagcatagcagtgagattattttagtttagtggaaataatccattaggtaatactgagcatgttcacagatggatttaaggggagtccttccctttggttgtcttcttttcctctggtgcatcccttctggagggaattgtacacatgactgatacttgagcaggagacagaggtggtctgcatccgttgggttatgttagggtaatttattcagaaacagtcttaaagtcacaaagcctttcagttgatctcagttttatagctttctactcaacaggtctatccaggaaaatggtgaactaaaaattgaaagcaagattgaagaggttagtcttttttctatttttgtatctatttcatctgtatacttgtcaattttacttcctttgctcgtgctgtcattcttattgtggcagcttgatgctgttctgtgattttgcaaccgtgtctcaaaaaattactcccttatttaagaggacatgcagtctgttactgttggtccatttttgatgtattaaaacaaattctacctcaaaggcaaaatggatttagacttttacatgacttttcaggtaagcgttttttagagaaagggaagtgattgcctttgggagatagagatgagtacaaacatcctctcactggcacaggtgctgaaaagaacaatggccaccaatcggatgctaggccacgtgcacagatggagacgttgcacacccacccagctgaaggctagcacctatgctcagttatgcacctcctatttaaatacatgtagatacagccagaccgttgtaacatgggctgtgggggaggggatgggaggttacttactttggatttgaagccaacttagggagtcctgggaagcccttgagttgctgtctttctgcctgagtccacagtgtctacagacgtggatgtaggttgactcacagcctgcaatttatgtgctgcagctgataacatgagtatacacagtaattgcagaaacaagatgttaagcttttgtgggccatgcttaggggattgttcctaaaaagagatggatagtgttgatctgtttttatgagcctgaaacaccttttacattcttcctagtaggatgggtgagcaaaaacattaattgtctcagaaaccgaggcatttatggagtaagagttcaaatggacagtttatctgttcaattctagcattgtgatgcaagtggtgtatcttaatttcaaactggaagttaatttgtagaagaaattaaaacctgttttgccttatctgaaacatcagaatggggtgaaaggggttgagaactgtgtttttgctttaaaactgatttttgttattattgttctagatggttgaaccactaagagagaaaatcagagatttagaaaaaaggtatgtgtactttttgtcttaaagtcaatagttaaaataagtttgtctcaattgagtaattaattctgtttgtttgctccaaactctgccaacctaaataaatgtctgtatacgcatttcccccactttgagtgtaatacccagatagaacatggggagaagaatcaatctagatgtgttaagatcttccttcttcaaactctgaacgtctgaatttctgcaaatttattacatagaagttgaggccaggcctcacattttccttgaacttctgcatatattgatcagtgggatagaattccaaaataggaggacaatccagtgggcctgaaatgtaccatatgcaaacaccacaaaataaggatgtggagcctatggtgtgtcatgtgtagtcatttagctgcttttgtcaccagagttcatgaggaggtttccagaatttagtccaggtgaagtgagagggcagaagaattatgtaatatgatagaaatgtttatttgagtcagatttcggagagaacccctcctcaccctttgggacactattgccctcaggttctctctcaggcactcccgaggccgctgagcctcagcctccaggactttcctcttgcacgtactgtatgtggaaaactatctagagtagcagttgaatcttcagaaattttagaaagaaaaatgacagcatttattaaagttgatgtgattttttccccttattgggatgagtttggacgatgtgtgtcagcattgaatgagccttttatcaagtccagaacaaaaatgaaaaaatgaagagcagttttcctttgattttcattaaatgatcgaagggaaatacgactggagaagagtcattaaacaaaatgtgtcattcacttgattcttatcctcaactgagcagtcaagcaaactgttaatttcagcacttatcagaacaaaagttgtcagtaatttttaacagattccttagtaatataaggttgttacttgtgctttaaattttttttgccatgattctgtgctttagttatgcagcttgtaatatttccttggatgggagccagaaaatctgcctttgataagacagcagaattgagagatcttaattgaagctttttttttctttttagaaaaattggaacaataagaaataacccaccacacattttctatattggtctaaaaacttgtccaccagtgattattttctttagacaatagaatttatttatgaaaagaaaaatgtctcaattcgataacttccctaaggcaatagcttacaaacaagagctctcaacatgtgagaattatgcaatctctttgatacttttgtgatatctttgagtgtgtgcttttaaactggatggagaagcacaaataagaattcaatcctaagaatttactaataatttattcttgtcaacctgtgaaaccgccttgaaaatagtggcaaagggcaaacatttgcctctcgggctgcttgcaggtgactcattctggaatggttccgtccttcaggttggtcagcaagtcaggtgatccgcgtgcctgcattactgtgtcagaaggtcaagcgtaggcctggctaaaaaagcgtgacggtggaaattgatggaactccgtctagcttacttttcctgactcagtgtgtgataaagatgatcaaacaaccatcttgacactgacaagataagaatgtaactggaaataggtttacttgacgtgcttgtcactttgagcaaagtggcccccaagaactaaagatatttttggaagttacaggttatatttgtacagggaaagaaagaagacagtgtcattctagaatcctgagtaaatggattgtatgtgggctttttctcttttaccacactcccattgcttaatactttgattatatgccatttgtttaattttaactctgtatctttaaatgttctttgaatagatggcaaatgataatttaaattctaagtaagaatactgcttactggctaaacagtaagtttaatctggaatggcataaaatattaatgattagtaaaggactaatttggggttgtaaggaaagatttgttacctcattctgcctctgcttgctggtttctctctcgcttaggaatgcaggcctcatgcctctgctgcattttgctgcttaacccccagtgcctagtgtagaacggagcttaatggaaagttcctgaataagtggatgagccagtacactgggtaggattttcacctgctacaggtctttaagaagccttgtgggccaggcacggtgtaataccagcactttgggaagcctcggcaggctgatggcttgagcccaggagttcgagcccagcctgggcaacataatgaaacctcatctctacaagaaatacaaggctgcagtgagctgtgattatgccgctacactccatctggggtgacagagtgtaagaccttgtctcaaaaaaggaaaaaaaaaaaaggccttgtgctcctgcccagccctgagtcagtccagcaggtgcttgggagcacccaggcagctggctcagcatgtggcccagccaacggcacccacatggtcactgcactctatcagtcactgtgctctgtcacccattactgcaaggaggaaaacaggatgacatgcatactgaggaggaccccacaggcactctccccttcctgtttttcagctttgtatgtgtggcttctcgaagaagtgaggagtataagatagttttttaaaagtttaattacttgagcgtatacatatgaaatctaaaacttggctgctacatattgaagaagaacaaagcaagaaactcaacctatttttcgttttttaaattaaaggtttcagcacgctgcatttgaagtattttttagtccatcttatgcccgtcactgcgtatgtcgggcaaccatgcctttgcttcagttcaatttctttgaagtacatttcctgtaataaaacggtttggccgtttcctcttggtataagtagcacaccacatttcattttaagctttcagatagggactattctaagctgacagcttggattaacatttgtttccatggccccggatgcacactccacagtcctgcgcctccgctcctcactgaattggttttctccctgcaccgcgttttcccatatgtagctatattcccattcccgagcggtcttgactctaaaatcatatacacggtagagaaggagccctgaaggtgagtgaggggaagtcatgagtcagagacggctccagcgttttcacgacagacagttcggaggagccacggtgcttatgagcagtcgtgggaaggaaagagtctcagctgtgccacggcactgggtgtgccacttggggactgaggctgaagacatggatatcgtgagctcagagaaatgaggacaattggagcggtgtgagaggtgcacacaaataactctgagatttacagtgccgtcccctagctgagttggtgagggaagaagaggcggaatgacaagaagtgttacttggcaaacaagacatctgtgccgctcccgccagtctaacagcatcgctcctgactgaaggcagaacttgctcctgctccccagctgcatggatgactttcctgaggcacttcctatgggcggcaagtactaaagacggtcggtgagctcacaagggggagccccagggttcccacccttgccctcagactctcccatctgattttgtagtctgcaaggggaacttgagcttttgagaccctggaagttcttaatgggggaattcgtctgcattgtaatagaaagccctttcactccaatttaagcacgctcagggctttctggagatgagaaacccctgcttcaggggcttctgtctaatgacccttcatattcccttcagttcagcgaccattaaggaagtgcattctgtatcctagtgctgtgtctgtgctggggacagggcagggatggagacggtgccacctggcacaacacctttccaattagtataatgaccataaagctgatgtctcagattttatttaaagcacttttgttcctaactgaataacttttaaaatgaatatttcagttctgtgtttattacctctcactggacgttttatattcagatcacactgccctgctcctgggacatcagtgtgggctggggaccagtggcaccttagggcagcaagagggtatcaaaagataagtgagacttagggtcagagcagatccacagagacagaagatgctgatgctcagtcgttttaccagggacgctggtcaggaagaggatgccgtgattgtgaaaattcctggagcaggagacaaagtttcattaatatctcttctcgctcttgtggagcggtcctcatgcgttgggcctgtgacttcacgaagctgctttcttccacctggaccctgatacagtacccagagaatgccatgattatagcccggtgggctcttcttgccgactgccctgagaaaaccaaggcactgagaacaacaggtgttacagcgaagagagagtttaatcacagggccagccacgtgtgagaatgggcgaggtttctcaaatctgcctccctgagaactcggcggcttgagtttttaagggtagtttggtgggtgggggcctggggagctgaaacgattggctgggtgtgaaatcatgggggtgtctaaactgtcttcaggcagctgaatcaattcatggaagccaagtctgaggaccgggtgacatctcttagtctgtctgccaaaatgctaaatctgaaagatacctcaaataccgtttccttaggattcacaatagtgatgttatctgtagaagttgttggagaagttacaaatcttgcgacctctgtttgagtgaccctggggcaggaagcaacatatagaaaagccagctaagctaagcagttggcaggtcattgtttatgcttattctttagcaaagttcagaccctaccataactctaacctcggcttaggaatgtggcttcaatctcgaaacaaggaggggggtcagttttccttgcctcatcgtttaactataaattcctctcctagttatattggcctctgcactaaaataagcaaaaacaataaaaacaaaaattgagcctgtgaggttagatggagccagtcatattagatttctctcattattacaattctgcaaaggcagtttcacggccatctccctcatggtgtggttttatctggactaatagaggtagtgcctgccctgctttagcagctgctggaagccggtagctccttgcgcttttgcttctcagagatagaatctcaagtcacgtctttagcttgattctaaacaaggagcaggttatatagctcttgacctcaagttaactagtgactccttggtttctccagcactcattcaagagtggagagaagagcaaacaataacagtcccaaaacctggcacatgctttgatggtagacagagaaaatattcaaatgagatgtttgactttttccttttgaatctctttatattatacagctttacccagaaatacccaccagtaaagtttttatcagaaaaggatcggaaaagaattttggtaagtttgcacacctgaatagtatttgtaatattaagaaactttcttttttcgttgagagataattcacatatcatagaattcacgcttctcaaagatacgattcagtggcttatagtatgtccacagagttagcaccgcattctgattccacagtttcttcatcaccccaaaaaagagtcctgtactcattagtagtcacttccatttcccagtcccctcccgccagctctgggaaaccactaaaactactctctatctctatgaatctgccttttttgaacatttcgtctgaaagaaataatgtgatatttgatctgtcttcaagactcagctgtagcatcaatcagtacacttcattccttttcatggctaaacaatgctccattgtatgggtgtaccacatactgtttccctgtttctcaattgatgggtatttggagttgtttccaccttgaggctatcgtgaataatgctgctatgaatgcatgtgtgtaagttttcgtgtggacacaggattttcattcttttaggtatactttggagtggaattactggattgtatggaaaccctgtgtttaactttttgaggaagtatgaaatttgagagcagtggtttttaaccttttctagctcacagaccactttgaagaatacccaggggtatccttggctaatagtgctcttgttaaacatcagtataaactcaccaatgaaagaaacccttttaactattaggtaacaaattatgtccaaaaagatttcatgttgcattttttttaaagtaacagctttattgggatataattcacataccatacagttcacccttaaaatgtataattcagtagtttttaatgtattcacagagttgtgcaaccattaccacatccaattgtaggccccccccaaggaaagcctatacccattagcagtcactctccattttccccttaggccttccacaccccaatctctaggcaaccactaatctgttttttgtccatgtagatttgccaattctgggtattttatataggtgggataatgcaacatttgaccttttgtgactagcttttctcacttagtatgttttcaggttttgttcatgttgtagcttgtatcagtatttcatatatttttattaccaaataatctgttatatgaatataccacagtttatttatacagtaggccctccatatctgtggtttccttatccgtggattcagctaaccacgaatcgaaaatgtagttaggtgcacaatggttatggctgtactgaacatgtgcagactttttttcaggttattattccctaaacaatacagtataacatttttacataacatttacattgtattaggtattataattatctagagatgatttaaagtatacaggcggatgtgtgtgggttatatgcaaatactacactattttatatgcggaacctgagcatctttgcgtttaggtatgggggtggggtgcggtcctggaaccaattccttgtggatactgagggatgactgtacgtttgttatatgtgtcatagggtgactctctttaaccttttgaggaactgctgtttgccagagcagctgcgccattgtacatttccaccagcagcatatgagtgttccagtttctctacatcctcaacgccacttcttattgtctgtctttttgattgtagcctttctactgggtgtgaagtgatatctttttgtggtttggatttgcatttctctgatagctcatggtgttgagcatctttttgtgtgcttattggtcatttctgtatcttctttggagaaatttctattagatattatcctattctttaattgggttatttttcttttcatcattgaattaagttctttatatattcttaattcaagtttcttatcaggtatattatttgtaaatattttatctcattctgtgggttctctttttactttcttgatgacattctttgaagcacaaatgctttaaatatggataaagtctgtttttttctcttgctgcttgtacttggatgtcatatttaggaaatcttgcctaaactaagggcacaaagatttaccatgtttttttcctaagagttttatagattttgttcttaaatttaggcctgtgatccattttgagctaatttttgaatagggtattaggtcatcattcttttggatatggctgtccggttgtccagcacaatttgttgaaaagactattcattgcccattgaattttcctggcacccttgttgaaaataattttaccgtaaatgtacagtcaagcatcacttaacagtggggatacattctgagaaatgcattattaagtgtttttgttgttgttctgtgagcatcatagagtggacttacacaaacctcgatggtacagcctgctacacacttaggctacatggtatgacctattgctcatatgctacaaatctgtacagcatgttgctatactgaatactgtaggtagttataacaaagataagtatttgtgttcatctgtgtaggccacttaccacaaatggagcttgcaggactagaatttgctctaggtgagtcattgagcgaatgccttgtaattaactaatttcctatttggtacctttcccttctttttccttctggaatccatttactatttggggtcacttgctttcagcctaaagaacatcctttagtatttcttgtgtggtaggtctgctagcaatgaactctctcattttttgtttatctagggatatcttatttttggtcgtatataagattcttgactgccagtttatttttacactttaaatatgttgatagagttcggatgtttgttccagcctcccaatcccatgttgaaatttgatctccagtgttggaggtggggcctagtgggaattatttgggtcatggggacagatccatcatgaatggcttggtgcacaccccactgtaatgagttcacacaagacctgattgttaaaaaagagtatgggacccccttcttctccctgtcttgccacgtgacatgcctgctcccccttagccttctactatgattgaaagctctccgaagccctcagcagaagcagatgctggagccatgcttcatgtacagcctgcaggaccgtgtgccaaataaacctctttgctttataaatcacccagcttcaggtattcctttatggcagcacaaaatgaactaatacatgtgccatccactgctttctccattgtttgttgtaatgagccagcagttaatcatactggggttcccttacatgtgacaagtcatttttctttttctgccatatgaatttcctaggacttgcagttaccaccatctgagtggtttaaaacaacataaatttaatccctcacagttctagaagctagaagtctgaaatcaagatgtcagcagggccatgcctatgcccctctgaaggctctgaggggagttttttccatgcttttctcccagcttctcgtattgccagcaatccttggtgttctttggctggtagaggcatcactctagtctctgcctccagcagcacatgggtctttgcatgcctttagtattggattaaagtcccaccctaatccagtataaccttatcttaactaaatatgtctgtaggggctctattttcaaataaggtcacattctgaagctctgggacagacataaactttgtaggacagtatccaacctagtacatctgttttcaaaatcttatcttgtctttggtttgcgggatttctagaatgatgtgtctgtgtgcatctatttttgtttgtgtttatcctaattgcagttcattgaacttcttgaatatatacatttatatgttcatcaattctggggagttttcagccattatttctttgaatatattttgtattcctttctcttttctgatactcccagtgcagcatgcatgttgatgcacttattggtgtcctgtatttgtctgaggctctgtttagtttcctgcatttcctctgatctttgggttgcataagccctttcagtccaagtttgctgattctttagcctagttccaattgactgttgaatccctttgttgaatttttagtttcaactgtggtatttttcaactccagaattcaatttgtttctattttgtaatctctctttattatctatgtacttctttaagcatggtttcctttcgttctttgaacacttgccataacttttaatggcaaaaactgcaattgcttttgcaccaacctaatatttacagtggttgctttggtgtctttgttatatccaacacctgggacttcacacagacagtttttattgctttgttgttttttctgtttatgggtcacccatttctgtttctttgcatgtcttgtaatttgttgtagaaaactgggcattttaggtagtatattgtagcacttctggatactgtgccctcatcccaacccccaccttccccaacttgttttattttatttatttatttatttgtttagtgacttctctggtctactttagtgaagtgtttcctattccgtccccgccactccagtgtgaagctttaactgttgttccttggaggatgtagccttggccaaaccccctgggatgatggtgggtctaacaggctcatgctgacagtctctttccctgatttctctattaagcctgtgcagtatctcacccagctgttaggctgcagtggttgctagctaattgctttatttttcaacaatgctgtgggttttaaattgctcttcagcctgatccagttaaattctatccccttggcaggggtagattttgagaccagtctttgagatttgttctgaccccaggaggtttcttaagtgtcctctccttggttctctctgttaaacaagctggcctcggatttagctttttattctcatagatctattgccttctatttattgcttaccatctgcatctcccttgttcttgagagcacccttatatttgactttctctttcaaataaagtcaactccctttagggagagcttttgagtgcactgttttcagtacctctgtcccccaggaaaacctctgaaccactgccctggtgctggggtgggagcaacacctctgttttataatcagggtgctgtagcccctgattttttttccttgcccctcttggcatggaacttctcccttctaagcaagttggggcaaccgtgactggaatcctattattctcagccttccctgtctaggaagtactgctaagtggcccttcctgttgagataccatatcttttgagtggggttctcattttcttggccacacccagcacattccccactctaaactgtggggatggactcaagtgttgcagactcttgctgttcttacttaattttatattttctttctttcctcttttctcttcttttttcttttcttttctttctttcctttccttcctttccttcctttctttctccctttctctctctcttttctttcttttcttttccctccctccctccctccctccctctctccctcccttccttccttcctttcttttctttcttttctttcttttctttcctcactttgtcacccaggctggagtgcagtggcatgatcttgggtcactgcaacctccacctcctgatttcaagcgattctcctgtctcaccctcccaagtagctgggattacaggtgtgctccaccatgcccagctaatttttgtatttttagtagaggtggggtttcaccatgttggccaggctggtcttgaactcctgacctcaggctatctgtccacctcagcctcccaaagtgaattttatattttcttgaatacatgttacttcatttgctgtacgtgcttagcacaatttccagagacttttaatggttatttaaaaaaataatttggaccacttatggttgtttccttggggaacaggtctgtggagcactttacactgcaattctacaagaaatgatttatatatgaccttgatgttgaaatgactagtacacaggttgttttgttcttttacccatcacctaggctgtagtactgtgcatccctaaaatattattgtcactcctgaatcgatattagactgttaccccatataatctctctgttcttctggaagttatagaagtctcttgcctttttgagatggcttacataactctcgctgtgagcagactctgaagtctgttaatacttgtatgtccctcttttgaggttatttctattgcatcaaaaaggtatatgcatttgagcatgaatttggaaataagtgtctcaagtagcatagaaaagttaatttttttaatgttttgttgccatgttgtcagattgatcacaaatctgatagtctacttttcttagtttgttttgtgccgctgtaacagattaccacagactgggtaatttataagtagaaaggtattggcttatgatctggaggctggcaagtgcaatatcaaggggcattcttgctgcgtcatcccgtggcagaagggcagagagtggatgagagagacaaaggggacctaactcattcttttacacataacccactgccgcaataatgacgtaaattcattcatgagggtggggccctcatagcccaataacttctcattaggcctcacctcccaatactgttgcattgggaattaagtttccagcacatgattttgggggtacacattcaaacccatagcattctggctgccgtctctagaatttatgtccttcttacatgcaaaatgtatttatttcatcccaatagcccagcattttaacttgttccagcaccaactcgaaagtccaaagtctcatctaaacatcatttgggaaaaattcaagacacgattcatcctaaggcaaattccccttcagctatgggcctgtgaaatcaaaacaagttatctacttgtaaaatacaatggtggaacaggcgtgggataaacattcccattccaaaagagagaaataggaaagaacagggtaactggtcccaagtaagtccaaaacccaacagggcaaacaagatcaaatcgtaatgctccagataatctttcttgactccatggcctgagtcctgggtacgctggggtgggggttggacctccaaggcctctgggagccccagccttgtggctttgttggtctcagtccacctggctgctctcgcgagttggagttctgtgcctgtaacttccttaggctggtgttacatgctggtagctttacagttccggagtctttgtggcagctgtatcaccgcaatgagtctctgcctaccccccgccacctcccaccctgtcccgggctatttgtgacatcctttgaaatctagttggaagaagccatgttctcatggctcttgcattctgcacacttgcagaattagagcaccacgtggacaccaccaaggtttacagcctatatcttccggagcggtagcttgagctgcacctggactggccggagccacagctgtgctggctgaggaatgctaaggggagcagagacttgtggcagcacagggcaatgaatggtgacctcgagcacctctctggaaacgttggcctcaaggtctcagcttgcctggaggatttctgaaatgccttcagggtcattctcccattgtcttaagggacagaacctggcttccttctaaccatactactctgtgtatcaaagggtcaattgtctgcactcttgcacactttttcattctttatatggtaaggctggggacttaaaaaattttttttgttctgtttcccttttagttatacaatctgtctttaaatcatttttctcttcccttgttttactctatgtagttaaaagaagccatgcaattcttttaatattttgcttagaaatttcttccaccagatgtcctagctcatggcttgtaaattttgccttcataaagccagaggacacagacacatttcagccaagttctttgccactttgtaacaaggatagccttcactccagtttccagtggtatgttcctcatttccatctgagacctcatcagaatggcctttactgtccatatttccacaattgttctgatcacaaccatgttacaggtaatctctaagaagttctagacttcccccacagctcttctcttctgaggcctcaccactgtttctttaacactccattcacagaagtctaggctttttctagcatgcacctccagattcttccagcctctactcattacctagttccaaagctttttccacattttcaggtgtttgtataagcatcatcccacttctctggtacccattttctgtcctagtcctttttgtgctgctatgacagagtacctaagactgggtaatttataacaaatttattggctcatggttctggaggctggggagtccaagatcaaggggttgtgacctggtgagggtcttcttgctatgtcatcacgtagtggatgggtaaagagagagcaagagagagaccaaagggactgaactcgtgcttctatgtggaacacacttccacgataacacactcactcctctgataatggcattaatccatttacttcacctcatggcctaatcaccccaccttttaacactgttgcactggggattaaattaccaaaatgtgcttttggtggacacgttaaaagcacagcagcactgttacaggaatgctgcaaaatcttgccatgaattttattatgtgcacatggaatgatcttcctgtcgatgctgagtattatagaatttattttgctttacacatcaccacagcaaacagacttagttttttttttcccctcatctgccatctcataggttaagcacatttctgaggcatttggcatgtgagtctggtatattgttgctataacttaaagccttttcagtaaattggtaagccttaggacagcttcaacagaaagaggagacttgctttgaaatacattttttgattttttgctaatttgctaagcatcatgagtttgactgctgaccttgaactagaccactttagctgcctattggcacccacaagagcgagcaagaaagcacactgagacaaacccctatactggaaagccatgcaaagccgtgtaagttctaatccatctcagtgtaagaggtcttacttcttttctcctgttctcttttgggtattagctccttgttattcaaagaatatccttgggtttggtgattagtgttcctgatagagctttgtaagtgctaagctttcaccaaatttgtttctatttgaaacacttgcctaatgggctaacattgattaggataaaaaattgcataaccatccagctatattatataaatcttaagtattttaggtagaaggaaattacttcagaaaaaaaaattccagtgcattttagtcaagctaaggtgcttccaacaattttacgtcagtactaagactagtgagatgttggagatgatcatgtgtaatttaatacgctgcatctctgatatctcagaactgtctgccaggtattttgggtgcagagataatgttagagtgccactgaacattttgttttcagaaatatttgcatatagagaaacagttatgttaaaaggggttacatttctttttaaaagttgcaagtttttaaatgtaaaaatcatggaaaacttggaaaaaatgcaataacgtgaagataaaatgaaatctcatcccgtgagttaagctctagtggtgagtcaactttgaatttcaattatttttctggaaaatcgtttttcatagtcattgttcaggtatagcagtagaatgtgggagctcttaagatgaaacacgaaccagacaaattgacaggcagtagagagcgtgtaattagaaagactgtagctttagtgtgtcccagctagtgatctctgaggattttagtcaaagacgtaacttctctgggtgtcagtttcttatcttgaaggcaaaggggatttggaaaatggtgctgttggtaaagccaaatgaaagctatcgagcatgaggatgcctggtctcacccatcctgtcttaaccatttgatttgcatttcatcagagcatatgtaatatctatgtggtggttaagggatggttattcttgaggttggccttgttaactgaaaaaccaaactctaaaatattttagaggtgtattatgatccagtatgagtaactgcagccccaggaaacacaaaaccaagaagccttgagtaagtgtgcccgaggcaggcggattagtttagttttatacattttagagaggcagaagttacaaggaggtataaatcaatatatagggcttttacattggtttggcccaaaaagacaggctattttgaagtgggggctcacaggtataggcgggttaagagattctgtattttattttatttattttgagacagggtctctctctgtcacacaggctggagtgcagtggcacaattgccactcactgcagccttgacctccctggctttagagattttttactttgtaattggttaaaggagtaaatctttgtgtaaaactttggagtcagcagaaaggaatctaagttatgacaaggaagtctgttcaccaatacactgggtcagaatgacttggagggatgtgacttagctcctgtctggcacgaccctaggtcctgtttatgatctctgttttaatattaacgttggtcagttgtgtctaaattccaaaagagaaagtatagtgaggcatgtccaatctcctttcacatcactgctgggaactcagcttttcaggtttctctggggttccgtttggccaagagggggcccactcagttgggggacttaggatatttatttatttatgagacagagtctcgctctgtcacccaggctggagtgcagtggtgtgatctcaactcactgtaacctccacctcctaggttcaagtgattcttgtgcttcagccaccatagtagctgggattacaggcgtgtagctaatttttgtatttttagtagagacggggtttcaccatgctgcgcaggctagtcttgaacgcctggcgtcaaatgatccagccaccttggcttcccaaagtgttgggtacaggcatgagccactgcacccaacccaaatttcatttttagtttatagcctccccttacttctcctctgccatttttgatctttttcatccagatggcttcttttttttttttttttttttttttgagatggagtcttctctgtcacccaggctggagtgcagtggtacgatccactgcaacttccgcctcctgggttcaagtgagtcttctgccttagcctcccaactagctgggattacaggagtgtgccaccacgcccagctaattttttgtatttttagtagagacagggtttcaccatgttggcccgactggtcttgaactcctgatctcaagtgatccacctgtctcggcctcccaaagtgctgggattacaggcatgagctaccactccactcaaatccaggtggctttactctctcaccgtggtgaatacttcatcgtgtgtgagatttcatttattttaaacaggagtttcatggagaattacatgttttaaaaccatagacctaggagtttgtataccttttattttaggtagaaaggattgctgtcttcctattaatactttccgtttgaaacagaagggtgaaatgaatgagaattttggtgaagagaaggcagagtggagaacaggatacagcaggctagagaattgagttgtgcatggcacgtctgttttctgagcctattcttttcactcccaccgcctataaccttcccccagatgaaattccctttatcctcctccagttacaccatttaatttgaataaaatacctgtgttcaacttaaaagtatttttcaagcgcagttgacttttcacctttgcaggggtctaggttttgttattactgagttaccgtcaagacccctcacagctgcctcatcgtgctctgtggctgggagtgtataccacactgggttcacatcaccattcagaaattaaccacacagtggacttaggcgtttagggctttagtctacaaacagcatgtattgcttattaatttgttctcataaacaatttaaaagatatttgtttttcctgcagtttttgaatctaacttaaatattaagtttttttttcttggtagttcaccaaatctctgcattttgctaatcgttttttctataaagtaatttttaaagttctcagcagtaatattaaagccacgtgagctatgtccagcatcccatttgttataaaacaagaacctttgactaatgggaaattctcagtcagcaaagacattttgaaatttgtaactatgatttttctgtattcttccaagactggtagtttgaaattttaggctgcttaggagtttacagatagtatgacctctttgttctgcagtaagagtcaagatgctaccttaaaacctttgctgtcttccttccccgccttgctcctgagttttaagtcgtggctgcaccagagatgtctctccgtggagctggtcctcactgtgttctcatgtgctttttctgggaatgctctgcacacgctgtccggatgcagataacaggaggcgcagggttcgtgggctcccatctaactgacaaactcatgatggacggccacgaggtgaccgtggtggacaatttcttcacgggcaggaagagaaacgtggagcactggatcggacatgagaacttcgagttgattaaccacgacgtggtggagcccctctacatcgagggtgagtgaaaactgcacattgttattattcagagctccgcaggtggccttgccagagctgcgggattcctgagggtaagctgtttgactcagcacattgaaagctatgttgggttttatttttgaaatgtctcaatatgtatgaggtgccgtcctagtctgtgtgataacgagtggttataacagtgtgaatagccgtcttctctcctacgtggcacccctggtcctgaacttcatggacctgttgaagtaactttcctgtagtacacatctgctgtggtctgaatgttggtgtcaccccaaattcatatgttggcatcccaagccccacagtgatggtattaggaggtggggcctttggaggtgatgagttcatggagacagagtcgtcacaaatgagattagtgtttttataaaagaggcctgggaaaaccccgttggcctttccaccgtgtgaggacgtggcgagaagatgcatatatgaaccaggaagcaggtcctcaccagcacccaatctgccaaccccttgatcttgctaatttgatagaaaaccattggttcaatgtacatttctttggttactaaatatggttagaatttaacatgttaattcaccagagaaataccaatggttttgttagtccattttaaaaatattcttttagtatgagttctttgtaataggaatgttaactgttgggcttgtatttagcatttttcccacaaaggcaaaaagtttttgccttttcgtttgagtgacattttataacatagtttcatctgttcatattcttcttgctgtttcttctgttctctttctgctctaaccgttccaagatgagatgaatatttaatctaatatttagaaagcagccatggtgttaattttgttggttggttttttgcttcatttttaaacgtttaattatgtaatctgtttaggattcattttggagtgaagctgtagtttttgtaaagtataacaggctatgtagattatagctcagtgggctcactttcctcttggatttcctcctgggattgctgtggggttaactgaggtcatacatgtgacagggcctggcaagcagattctcacagttccctgctaagatgccctttcccattgttcaacccaagatgctaggtggtgctgtcacaggactttgctgatagaatcaaggttatgaaccagctggctttaaaatgaggatgatcctggattatctgggtgtgcccccacatagtcacatgaaccgtcaaaggcagcaacagagaatggaagagtcaggtagagagactgggtagaagagataccgcggggagaccaggcagaagggaagctggagaggtttgcagtgtgcaagggacctgacctaccctggctggctttgaaggagccatgtgcgggagagtgttggcagcctctggaagctgagaatggctccctgctgagagcctgtaaggagacctcagtcctgcagcctcagggaactgaattttgctgtcatcctgaatcatcctctgaagaaaggaacacagccctgctgacaccttgatttctgcctgggggcaggcagagctgagaaccagctgagccatactgtgcccggtcctgtagacctgtcagatcggatcgtgaatggatattttttgagcctctaaatttgattaggcagcaatagaaaactactgtgaggacttagcacagcactgggccctcatttcactaagtgctgcccaaattataccttttttttttttttttttttttttttttttgagacggagtctctctctgttgcccaggctggagtgcagtggcacgatctcagctcattgcaagctctgcctcccgggttcacgccattctcctgcctcagcctcctgagtagctgggactacaggcacttgccaccatgctgggctgattttttgtattttttagtagagacggggtttcaccctgttagccaggatggtctccatctcctgccctcatgatccgcccaccttgacctcccccaaatgatacctattaatattactactctcttctcttttttagcacatggcaagaaacatttattttatgacactattgtttatataatttcagtaccactgagaagccagaacttagtaaaaatggtgttttaataagtaaattatcttctttaactgcgagctttgataccaaagctgctctaggccatttctgccaattctgtgactgtgtgtaggacacacacacacacacacacacatacatgcaaacacacacacccacacacccacacattgaatgaagtcatacaataaatgactggtgctttgtcctttgctcagagtattgcgttccctcagttggcatttatgttgggagagcataagatgcttctctgcctctgtggtttgaagcctgtttttcactttctccttcagcgggtcctcaaccttggcatcaggtcttctgtgcccttgataatttcccccttgctgccctccatctcttcactctttctgccctcacaatgcccacttcatccaacaatgccagaatgcaccttcctttgaagcccacatggaacattctccaagactgatcatattctcagccataaaagacacctcagccaacctgaaagaatagagtgctataaagtgtcctctcagaccagagtggaattacactagaaattagtaacagaaagatatctggaaaattacaaaaatatttagtgatgaaacaacaaacttctacataagatatgagacaaaggaaaaatctcaagagagattaaacatactttgaactaaatgaaagaattaggtttcttgtttatatatttgataaagaatgagatggaagagaatctgaaatatttttctcttttcaaaagaaacttttttcctgatgatgaaaataatacatacatgttaaagaaaatatagaaaggtattttacaaagcaaatagaaaattatttttaatctttctataaactgttgaggaagttggctgggcatggtggctcacacctataatcccagcactttgggaggccaaggagggtggatcatttgagctcaggagtttcagtccagcctgggcaacgcggtgaaacccagtctctaccaaaaatacaaaaagttagctgggcatgcttgtgcatgtctgtggtcgcagctattcaggaggctgaggcatgagaatcgctagaacccagaatgtggaggttgcagtgagccaagatagtgccgttgcactccagcctgggtgacagaataagacctcatctcaaaaaaaaaaaccaaaaaaaaaacactgaagctaacatccagttgttttcctaaatgtgattttttttccaattaaaaacatgcttaataggtaatatggttatatggttcaattattttaaaaaataaatggaaaagatggccgggcacagtggatcatgtctgtaatcccagtactttgggaggctgaggcaggcagatcgcttgagcctaggagttccagaccagcctgggcaacatggcgaaaccctgtctctacaaaaattacccaggcatggtggcatgcacctgtggtcccagctacccaggaggctgaggtgggaggattacttgagcccaggaagttgaggctgcagtgagccatgactgcaccgcactccagcctgggtgacagagtaagaccctgtctcaaaaataaataaataaacataaaaatggaaaagataaaactgtaaagttaaagtcttcctcttgccagttctcagctctcctcaggaaacagctgttgatcctttctttgtattcatctgcagtgtttgtatgtgacccagctaacacaaataggtatttatagttctccctttttatataacctattatgtattgtcctgaatcttattttcttccacttactgtgtcctggtgatctttctatatcatatatagagaccttttttggcagctgcttagtgttccattttgtggctatactagctagatctctttaccaagacacgggttttcccttcagcattacttgttagcaagtcgtcttcttatgaatatgttgtaatttccttagtcctgtgttgttggatctttaggttgattgcagtttggggccatcataaaccatgcttcagaaagccacacatctgtgtctctgtcatcattttcatggtacactggctttcccagggtcctgctacagagcacctgtgcttccctgaaatgctgtcccaatttacttttccaccgtctgtataaacagggatcttgagaccagcttttccatggggaacaggaaaaggcagaaatgtgcattgtgtcgtgggaagaccagtaccgggaacttgtagtatctctgttgaagaggtccaggaaaataaaagaagaaagtgaccatagctaacacttaactatattccaaatgctattctaatcgctgtttatggttggcaagtttaattatgtcaatacccgtgcgaagtaggcagctattttcttcattttataggtgaggaaaccaaggcatggagccctttccattacctgccttttacctggatgctcagttgctatggagggccgggggtgggggcaccaggagagggaagatgggagagccaagccatcaaccctgggcacccaccctaaagaggaggggtggaaacagtgtttgccaaggggattgagtccatgtttatgtagacatttaaagcatgcagctctgattagaatatttttgttgaagtatcatttagaaatttttttctcagctttcagtttatattgcaaatgtaaataaaactgcagtggtggctcttagagatcgccctctgtttaatttggagctgttggaggcttcctatggagcagcctaggacactgaaaattctttcccctgcggtggcttcacagggaaggtgagcccctcgctcagaacagtcgacagcactggcgggcaaccccagctcccgggggctgagccagtctctagtgtgtgcagcctttgccctaagtaaatacatttgacatgaaatgaagggaaaatcttgctgttctgcttctttgtgccgagagaaatttggtctttatactttgagaagttctgtatcttcttcattcctgttttccatcctaaatactggttctagagacaaagactagggccatgctgtgagacttcacattgcagagagggacatctcgttggggagtatttctgtaagacctctgactcaagtgtagaaaaagagaattctactgtaagtatcttttatgatgggaatttagtatgtgctaaataatcgcgtgagttatcacagaaagaactaacccactgttttgcgttttagtgtttctatagtctttagtttcatggtacaaatcctgaactggtccttggcagtttcatacagcatgggtgtggcacagaatgaggcttgacacagactatgtcactaacttaagacaaaattaaaaaagaaaatcaacaaaggagtggaagctacagtcagtttttatgtggatttcccctttggtagaagaaaatgtcgatttctccgatgtgttctgaacagtggtttcaggttatcccgagttgttctcctcctatggtgatttttttcttccctatgtatgtgtcatttatgtgggttttgggcacagtgaaattcaacctaagaccctttagggagttcatttgtggtttgactggttgagtttccccagtcaggattcatagaagggccgagtaagtcgcagctgtgccctcacccagccacttcccaacataagattaccctgcatgctctctggtaggaatgctgctgatcattaattggagctcttttaggctcatttcttgagacttctatttttctagctgagctcccagcacgtggccttgtaaatgtgaaaggtcgtggcagggtctctagcggtctctggagcaactgtgggcacccatgaatgggctgcctttctgtccccctttgacttcctctccccacctcagcttggattttggaacgtcaggctcatgcttggtgtactctgaactgtgcagttgacatgttcccagggcctttgtcctgggctgtgagggttaaccttgctgctttatttatattccgaagccggttgttattaatgttacttactgtttacctagcacctctcattgctggttatttgtccctgctctgaatttcccctcttctctccccttcagaatttctcaccagattatttaaccaacagactctgctgcagtgccctttttaggataggaactggagttattgttaatgttacaggaagaacacattctcaaaggagaggggggtggtgggaaactttgattttcatagggttttcagtttcctctcaaatgggaggatgcagcagtgccgctacttaactgaacgtctcgacagtctgatggggcggccctcagccttccggagcagcagtgggactgacctgtccagtgaggaagaaacactgaaccagatggaatggcctttggggatggaaaaaccccagtttacgctcatctcttctctcagctaacttttgtggagccctgttcccaaactggcctgggccagagcaccgtggaggggtatttgttgtaaatggaaggtttccaggcccgcctggaaatcctgaagggtgagacctgcagtgggctcaggagtctgcatttgtgggtgaccgagggggcctcccctccctctagagtccacactgtggagagcatcaggaagggaaaggcctgcatcttgtgctcagtgagctcatcgtctagtgaggaaggcatgtgtgaatctctggacaaggcagcgctgagctgttgtggactagtggtgcaggcaagggattatttctgaccaaggatggtgagaaggtttcccatacagactgacgtctggattgagctttgaagaagaaagccaggactggagcagacgacgaggagggaagagtgtgaggttaatgatagtggctttctgtttgatgtcggagaggcttcctgtactctcaaggcacacttcttccctcttagcctttaatgcagtttcctgtctttccctgcataccttgtcacctcaagagtaaagataatgatgaataatttgttgtgtaagatcacagcccatacagagttgtttatactctctttgaggaatgtagggtgaccctgtctgtgtaagcagaaatgcccgtgagtataagtcaggtggcagcaggctccaggtctagcacacctgagcgggctctgtggtgtcgtactcggctctgaaggtctggccaggttcattttttaaaattttaattttaatttttaaattttatttatttttttgagacggagttttgctcttgttgtccatgctgcggtgcaatggtgccatcttggttcactgcaacctctgcctcccaggttcaagtgattctcctgcctcaccttcccaagtagctgggattacaggtgcctgccaccacacctagctatttttttttttttatatttttagtagagacgggtttcaccatgttggccaggctggattcgaactcctgacctcaggtgatccacccacctcggcctcccaaagtgctaggattacaggtgtgagccattgtgcctggccctcatttggttttcaacttggcacagtcctgctccaaagtggcagtgggtatgaggaggaatcttcagaggaggcagcacagtgcctgtttctggggctaatggtctgctgcttctacctgcagccctggagcttggaagtaggtgtagcaggaactgacccggtctgtgctgatcctagctggaaactgcaaaagatagcttggccttagaattatgggactttgtgagaactgatttttaaaaggtatcttgttaaattacaatttgtataatacaatattagtttgtcttttatttttagctgtttttcagctcagaataacttgtgggggtgggaacagcagtcgcaggatttccttttacttggacagatcctctcagcgaacttgcattttgacagaccatcaataattttaaagattttgtgttttgttagttctctttacaaaaagattattcttcccataagcattggttctatttctaaattaactcactggttttcagacttggctttctttttttttttttttttttttgtgtgtgttcttgacttctccattctttttttttttctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtgtttctagttctagatccctgaggaatcgccacactgacttccaccatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcactgtagattctggatattagccctttgtcagatgagtaggttgcgaaaattttctcccatgttgtaagttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttaatgagagtttttagcatgaagggttgttgaattttgtcaaaggctttttctgcatctattgagataatcatgtggtttttgtctttggctctgtttatatgctggattacatttattgatttgcgtatattgaaccagccttgcatcgcagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactattgattattgccacaatttcagaacctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaaccagctcctggattcattgattttttgaagggttttttgtgtctctatttccttcagttctgctctgattttagttatttcttgccttctgctagcttttgaatatgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaatattttttccttcatttcaactttggtgaatctgacaattatgtgtcttggagttgctcttctcgaggagaatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcggccgcccctcccccagcctcgttgccgccttgcagtttgatctcagactgctgtgctagcaatcagcgagattccatgggcgtaggaccctctcagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccggaacctcagatggaaatgcagaaatcacccgtcttctgcgtcgctcacgctgggagctgtagactggagctgttcctattcggccatcttggctcctcccccccagacttggctttcaaatgttaaaaaaaatatatatatatgaatgaaggtctagagtctcccagcctgcttcagggtgttggggacccaggcatcacctcactgggtgactagtgcacagtcaggattgattgagaacctccagactgacctgctgtggctcaaggcttgatcttcagctcttccattcccggcactgggaaaggaaagacagcagcagttccctggtcaggggagcccggaaggcccgggcagaggggcccctgcaagtattcttacacatccatgtgcaagggaggactcattttggcagcagagctttcagatccctgttcttcactcctgtggatggtggatgtgtttcctcaccattggctaaaagtagaatggcatgacatggactttgtctggaaggatggcattcctcctgtgtgtgtgtgtctgttgctgccattccacagggagaggttggtccccgaggacttctctgctatgtgcagatgttacctgacttggttctgtgctggaacgctgtgggtagtgacgttaaagtgaatgcctttccaggaggggcaggggttgcatggaatctgaattgctttgccattcatggctttaaaaacctccctccctccctcgccatggtctcagggtctggttttatgtatacaggatgcataaaaacaaacgagaggctactttctcccatagttctgtgtctttggtttaagtcatatttgcctcacaaactaaaaaaaaaaaaaattcatgattaattctgtgtctgaaaaaaatcagtcttccttctgatttgaatgctctatctgggacaaatatttcagaaaacaatcaactcagtaatcgaattgactctggttacacgagaacagactcagctgacccagcacatgtttttgtttccaaataattagactttctatttttgtttaacattttcctaattacaaatgtaaattagtttatatgaagaataaaataacttgatttcagtgaaagatatactaatacgtttattatacagtatatatcctaggaggtcagtatttttttggtgcttttttgaagtaataggcttctgttttgtctcctttagttgaccagatataccatctggcatctccagcctcccctccaaactacatgtataatcctatcaagacattaaagaccaatacgattgggacattaaacatgttgggtaagttgtcattttcttgtttttttggctgttgctgggaatattttagatgattacaagcataggtcattgaatcttctactagagtttgatctgagtgtgttccctcgtcccttattgccctgcttgtggtatttggcagttttgcagtgttatttcagtgtgacttttatttgtcatcagagtatgtcatggaggagatggtctaacttaacttttcatgcattgtagtaatcaggctgcagcaccctggtgcagatcccctgggagtgaccacaggcgcttcatgtgaccaaccacccagcctgcccccctcccctcctctgaaaccagttgatgaatgctgaggataagtggcatgcctcatgctggaaagaggcagtggtggctctgatccccaggttgggttgacatggccttacacacgggggtgattcagtagcactccttgaaggaatggatggagacatctgtatggggtgttatcaagactgagtacctgccctagattggacttcagggttcgcattagtaaaagatggacgagagagcattgttaatggtggtcatatgtgtatattcacaaatgacatgccttagatttatagcagtgggtaatgtgcacatattaatgtttaaaattagaggcatgcttaaatttggcacagttttttcaaaaaactccaggggttttgattatttgcaaagtggaagaaaggaaccacttttaaaaatggcaagtaaatgatggatttaagtataggaacatttaatacaggttctgcaaatagacttgggacatacagcactaaattttaatttgaacaaagcgtggagtcgagaatgaaaggacagccagagattggtttatctcttagatgcaatattttagggggtggtactagtcaaggttctacagaagaacagaaccaataggatgtgtagagatttagagaaagagatttgttacgagagattggctcacatgattatggaggtcaagaagtcccaccgtctgccttctgcaagcaagaaagagaaccaagaaagccaggggtgtagttccaaggcctgagaaccagagagccgagggcagatcgatgttctgtgtaagcagttgaccttcctccatctttgtgttctagtcaagcctgtaagggactggatgatacatccacgttggggagggccatgtgttctacgcagtctacacattcaaattatcctctcttccggaaacaccttcacagatacccccggacataatgttcaaccagatacctgggcatcctgtggcctaagttgacacataaaatgaaccatcacaggggacaggttgtttggagtaagatgattcattcttcctatctggaaagagctttatcttctttgttaccgtctcctgctctggtcaccagacagaacagggtgctgctgcttctgcttagaggtgtgcgtgatgccctcttcttgccatcacaagcgcctacccctcctacactctctctgtcccgcccccctccatcataccagaactagaccatagaggaaaagatcatgcacttggtgtttagggagattccgtttattcttcctactcgggggatgcagtcactgtgcccgtgggtcctgtcactggggcagattcagatggggttaccctcaggctcttctgcacttggtgccctatgggggttgggggctgctgaacgggcacaagcgtcgatgatacctagtaggaaaggaaagtctcccaaagagaggcctcagcaaagtgctgttagagttaaaggcaaaaatgactcgagctagggcttgagctatgactgagattgaatgtggaggccttgcaggaatggtaaagagtcttccaggagagatacaaaaggcaaagggagaccattggtaggctggaaagaaacccaaattggactttgtattctgaaccgagaggcgctgtcattagccatcttgcacttgagacaagatgccatgaactttgcctggctttttcctggtgaggccctttcctctatgtaacttgcccacctcccagaccctgtgctagagttctttctctgatgaaagtttttcgtaacccccagacactacagcagcaggatagctcccttggcttcactccctgacagttgtctctgtagatcctgcgtgagtcattccatgaaagtgctacagaaatagtcttagtttcaaaatctttaaactcagttgtttttgaaatataacacattgcatttgtgatgtgtgtttgtgaccaaagttcagagaaaactataaactagaaagaactcaggtaggggggaatataaaatgtatagttactctggaaaacagtttgacgctttcttaaaaaactaagtatgcatctactgtaagactcagtaattgtattcttgggcatttctcccagagaaatgaaaatttatgttcacatgaaaacctgtgtgaatgttcatagcagctttacttgtagaggtcaaaaatgagaagcaaccagaatgtcctatcataggtgaatgattaacggcagtgcatacatatatccccgggaattctacacagcaatagattaggaaggaactttgatacacactgcagcttggatagattttgagggaaatatgctccatgaaaaaattcagtcctaagaggccgtgttccatttgtgtatcatccttgaaatgacacaattatagacatggagaattggttagtggttgccaggggtcagcaggtgggagggagcgaggagaggctgtagaagggccctgtgagggatcctggtggagatggaaatgctctatcacttttatcaatggaatgtccgtttcagtggaaatagtcactgatcatatcaatgtcaatgtcctgattgtggcacaatctagttttgcaaattttagcattgggggaatctgggtaaaagatacataaggtccctatactactttgtacaattgaatttgaatgtacaaatatctcaaaaaatttaatcaggaagaaaaagatctcagagtccttcattttgaagctactacattgtctgacacactgatacccctggctgctgcacgctagaatcctaccaccccacccagcctcacccagaagcgcacataggttgcatgtgcctggctcgtctcaccctcctagcagtgcttcgtgggcatgtgttggcccctgctgttggtgggggggcagagctgaggggtgtccagcacagcccccctctagtgtagtggcgattgggggtggggtatgtcgcctgtcttaagtacagggttagtgacggtcaggggggttcttggatcctgtagtgaaccactgtacactgggactctgtgaatgagtttggaagactttccatacttacttgaccaccatagataatgatgttctggtcagttacatgtgagtggtcagtccaggaaaggggttcagagcagaattgaggaatgtgacagttgctttggaaaaggtgctgtgtaagctgaaccgcataggaggaagaagaatgagtggagagttacccagacagggtggcatgggcagttagaagagcccaggagatgttcaggaagtggcaagctgaccattgtggaagttaaggagaaaagggccttgccttctgccaaccaagggaaagttacccagtaaaatatggggtaatatttgggggcagaggagtcttcacgaaactcctcaaatcacactttatcaaactaacagattctgcgtttggccctgcttatgacaagtattcaacaaaatactggccttctgagaatccatttatgtttttcttactgtatttgttttgtttattttggtgccaaagcagacgcagtaagggtagataattggatagataattaaatgtctttaatactaaaacattgcttaaattggccagcaaaaaatgtgcctgcacatgtaaattcagtctcttttatcatgtcattgctttctgtagggctggcaaaacgagtcggtgcccgtctgctcctggcctccacatcggaggtgtatggaggtgagtaggaggctctctcaggagatgttcactccagcccttggactgttttcatcctgtctcagaagagtccagtgttcttttctgaggaggcccagcctgcccatgctcctcttgtgcacaggaggctacctgtcggcctcccgggtcgccaagctcctcttccttgtgggacagcctctcttgtttgatcacacatcactggaggtctgcaccctgtcacctggccagtaaagacccaccatttatgattccacagaagtgtttctgccattctgctctgaaaacaccccacaaatcacactatctttttacctgtttgtctagcacatgtcattcttctatgtgagtcatgcatgctgcatgcctgacctcccaagagctcatgggctggcctttaaagcttgctgggagaagagacatgcgctgactgcctcccctgttgtataacgagttctggaagaaccttaagcaggtagtgtcagaacacccacgagcttgttttaccaagctacagccttcctctccttcactgcctgagaaggagttgaggagtggggaccaggagctgtgttttcaatgtgtgttgatttctcttcagccccaaaccagctgggtgtgcaaggttcaggagaactgcttagctgatacagcggaagccaggttttagtatgatgtaatttttctattttacattattattgtggacaagagaaggaagtaagagggtaaaatcagaagagacttttttttaattaaggaaaccaaatgaaaaaaatcatagcaacagagaaattcttctaaatgcagtgatattctttgtaatctctatgaaaaggtagttcattgtctacttttttgaagtcctgggcagttattaataaaagagcagagtgtgtccctccctacctatggggtatggtatctgtccagaggggaacagtgacatctttcccacagccatcctgcttcccctactcatctcatttattatctgcatgtctgacaggagcctgtgttccttaggcttcctaaataattggagagtgtaatttatggaagtcaccaggtgctctcctctgaccttgaataaccaaagtaaacttttgtggagtatttgcttagtgtcttagcctcacagaatgctggaaaggggagatgattggaaattatttttgactctaggtctttacttttgtattaacaatgtaagctgtccctgttttattccacggtgattttgtgaggggacttatttagaagcttggcatcctgggcatttcagtccagacggtgccagtccagggacagatgggcgtacccagccttttctttcttgtcctttgtcaaatttatgaccatcttttttggagggtagcttgcccagctcttgttaaagatccccagaaaaaggtctgggatcaatcatctggtacattctgtgaatttaagtcaatggttcctttctctcaggaagtattttccttagaacttttctctcactgagtagtgagaagtttgctctttgaaagggaattttaaaccacagcagcagatacatagacctttctttgcagcacacttctgcattgctgcggaggctgtgctgacccagagggatcggctgagcagacaagtggcaggatacctgtctgtttacctccctgcacctgctcaggcccactgagtcccaagtcagacttcaggggtaagataaacaagatgggaatttataacaatgcatctttttgtccagatttcgtggcaaagacttatacattttatatcatagttgtactcaagtatgtataaaattcttggtgtactaaataaattaggtgtatattcatattccagaaatatacttgtgtgaataaaagaatttgttacgtgttttcttccaatagtctcttcccctggtatgtcttaaagtgtgattgatttatacgctagagaaacaggaattgggagtgtaaaatgagggctagaagaacaggcacccatttgccaggggcaccccgtccctccacctgccctacaggagcctccacgttgacttgtcacgggtcccagatttgttctgctgatggcacatgtcaaagtcatcatgttccagagatgctgcgtttttcattttttttcaataaatacatgatttgctccagttatcaactttataaatataaaacaaaaccacatatctcttcacatagattctatttaattgtaatttgtgtagcactctgaaagttaagaacaatttacggaagagagggaagacttaaaattgggagacctgatctttttctttttttttttcccctgtaagtaaaatattgtcattgcttaatatcatatcctactggaactcaagagaatggactggaaacctgaggttgcctctttaatacatctctccatctctaaatgggtctttccgaagttcccttttgcatcataaatatgcattattgatatgaactggaaaaaggaaagatgaaaacagtctcacttttctcccatcgtagatcctgaagtccaccctcaaagtgaggattactggggccacgtgaatccaataggacctcgggcctgctacgatgaaggcaaacgtgttgcagagaccatgtgctatgcctacatgaagcaggtatttcaccagggtctaggcttgcggtttaggcgtgctgagcaccctgacctcagatgtaaagtgttgtaaaggaatgaatgccatgactgattttgtctggggataggtgtttgggaagctcagtttcccagtattataaattaatggtattatcaacagctttttccatgtatctccttattttaaaaatgatttcctagagatcaattcttgggtttggaatactattttatggctatgaacagaatgcttcttcattgccagttgctcaccagcagctaagaagtacctcttttcctgaagcctccaaatcaatggatcttctttttttacttttctatcaattaagtaaaaaaatggatgcgttattgctgtaatttgaacctctttattgttattgatatttatttactgttatttcatgctttcttcattagtcattgttgtgctgatgatattttatgtgacagatttggtcacctgcatgttatagcagaaattgctcacagaccaagaggccgaggttgccacactggctgtgctgctgtgtgactccaagatttaagccgtcattctctcagttcttatctctgacacagggtttgtgaagcctgccctgcccatctcagggtggtgcaggagccaatgaactgtgcagagaaggtggaggcctgggcacaggatatcccattcatgttctcactgagtgtgtccttgggcttgggtctgaattttcacatcctcatgaaaatgccctctggtatagtgggacatgcaggtaaatcaacatggctgtggaacgttggtccaggacaggctgttggtagatgcagtgtctgtttctgggagcaatgctgtcaggcccagggcccagtctgcaggtgagcctggggaactgtcggctatgtgctctgtaggaggggcaagtgtcatcagcatggccagcatccaggagttttcctgactgtctgtctcaggccccggcagagccccagtcaagcatgtgccaagggccaggtctcctgttcctgaccttgggatgagagtttaatcgacttcccttcccgtggtaccacagaggacagggcaatgtaaagccaggtaggctctctgaggggtaggagagaatgtcgaggactctctttctcatcatgtgtttaatgaaatgccagcattaaagatgcataaattaaccttatgctattgtttatatttaaacttttctgctttatttcttggccagaagcagaactaattgccttctaagcgactttagtctgttggcttacattatccacttcctctatgaaatgccgatcagttttagtaggaacatactttcatcattttggggcccagaatatcttgactcaaaagtttcagatgatcttccagacacacaggaccactctgtgtgcatgggtacttaggagtactgactagagtgtcaggggtacatcattgcattttattctagaatgtgttccaggagtgatatgattctcaactgttttcttttgctttcagtcctatgattgtatttcttacctagtgaatttttatataggtaaagctggtggacaaatgggacattttgattgagcttttagttttcattaaatgattattcggctaatgtagttgataactttatgggtatacctattgccttaagtataagcttgcgataattatggtatttggcaataatagaagcagcacttcttgagcaccgactgtatgctaggtactgttctaggtatttggcaataatagaagcagcacttcttgagcaccgactgtatgctaggtactgttctaggggcctgggctccagccaggatctgcatttcacacaaatgctaacattggacccgttcgtgtcatctgtgcctgggggttccggaaggtagcacctagtaactctggaacatcagcatttaaattcctgctcacataggtctcgggagcttaatggcgtgggcagcgttgccctgaaaactgtgagtaatatacctgttagaagccccccgtgtggtcagctggttcctcctgctcaaggtagcatccctgacgtgaaccctgtcgggaaggtgtccctgtcactccgttggcatgatacgccttctatggagtcaccaggcatgtgccttccaccctggagtccctaacagacagttgcagaatggctgcaagagtcacttctgtggccaggttcacagtgtacttcacacaggggtgtcgtgggttcttcatgtgggaaccacgcttgctgctttccgtcacactgggaggcttgagaattggcccatggaagacaggtgcagcactttctaggaaggagagtgtggaacttgggctcttggccaacaggtcagtaaactgtagtttcattggggctcacactctacttagcacatgtgctgagggtttgcatctgcccaggtgagaaatggcaccgaggaaggcccacctctgggggcacgttgagggaggcatgtaagcaggtgtgatattgccaccctttcccacggaccctacccgttcccactgtgcagtcattatgtcagggaggaccgtgcccttgaccctaggggtcctggggccctgtccaattctggtggctgcgaggcagacaggaggaggttgtagtttcctgatgaggaaggaatgacgtgactaagagcagtgagcctgtgagggtcactgtggtattgcctgagctccaggaggcctgtgaagaaggtgcagtgtgttcttcccaccttccgtcccgttattcatgttgtaaatattgtgctcccttgtaggaagagccatgggtccaaggccacaagcccctctgggccctaaaattggtacctgaatactcattcccacttttttctgaatgggtgctgaggagggaggaaaatggtgcctttcctctctgcgcaaaggagcagacacctcacagctgagacaggtttcagttcctgctatggcaggatattttgccaggtatagaaaaataagacaatactgattaagcaagaaaaaagaaaaattgctatgcataatcccatctagagacaaacataagggggaaaaataaaataaaacaaacaccactatataaagattgtgagagatataaaacgttgaaatgaagacgttgagatgattctttaacccaggattttgtgacagctggcagcaagggtgggtccaagcacctcctgccacattgggtctgccctctacctgtggcttgatctggggcaaatcactggacctctttggggcaacaactccaaagtgattgttattttctgggactatgactgtgttctgagcacagcggcctgcaggatgttgtgcctttctggatgtgtcactgtctggaggtgacattgtttgaggatgctctgcgtgcctgctgtgggtgttgcgagagagcaggaactgggggctggaatgcctgctgcgtgctcagcctctgttagggctcagtccgtttaatctcagttaattccccgcagccccctcaggtgggagtggtcagcccatctcacagatgggaggatgggctccaaaactggtttccaggtccctagcccataagtggggttggaaccttcagctggctacctgtggggcctgctcctccccacactccctggctgtccctgcaggctgaagcaggtaaagaagcgtgagtgagcaagaggagaccatgcagctccaagtccaaaggcgccaaggctcctttgcagctcgcacagttgtgggacagtgcccagaatgagtggttcatgcgcctgcagtagcatcacccctgcacctctcagctgggagattcagcaacaggagctgcactgtgaccttgtcagtttatagttctaaatgtgtgatcttttgagatagtttggggagaaaatttaaaactttgtgtgttaggatttatgctatctggagacaaataaaatcaaggaggatgaaccaggtggaatagtacgtctggcatatttttaattcattattttaacaactttaattaattccttatacataataacatatcccccttaagtataaattgtgattttattgtcaagatcctatatagtatgtggatatgtcttactctgaataatatgtaaagattgaaaatataaacaagatagatgtaggaataatttttttatagaaaaatttctcttttcctaaggattctcttctgagtttctttaatgaatgaaatgtcctaatgtagtcaaaatagaattttactttccagaaaaatctaccacacaccccttagaaaaagagaagctccctggaattttttttcgtgggatggagtgagatggaggttgagatcaaagggcagagcctttcccgaatagttagaacttgccagggaggaattaaattgccgcctctgtgtgcatttggactcagtggcttgataaatgtgggggcctctcccgtaggctgcggtcagtgcttagtgtgcatttgagttcgccccctcatgagtctgactctgaggtctgtggcccacccactgggctggatctgcaaaacaagcctccattcataaaaccagcaaatggcagagtggaaagaaagcaaactcagaaatcacctagtctaatggccctgaaggtatggttttgttttagttcctggcatcaaagtacttttgaaaaagtcggagttggtatatatattctacctgagttggaaaaaaaaaaaaaaagtaagcagccaaaccaggtgcagtgttccatggctaggactcacaccccaggaggcccgtcctgtcctctggacctgcccagtagcagcttggcttcctggccctgtgactcactgggtgcctgctggccacatcccaggtgtcccacctagacactggcagagtgatatccacccctcctggcctgctgcagagcaaacctcaggaaggtcagctgattgttgatgctgaagcaggagtgctgaggaagatggccaaacagatgcagacacacccctcctggacccccttcctcagccaacccctcgagtcaacttgaaccttttagcacctttgagaatcgtgcttcagcacagtgagctgtgcattctgcagtcgccttagttttatccacaggtagggagcagaacccatcgagatgtatgcatgacaggccctaggggagttagggggttcagccctcacagcctgactccgttgctttagggatgtgcatatacttctctgagagaagcgtcagagagagcctgggctgctgtaccttggtgcacttcctggcatttctccattccattccctacaggtgaatatgcccaggcacctccttcaggacctgctcccactatgcagggctctgttccaccttctatcaatagaaccttccgtcagcgaatatagtgatcacgttacagtgttcggtggcttgatatagcacagtaagtcatcacttaacaccatcagcaggttcttggaaactgctactttaagcagaaggacatagaacaaaatcagcagtaccacaggctaattgctataacaagagttaagttcccaggcatatttctggtcacaaaaacatcaccaaaattctaaataaagactaaaacacttctaatattaaggatttgaaataaatgtgagctatccacctaaggaagattaataaaagcaagataattattgacaggctctcaggtggccagagcctatcgcagcagctccaggttccaggcagcagcctgccctggacagtatgccaacctctcacagggcgtactcactcacactgggaccactggaacagcccacttgtctgacatgcacagctttgggatgtgagaggagaccagaatacctggagaaaacccacacagacgtggggagaggagaacatgccagctgcgtgcagacagtagccccagccaggaggtgattttttttctcatcagtattatcatgaaatgatattatttggggacctgttgtactctccactgaatggttgcattttaaaagaaattttgagggagaacccatgtgtcgtgagcagggcaaggtcagacataaccaggtccatgaacgtttgtgtctttccacaaggtcaggcttttattgatactatttccatcataaaatccatgtgctccatgcagtttcccagaaggaacttcttagtgttttccattcactcggtaatcagagctgtggtcacacaggctcaagccactccacagctcagtcagtactgcaaaccatacctagtagtgtacttaatatataaatgtttagattaagcagtccacatcaaacagagtaacatttaacatcaagagacacggggagaggaaaaggggttaatgaactagtccaaggacagtgacatggacaaagagagggtcctgggcttatctggacaggcagcatcatcttgcatggaagagcccttgatttgggcagtctttggcggcagatgctgggtgctgatcatgagtgacagcaagatggagtctgtcaagatggccatctcgagttgtagaagtcctgctcattaccgcccttgagtcctttggtgaggactgacagtaaagggttatgcccttaatctggttgggtgttgtctctgttgattatgcaaatatctggaccgtgttggctggatgccttttgaaatgtgaaatggagtcattttctaagataaaatcacttctgtcagaggtgctctgtacaccgtgtaatccctgctggtaacatttctgtccttgggagatatctggggagggaggaatccctgtaccttcattactcctcttgggtcacctcttgcctgtcaggcctgctgttagttggctccacgtctcaggacctgcatacccaagccctcacccctctctcagctgctacgaatgaggcaaggaggcgtttgatgccagttacactgttccagcctagttcgtgtttccaaagggcctttgggagcctcagcctgttccttgcaatcctagtgtccttgtggcaatgtttgtgagctattccacacgtggtcactgtcacttcaaagtaaattagtgtcatcagaaaactggggacagaggtcaagggcaattactgggttgagaaccatcccttggaggtagataataatgatggcagttttcaaaatagtttcagtgttttaacccctgtgttgtaggtggaatggatattattgtcctcatctcaaagattaggatcttaagtcttagaaactgaagtgacttccttgggataatgaatcccaggatgagacgaggccatccaggcattccagcctccaccctttgcaggtccctcagcatccatcctaagtttccattggttctatgttggtgcagctcaggcttgtaggagttgtcttgaccttcctgatgcttggagctgtccatgactcatgggccaccataggggacaaaaccacagagcataaagtgaaatccagccatgcctaggatgaatcagcagttagctttctgactgacagctttgtctatgctcaaaggcaccagctcagtgtcagcagggcctgaccactcgcaggcagaacattgtgtgggagtcaggggttcatgaatgtgtttgcttcttggtccttcagaggtgggctcttccttaaatgagacagcgttgcctggtgtgtacttcctgggttttcagcctggttcttcccttcttaggaaggtggctttgggtcagaccctggaccttgcctcagatctgagatgaggaatacctttctccaatccatgcatgtgggtggcaactgaactgccaccatcaacagtggtgtcagcatccatcgactgtccccctgcctgcccacatggtcccaccgtgaggaccagtgagaatgaggattcagcagcaagtggactatacatattgactgggggtcgcctttgtgtgaaggccaagggttccctgatgctacctagaaagggatagatgggcatacaaactccagaagacaccatcatcccagaggagagcagggcttaactggagtgagcctcgggttcctgtctatttcatgtaaggagtttaggcttcatgagtagcttgtcttattggtgtagaccagccttgagagctcgtgttcttggaagtgttgttgcactcaacggctgttgcacctgtatagaagggctgccctctgttgctgaaccattacaggcccaaatagaaaagccacagcaagcaagcctgtttatgggttggacacttaatgtctgctgatcctaatgaggccatgttccggaatattgttttgtggaaagggaacgtcaagaagataaaagcatttgatttgctgcaaattttgcctaacccattgagcttttcccctgccaggcacattgcgttgattattgtaaatttgctgaggtttttccagtcttttcctagaataaagccacatccattcactttctttcctcatcttatcaattaaatgcaagtgggtacttctgagtcattttctgttgagagcagcatctctgctccccaccctttttaatacactcattagttcggtggagaaaagggttgatttattcttggacttagctcatatctttgtcctgagtatctgagtggctcacgtgaagtattacagtgtattactaggaagaattagcacaaataaagcactctggcttctaaaagttaactgtgtgcttccatgcctctcaccctttttcatatcacagcacacttaaaaacccgcctgggtttgtggaacaccctagggaaattgacaagcctgctgtgggccgaggtggcggccgtgtcactccagccactgagagggctgatggggcctctggggctcgtggttcatgccctttaactcgctatactggtggagaaattctgtgctaagtaagccttgttagctaagggttcattggattcccattcccaacccatgccagcctaaggtgttggccgaaattgaaaaaagaactgtttcagctggtagtgataactggcaccaaatacagccactgggcctgtgcttcagtcttagaacactgaggcggtcaggtgagtactgcttctttcccagtcttgctgcgaccgagtcagtggcaggcctgggcagtgagcggtggagcgggaacggcggacacatgggcgcagtgagaagcagagcccaggtcctcacgccccaggctccctgccctcaggtgcccagaaagtgcacgtttgttctgcagtggatcaaacattagatacgtatacactgtaaaagcccactaattcagagtttgtgataaaaacatttaatttttccatccatggcaaagcagtctgtgaagttaataattaacacgatcacttagagcaggcttttgttattcaagtatgcacttccatgattgcatatttgaaaacaggcttttctggattacaaaagtaatacatgttcattgtagtaaaaatagaagcattaaaaatacttgaaaatgaacatagaggtgaaaatgaacaggagggatgactatttaaacagtgtcagtatgtttctctttccaggccattagctaataacctatactgggcactaagttgtatttagtttctcactaaaacagatgttttttagtaaaatagattgggagtgtagatgcaagctcactcagtaagaacgtttctgtgtccccttttcctaagatagagagctttcttgtatttctccctagctattaaatattcattgacatctaaatctctattgagtgattaatttgcacaatatattatgtgaaaaagattagaaaagcatattcataacatgatcccattttggaaaatatatatttaactgggaaaaaaaattatataaatacacgtttttcctccttgtactgtttggctggttttctaccaaaatattaatgctggtggcctttcagtggcgagatctgggacagctttgactctctttggtatagccctgtgtagtctcccgattggtctataatgagcacattatggaatcagaacaaaaaagccatttccattttggaatggaaagcagaacgtttccattctgcattgcatgcagggcactggaaatgcaaagtggatgcgtggaccacacaggggagcacacctgacctcctcttctctctgttccaggaaggcgtggaagtgcgagtggccagaatcttcaacacctttgggccacgcatgcacatgaacgatgggcgagtagtcagcaacttcatcctgcaggcgctccagggggagccactcacggtaggtgctggcctcggctcagggagcaccttgcaacccaaatcgaagtcagctcacaaaggatgagggataagtgcatcttggttcagggagtgacacttctgaagctgccatgtatacccgctaccctccactaaggggaaggcaggcacggggacataacccagatgcatggctgctccacgaaactagagtcaccttgccctccatggccactggggtccctgcccatgcctccaggtctgcctgcctgtaccagccggcctgtgaagaccttctccgacatacttttggcctgctggctgtagccaggggtgtgcctgtactgggtgtcctcggatggctgagaagcctggacaggtagggtggggaggtgagccacatctggtcaggctgggccgtcaccttgacaatgccggcaggccctcggtaccatcctccactggccaccctcaacccagggagacttctggagccagcagaggtcccagtgatctgtggtcggtggtccaagtgtgtggcaaagatgtctgtgccgacactgactgcttggtaccctcagataccatctggggtcagggtgggtttgctgattccacacctgttcccacagccctctggcctcccttgggaggagcaccccaggcctgcctggtgagaggctctgccggcatctttggttttgctaatcctccctcccacccccagctccccggtcactcctcttcgtggttgtctgcccaggctgctttgctcttctgatctgtagcctcctagagcactttccagcatggcattttgtgggactcgagtcgatttgcatcctgttactctgaaaatcctgtggcatggtttgttatcaattgagtgtattccagggggaagaattatagctctgtgtatttctgtgtagtacatatgcatctacccattgattggttgatcacgttagctcactcttctgtcctatgatctgcaggtgacattattcccctcctttttcaggcaaggatgctggagcgcagaggttatatgagttgcccaagcttaggtggccacacagtggtagcctgggttttgaagccagagcccccgctcttcatgagcattctccgtggtgtgtgtctccttgtctgtgttggctgctccgctaccaacgtagaaccaaaagcctagcctgttacacagtgggatgactctccaagggcaactgcattgtatagctgagtttcgctgagtgcattcctggggagaggtgagtccaaactcagctttaggctcccaacagcccatgccagctctcccacctccccctgtcactaagtggtatcttggtgcccctaaatggaggctctgtgactacacatggctcttctccttccttcactgcacagatccaccagcacatcctaatggccgtgccctccctaggtagatccagactccagtccctggtctacactgctgccgccccacccctatttattgccgtagccttggagccactctcattctccctgtcctgtgtactctcaaccccgcagctggagggagccttgtaaagaggggtcggaagctcaagtggctctgcagctccagcagagcacgggacacagccctgttgcctccgcaccttccctcaggccgggcttccttgctcccttgctcctgcctgtcccagcagcgtcttgcttttcttccaggcattcttgttcattcatcctctccttaagggaaccttcttgatgcttctctgcattatggcaccaggctagttaccataaccatgttagttgtcttcagtgcccttgtaaccaactgaaatacgaatttttcagccccaatctctgttagtacagtgtatgctcttcaaaaccagggactttgtttcattcatggttgcgtccccagcttccagaagaccaccaggtacgtgggcgcaggagagaaatgttgagtggactaattattggatttgtagtggccgctttcctttatggtaagtgaaagtggtgaaacttactatcatctcatgtaaccctcttgctgctacttggggttcctaggagctcgtgccgtgacctgcgaaccccttagtccacctgctcagttgagaattccacatctcgaggacagcctggtgcctttttagcaactgtgttcagaaactccttcatgctgtgagatgagagctgctttgtttagaggaaaccatgaaagcctccaagaagcagcttgatttagtgcctccttggccacagccagggctcccagtgtcccctagcctccccaagaatgcatgcattgttggcagaggtgataactcatgtgttgtcttcacaccgagcaagcttttgtgccagagacaaaagggagaagatctctggagccgtccatgactgcagttaatcgagaacgtggtgggcttcagtctctgtaggcagcttctggtggcaggaggcagaagtcccgagggaggcctttcagaatgtgttttgtttcctttgtcacacagaattctatttcccagcaagaatttgatgaagtcactgacttcattcttttctgtccaattgagatatcatgccttgctcttgtcagatggctctgtggagcagtctagggagagactcgcaggcctgcctgagccagcctgtctttagaaacactcggcttactgaggaagggaaataaggaggtgtgtccacctatttccttttctgctacatttccgacaagtcacttctgaggtgaagacctctttgagggtggccagaaacagctcagcgtctcgttctccctttccaagctggatgggtatgattgcttaccttgcagccgtgtttttgagcagattcctcatgcctgtcttagcatctcactcgttgctgtaccagatgcctgtgatgaggactcagggagtatgtcgctgggttaagtgcatcatacatcaaagctatattttaagtggaatcatgttcagcaaagtttgcatctcagattagaaaatagatgagtatggttcaggtagagctattgtcctaagtttattttcgaagaggctttggtccacagttcagttatggcactcaccttcacaggaggggtcattctgctttccaccttatgtgatttatcccaggtttggatttgcccaggacaggtcagatgtggtagaattggggtttgaatccagtgctatatcattttaaaagccttgctattcttccaaagggaaattgtggaaaaatcatacttctaagaccaattcaaagctggtatgatgtttagcctttttattgatactgtggtatgttaagtgattcttacattgggccttcgtttgtggcggaaagccataggatttgttaaacagttattcaatggtactaaagtatggtgaggaagactttattcaggaccatcatgacaggaatacggatcactgcagtgggatttttcgggggggaaagactgggatcaactccaaatacagcacaggcaagcagaatttacagccaaggagcagggaggaggtgagtggatggaaaattattaagaggaagcatcagaggtaaggcggattctagctaaaccaacctaacaggattcttgctgacaacaggccagggtggtcggacacactctaggggatatggggggtgaggaatgtcagatgtcgagggtgatcagatatcgagggtaagggtttcttgtgaaactgacttagcagggttcttgtcaaaactacattttacaaggaagtgcacaaatgggcctaggagaaggtactcgaggctgaacgaagtttggccaagcaaagaatctttgttacatcttaaacacataaagcacagcggctggggacattgctaagtgatcatgagagctcctcgctgcccctcacccccggccggtcctctcccctgttggttactccttgatcatcatgctgctttgacctgcacacagcccttcgttccccggcccccagtagcagccttgactcttgcacgaatctcctggcatctctcctgttctgtgaaatgaagccagagggaccgaatctcacactgtcttctgttagaagaacaatgagaaggctgagggagctctgctgccatcagctgtccacaccagatccctgtgatactcatgccctggattttgctgcacactcaatttgtgccaagtccctgcaggccttatcttgaagtgggggagatggaaggcctcagaccatgctgggagggctgtacacagggtctgcagttgcattctagagcccagggaagacagatattttggatggggcataattgcatagcatcttctctcttgcacacacacccctttcttttactttacattttcacattagcgcacacagtgaatatttcacacatgaattacaaatcctcatgttgcaaagtactgtgttagtgaaataggtaggctaatttaaaccaaagtacagatgatggatgtgatatgctatagaaactgaaatccagcaggactcttaaggacatgaggaaggaagtattccaggctgccactgacattgcatcttagcctaatgcacacactggagcatacaaactttcaggactgtgtcagcaaggtctgtgggggtatgcagtgggcgtcccacgggatccacgcctttccactgcagcccaggcagaacagcctcctcttgtactagggactatttccttgaggcccagttgggcctcaggtgggacctcagagggagtgctgctgagcaccttttgtcaccgtacctgaaggcagcatagcttacccggtgaccgtggtgcctgcagatgaaccttgtgtcggtgctggctgggtggggagctgcccctggcgagtcacgcagggaaatgcacccacagtcgtaactctccttccagtgcacttatgaatgagtcaacggtgggaaatacccagcagactgcaggttattttgggagccttttggacttcccaggctgcagccctttgggattaagtgatattcaagctgctgaatgtctccaccacaagtcccttgtttggttgagcaggtacctggcgtggttcttcacatcctgaccctggcagcctagttaacccatcccggtcggggggcttacccagcatgtattgccctggattgtgttcctccagggcttggggtcagcatgtttcggtggaatggaaagctgccactgtgctcttccatggctcctctctgagagacggtgtgtgagtggacaccgctgctctgatgagtgagcctgggctttagatcagactgaagactggcctcggctggcttgttgaaggccactgccgctctggacaaaggtgggctttctgtgaatgtggctggaatgcactagcagactggtgagcccaccatcacagtggccctgactgagtgtggtgggaaggtgcaaaacaagcagcagaggtgcatctgtgcgctcagctttgagagcagagccccggatgcagacagaggcaatgggcaggacagcagcacagccccaaacccacctgtggaggagcctgtgacgcgggagttgcctaaatccgatactcactacagtgaggttggagaatggcctggtgccagcctgagagccacagtttgaaaaaagaaaaaaaaatctacaggtagttctgaaattatgaacacaatagggcaggaaaaagaattctgaacttggagtcaagataaatttcactctgctgaatgcaggtcactccagcgctttgaccttccattacctcatctccaaaataaggttgtaaaaaacaaaaagagttacacctacggcactggtgtagaggggagtttccaggctgagggagctggcagtgggtggacctcctgtcctaccaactcaggcccactgcttcctaccttcctcacatgtatcagaagtatcagccaggccagagaatcaggttcaggcagaactgtcaaggaattcccctctgcttccaagaggcccatgcccatccttcctcaatgttcctttactgagatttgttgcagctgtagtttctgtgttgacaggaatccccattcctcagtatccccagccttttctcagtgtaaggccttccccccaagaacagaacctacatagatagaactgatacacctgtggaattggcatataaatgtttattaagaaaacagagatagcctttgaacctgctttttaaataaataaataaggctttcagggggtttgatgcatgtgctttttttttttttttttgagacggagtttcactcttgttgcccaggctggagtgcaatggcacgatctcggctcactgcaacctccgcctcccaggttcaagcaattctcctgcctcagcctccctagtagctgggattacaggcgcccaccaccacacccagctaattttgtaattttagcagagacagggtttctccatgttggtcaggctggtgtcgaactcccgacctccggtgatctgcccatctcggcctcccaaggtgctgggattacaggcttgagccaccgcgccaggccatgcgtgtgcttttcttctccacctgatccttccccttttccttctcagagctggagcggggagctctgggaaagccaggctgagtgtctggtgctgagggggctggtgctgttcacagagctgctggcaggggctcttttttgctgtcaggcgggaagagaccccagggttgttataatcaagcttgttcccaaaggcagtcccttcttcccagctgcctgctttccaccacagggaggtacacaagcaaacaaaacccccgagggcactcttgttcctgtgatgccgcgcttaggagatctccccaagcacctctgttgccgtctccgcctcagtgagtggcgtgatccgtggcgctccgcaggtcattcagcagatgctcatcccatgctggtatcgcacctcacatcgtgctgggctccagcagggcaaagggggttcggacaccagtccttctggggagttcacagttgggggcagttggcaaagggctttccctgggcaatgagccagagaagcttctccaggaggtggcatcagagcttgtccctaaaggatgagtagcactctgccaggtggaaagtagacaagacggtctcagctggcagagcaaagaacacaagccaagctatggaagtgtggagcaaatgtgcagtggaaacaaaggggaatgtgaccctcctcctgccacctccgcatcactttcagagtctcctgcatgcctctccaccttggccttatattagaatctcctggggagctagctgtaacaataccaggagatgccggcctcatcccaaacagtctgtgaaccagcctgggcggcatccccagctctgctgttgggcagtcagtgtgaggaaccccagttaaatgcatgtattaatgtttgtgtgtagatctgtcacctagctggactctgaggtcacagccccccagagcctcacatgatgcctgacacatcgtaagactccagcagaagcgaattccttcaggcactgtcttttgagggaaaactttacacagctataccaggtgcacactttaggtattgctgccaccatctcactgtcaaggcatggtctcgaagtagagtgcgggatgtggtgctagatgctttgagtcagcatcactgccccctgggatcagtttcaaggtcggactgtgtcccctggagtttcaaggacacctacgcaggacgggtgtggttttatcaggaggcctaactgttggtttccttccaggtatacggatccgggtctcagacaagggcgttccagtacgtcaggtaagactgtcctgccctgccccagccttagcagtgctttggagcaggggtcatgccaacttgacagacagttcagtgtcttgtatatgttaaccatttccacaacgctaacactatatattgattaaaaatttttaattttatgatgggaaaacttgctgttctctgtttaaaagttaaaatttgcattcatctccatgactatcgtgactcatgtgctaatcttttactgccacctagcggtgtgtgggtgaagttgcccagctctgagggtgacttgggtgatttcagcgcaggtggagttaagagatggccttttgcatccagcagacctgtgaatgccagaatctgacccattgcaaacatggctcgcggggtggaggagatagtccttgtggagggcacaaggtagatagtgttcttatgttgaatttcacgctgaaactaaatgcagataaaaatatattttttgaatagattcacgtggtgatttttattgctttcttggcagcccttataaacccactgttctgttgttccattccgttggtgattaattttagaaggcagtgtggattctcagagtagttaggatagaagcagttgtgtatgccaaagtgcatccaccagtatgtggctattgtaaattctgtgaaagtttctggtatcctgaattgttgtaaaacccagttctatattttgaacccacatattttcactcttcattgcaaataccccagtatgcctgtcaatcaggaagtgttattcctgctgtcttagggccatcccaggggcactagggtgagatggtggctgttgtgcaggtcggggcagcccccaagtcccacctcagccaaagcaaccacataaaattgtacctacccaggacccttaggtaggggtcctgggtaggagtcccgtggagaaatggaactggtagtaaaataaaattttaaaaagaaatcaaaataaccactgtagatttttgctgaaagtatttgtgaatttccatttactccaaaagaaagctgtgagtaaacatttacacagccagtagttttttcctccccacccattaatatcttgcctcaaggggcaaaagcccagaagtgtactataaccaactttgtggcccaaataggcatgcatattctaaaaagcgatttaacagggaaatggcagctgcccccgctttgggactgtgttcatttcaaagcacttaacgtaggcactatgtccctggaggaaactatcatggcacacttctgtatggggaccaaattgtgggcctcccttggattgagtaccgtctttccatagtgacgcgttcttatcccatcctcctccactcacccagctgtgcccttttctgagggagtcttgctgtcctcggttatgtgtgcctgcctcgggctgcctcaccagtggcgcccaggcttctccagcccccacaccacatggaatatcaatgagatgttgtgcggtaaaaggaaaccagtcaggacccattcttctttctgctctcattatctcaagggcattgtgtgcaaaattcatttaaaatagcctcagagacttttctttttgctaggactaaaatattttgagcattcagtgatgcctgtgctatgtgctgtcccagctcaggacaaaatgcaccctggcccgctctgatggcctggtcactgtcctgtgcctgctttgatggtcgtggctcatgctcctagctgccatcacatgcatcgtcctctcccacaccacttgactacttgaaaagagggcatgagcagtttccctagacacatggttgttaacccttttagaaaacccatttcataacacttcagtagtatttatttactccccactctggtgatcctctctggtttcacattagcagagtctgagatgatgaggcttcagggactttgccatacttgggcaagggtttcctgacttaaactttttagttattgaggactcagatgagttcattaactgaccaaagttttgatgtttttcacaagcaattttttaggaactgagcgtcttttagtaatgcacgatgtctgggtccatatagttactgtactaaattaaccattccccaaacccatgattgcctcgaaacaacagtgcagggagtctgaggtctaggtggccatccgcatcggcattttggcatgactctgtttaatattctcatggccggttttgtcctcatttacataacaaaggcatgctatattttttaaaagtcactttgtcaaaatgacacttgtaaagagcttcaggttaaagaatgtgatctatgcaattttgaccttaaaagttgccagtttgtcatgtaaaaggcccatggctctcccgtctgccccactgaggatgactgcctgagagtcacccttcttccaactcagataaaccccaccccccagtttcaatattaaatcatattgtggatgcaatggaatggcagcttttaatgtctttttataaacctgcacagatgtatgtcatgagtgcactattgtaatgtagcaatactgccatagtgatgaagtgactttttgctagtttctataaaggagaaatcatccaaggttagcagggatttgcatttgtgcttgatccttgagaatagaacattttaagcatgttcatatgaaatacgcatttgtcgtaaaggaaaacgcagaaatatctgatttacgaaataccccaataggttttttcaattgaaagcaaaacctatctgcggttttcttttggaagtttatcctgacccagagtgacctgctcctcactggtaacgatggaggaggagaaggagaagggtcagagctttaaaagtcttctaagaattgtagctcatggaaaattggcgtagaaaaagtgcttgtgcttagcagtgaggtgtcatttttacgaagtaactttgttttaacagagccacactttaaagcttctgaaaataagaaccaaaccttggtaagcgaaagtttgcttacttatcttcaccttcatggcctagttgatcacaatccatttgaaacatccaaatatccctgaccgtttcatacgaggtgttttggggggtggcgactttaaggttgggggagtagggagtgacgtttctgtttatttcaaccctcagtattgtttgcctttatctgtgatttgccagtatggggatcacatactggagttcgttcatttccgtggatcttgtttttaaaagtaatcatgtgctttcgtacaggtcaactactgggttcacattaaacatgaattttctttggaaacttatgtaaactccatcttttttgagtgtatgcctgttttaacttatgcttagtttttaattgttaaaggacttcagaaatgcagtggcgaactcagccccatcactcagcttccatcctatttaactatctccaccacacccaaaaaaagcaaatcccagacatcaaatatatcatttcatccataaatactttcgcattgtaaacaccatcttagtttgtaggattttgtttcgacattcaattttccatttgggtttttgttttctcctgggggtggtaatttttcttctgggagggcttctatgtggtgcgtggcactagcatattccagcaggcagagcctcacctgcctcccctttttttccagcgatctagtgaatggcctcgtggctctcatgaacagcaacgtcagcagcccggtcaacctggtgagtgctcctctccctccactctgcaggacagctcagactttcgttcatttgtgaaaccatgagcagcaccaggctttgcttcatttgccatcggcacacttaggacatttgtgtttgttgcttgctaaatactagaggaaaaacaaacaaacacaaagtaagagtatacaaagaagtaaaacatctgcaaggcacgggtgagtgatgtaatcagtccctccaccttctgaagggcctgggtctaagattgtgtgaagccttttggtggtagtaggtggacgtgtgtgtgcatctcgttctctatttaacaggcgggtcatcattataaggcctgattgcatttttagaagatggaggttgttcagagggaaaattttccggttgctgatgatgtctgtcatttagccggacagaccaccttcatggcttctcgccttccctgcatgcctgcccacagccccagaacctccctgttggagggatcatccagccttgagcagtttcagtgctggtgaacttgcttctgctcagagaaattcaccctgtctttggacagttctggccggcagaaagctcttcctcatattggaccagaaatctcactttctgcacacctgtccactgacctcacttctccacctggggccattcatggctagtgtgatgcctctacagtgtggtaactctccaaggatttgaaggagatggtcctaccccctaagctgcctcctccttggtgcatcagccaaggtcatggtaggacctcttaccctttctgtcactgagtgattttctgagcagttttgttccatctcatttaaaatgcaaggtttccaatgtggactgtccagcattcaagatgttctgcttctgttgatggcagtggacacaagaacctcttagctcacagagacctcccccttaaccctaccttggggtcatttcaggtgcttctcccaaattacctctcctggttcctacacaacactctaaagttcagggaactctaaaatgttggccatgtgacctatttcttgcaaaccatgtcacctttgcttatgcatgtctttgtaaccagccatctcaaatacattgcagaccatgcatttttccctgaggtgaaagggaattctcatcacgtaggaaagaattgccctggagtgctgactccattctgggactgttgctgattcatgggtacagtgtgccacttttgaaaaaaattcacttaaaacagaccagaacgtgcctcacactgtaagcctcattttgcttgcagcatttgcctgtgtacactggagaggcccgaggcgcccctgctctgcgtttttgttgcaggttctttagcaagggtgttgtcagtgacttccctgggcagccaggctcttctctgtagataccatgttcctccttccctctttggggagggcctttgcacagggacaattcctaaaattggaatcgtgtgtctgccaggagaaaggcagaatcactttcttgcaaatttccgtcactccacttcgctagtcatcccctctgtgctccattgaggcccagggtctctccctccacatttaccatctagcttcaggctaaccgaggacctgggcatgaagaggctttagggtatagaattatcagactttatggtggtctcttatgatgagggcagtggtggcagagtaagagtaacaggtgctctgatgtgtgatgggagggagaaaaagagcaaatggttttccttaaagcccccacacaagtattctctcttcatgaaatgcatggagtttgtcctctggcttgccggggacactcgcctgtgagcctactcatttctgccttagcttttgggtgtgagattacaagtccttcatcactgacatggttaacacagctcacccagacgggaatagatagtgttaggagagctaattttgtaaacccaagcttttataaaagtgacattgaagttatgttagatatggaaattgtctgatactcagtgagtgtgtgccttcatcagaaactcttgacctatccaaagcccagccttgtacacagcagcctagaggctgaaggtatagatggtgcagtttagcactgccaggtgagtaactgtcatcttggaagcggagtaccctctggcacacggagctctgctgaagcagcgcagggaggtcagactcggccagtagacgtctctgcagacacgcctgtggtctgggtggtggattgctgctgttgtcatgacgcttataactggaaaccgtttctttcttaggggaacccagaagaacacacaatcctagaatttgctcagttaattaaaaaccttgttggtaagtaggataagtcatttcctgagtaaaatcgactgtgcctgccctatctgttaataacaccttgactagaaagtgggtaattaatacaagctaattgaattggatcaaagcagaactttttatcaggaatacttaagtgttttctaatttttaaggaatagaaagataaaggagggcaggattggtttctcctcagttttcgttgcaggtttgcatgaagtgggagggaggaggagatttgctcccagtgtttgaggcacgattgtattagatcatcctacatgggtgacaactattggatttccgaactggtcatgtcaagcatagaatttcagacagcaagagacagcaaccaccagctgcgtgcttcaggcaggtttgaaattctgtttgcaattctggttatcctggctgccacccactgggggcagtgtagcattgggagcaccccatcaaggtggactcttaggccatgagaaggtcaggtcttccagaccagccctggattgcagacatagagtggatgagcccttggcctcatcttcagacttcctggagctctgaggagtcagactcttggagggtgtctgttgtctggggttgatcctgaaatttgagtgaagtcacaaccagactagactggcaggtaggccaaggaggagtatgccacagtgtgtcctgaggtgaccattcagaccccgcttggctgggttaattcctccagtgtgcccttcctggcatcaggctgccattcatcggcattggtctaatcgacccggatggctggaatcctcccgttgctcgtggcagtagaagcagcggtcttcctcagacatagcctgcatcatctgtggctcccacagctgctccgatgcacttcccagcttttccatcctgaatctgtgtgttcctcctgcgtgaggaaggggcaggctcagatcacagctctgtgccatccactccttcacaccctcactgcacagagtgaggcccgtgggccaacgcagcagcagcatcatcagatgtgtgttagaaattcagactctcatgccctagcccaggcccccagatcaggatctgcctgttgacaggctcttcaggtgatccgtgcgtgctgacgcttgagaaacactatttgaaacctaaggctggggggaggggcgtgcagcttccctgctgtgcttctgtatatagctttgtgacagaccatcctgaaccacctgtggtggtgattcgctgcagagtctgcaatgtggcctccatgacacggaggcagggaaagcctccacaggctttcttctgcaggtctggcccacagtcactggtggggctgtgtactgctggccagtggggcctgggcccagcaaggatgtggaacaggccagcctttgccgtcctccgagaggtccctccagctgggtggctgcacatcttgggtctcagggctgtctaggctccgagcacccaggtatggcccacttggggcatccacctcagggatggccccacaccacgtttgtggtctcacaccggggtcatgctcggtgggcacgtctgcacttgttacctggtgtgggtggtctgccttggagcaaccctcttgtagtgggcggtaactcaggcctgttgagacagaataacctgccccccaccgagctcttgctgggcgcctgcacacagtcagcttggccacagcagttgcaggagcactccctggacttccacgcagaacagtccctcgggagctccggggcttctcagagaactgcatttccaccgcctgcaccctattcacaccacatatggggtttgcctttgatgtggatggtaaggctgtgcttacccatgctttgtgattctctcctaccttttttttctttaaacatctcaggtagcggaagtgaaattcagtttctctccgaagcccaggatgacccacagaaaagaaaaccagacatcaaaaaagcaaagctgatgctggggtgggagcccgtggtaagtgcagggagttaatgctgccttgtggggaggggcctcccgtgtcctgtgtctgctgtcctgtaggcactgacccttgtcagacagcccccggaggagcaaggtgggctcggcatccaggcagatagagggttttctccaagtggtaaacagcctctcctgtatcaggagtctcagagaatgttacctgggaagcggctggaagcccctgctctgggctctgttttcgtaaaatctctcatgcacacacacattcttacattctctcatacacatacactgccatacaaacacttgtacacacatatactcacactgtctcccacacactcacactgtcatatatacactgtcatacaaacacacttaatacaagtatactcacacacactcattttcacacatacatatacattcacactatcatacacattctcacattcactcacatgcgcacactcactgatccacactcacattcacacatacactccctctcccacatacatacacacacacacacacacacacccctgactgtgaacgctgtgccaagggcgctggcagcacacgctcagagccctgcgtagccccagttgcctgcctattgagtgtgcggggccaggtcaggggcaagtggtccccatcagccccgcagtggagcccctggttggaagcgtgcgagactgaagggtgtggaggaaggggaactgcatgccttcctgttgtcttcagtgtgtctactgaagggggcagggtggggcggctgctgcctccctggggctgagcctgaaccccgcctgcttctgctctgccgcctgctgtgcccttcctgccttgggtgactgcaggctcctccccgccagagaacgctcgtcctcagggctgcctgtgtccttcagagaccacctgtgtagggaggttggctgggttggccccatctatagaagcaagcccacctcatttactgtcacctctgcctggctgttccctctttgcccaccctcatgtgccccactgaaattcgggctcccctcgggcagaggcgtgtagtgtagccctgtgtccagcaggagcccggcacctgtcagacctgacacacactgggtgctcaacaaatgtaggagcatcttggcatggcccttgggttgtggcgcagtcagagagtcagggacgcagttgagagctcagtttacctttttaaaatgtgcatagtcagagctgagtgagtagaatcctagaatattgaacttcaaagggacatgagagttccagcctgatccttatttcattctgtcatgtacaagtctacgtaatctgctaaaaactgcagaaatttgttgagtgaaataaaaatacaattacacccagacttcacaaaatcgaataatcccaagctgtgcaaaacaggttatagcagcctaggtttcttgtttttttgaagctttgtaaggggccattggtccctttgtaaggagagcctatatttttaaacaaaatattttttgaagatttaaatatacattcactatgtattaactattgctttttatgtgaggtgtgtgtatgctcagtatctttatctttctggaatttagacctataatattctaacattcttggaatgtgagccatctaccactggtttctcttctagtagtagttttaatttataataaatttttgagggatatgatccaaagaaacttacaggcattatccatcttaattgtcccaagtgtgtgtgtttaacagcttgttgagatataattggcaaactgcacactgcccatatttagaagatacaatttgataagttttcatctattttgacacctgtgaaaccatcgctgcagtcaagctgacagaccttctcccccagtggtgccccagcaccccttagcagtgcctcccttcaccttttctctttctgctgttaatcagcagttgatctggctggtttcctgttggctgcaaagcagcttcagatgaaggttgctttctgtggtgtgggctgccgtgggtcccctctcagactcagcctcttagtatggtgggggtgcaagtgggccatgatccgctaggcagtgcaaagggttgatgtcacgtgggagaatcaggcgtgttgatcagatgcagatcaccttcccaaagcatcttcccgccactccaaggtggatttcttctgaaagaatggggcacatgggcattatctgaaaaacaatcttgccagccgattcaaactggagtagacattataccagcaagaggtagtcggggtcttttgtgaggtggagctcactttacgtcagtaagagtgacacttgtcagctccacagtacattctgaaagcggccctgaaggacttctggcttctctcggtgggccgtgatgctggatgctgtcacaaccaaagcatggttctgtgagtgttcctctgaaggaggcctgactggctgcaaggtggcacttccttcctgcaaggtggcacttccttcctgcgatgcccttctgtcaatgtgaccttgtctccctttcttgctttccctttaaacaggtcccgctggaggaaggtttaaacaaagcaattcactacttccgtaaagaactcgagtaccaggcaaataatcagtacatccccaaaccaaagcctgccagaataaagaaaggacggactcgccacagctgaactcctcacttttaggacacaagactaccattgtacacttgatgggatgtatttttggcttttttttgttgtcgtttaaagaaagactttaacaggtgtcatgaagaacaaactggaatttcattctgaagcttgctttaatgaaatggatgtgcctaaaagctcccctcaaaaaactgcagattttgccttgcactttttgaatctctctttttatgtaaaatagcgtagatgcatctctgcgtattttcaagtttttttatcttgctgtgagagcatatgttgtgactgtcgttgacagttttatttactggtttctttgtgaagctgaaaaggaacattaagcgggacaaaaaatgccgattttatttatgaaagtgggtacttaataaatgagtcgttatactatgcataaagaaaaatcctagcagtattgtcaggtggtggtgcgccggcattgattttagggcagataaaagaattctgtgtgagagctttatgtttctcttttaattcagagtttttccaaggtctacttttgagttgcaaacttgactttgaaatattcctgttggtcatgatcaaggatatttgaaatcactactgtgttttgctgcgtatctggggcgggggcaggttggggggcacaaagttaacatattcttggttaaccatggttaaatatgctattttaataaattattgaaactcaccagtcatgg

SEQ ID NO: 38554 - DNA, 87768 bp, Homo sapiens
ccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagcggcggcaccagcggcggcggcggcggcgggaggaggaggaggagaagaaggaccaggcggcggcagcagcggcggcggcggggggaggaggggaggaggcggcggagcaggaggaggagaaggcggaggaggcagtcgctctccgcggggctgagccggacgcgtcgtcttgcccccctccccccggttcgcggtgccgccgtgtagttggcgccgctgccccggctgagagtgagcgtggtgtcgacggagggagatggcccgggagcgccggcgccagtaactgggagctgatgagagtcgccgagggcgcgccgggcccaggtgccggggctgcccgccgcccgccgccgccgccgcctgcgcgcccgcccgcctttcgcggccgctctcccccctccccgacacacactcacaggccgggcattgatggtaatgtatgcgaggaaacagcagagactcagtgatgggtaaattgtcttttcgtttcgggccgggcggcggcggggggcggcggcgggggggctgttcctccttatctggagctggccgggccgccatttttgttgttaaccctgatccggatcgggttggggaggaggagcggccgcgcgggcgggcgggcgggaacgcagtgtggcggggagcgggggcccggcttcgcggcatttcgccctctccggcccttccggaggctccgggtttgtgccgtgtgcgtgcggggctcggcgctggggcgctcggtaggtctcccgcggggaggggcggcgggggccccgttttcttcctccccggccccccacccgcgccgtgtcttatgtcgctgccttctcttcctgtttttcagctgtcacgaccggaggggggactcgcagccttaccaggtaccagccgaggccggggtggagggattggaaggggccggagggggaagggagggactgctactcgagcgcaggcctcagaagtcgatacaggcccttcggtgcaacacatctgaaactagcaccgcggatccccttaaaattccaggtttggttcctttagcgctctccagcaaggtttagtgacttattttgacaggtgactggagggagttcgctgatttaggaaaaaagaatcatttgcagccagaaagacctgactcgattatttgattatttgcgagtgaaggaatcgatgggatgagatgataggtgacttacgaggcttatttatttatttattgtgttgggggaactgaaaagttaatgtaaaggtattaaaattaagtgaagaacttgggtaaatagctaaatgacttacaactttcaagtcggttataaagtactaccctttccccttttaatatttttggtatacttaattgccttacaagtaaaagatatgtgtgcttttgtttctgtaagaattgaggtctttgggtacttggataatcattctgatgtaggtggttctaggtaggtgggttcctttttgttactgcagtcattgtgtgtgaagttctaaggattatgatgaaagtggccccaattttcaggagggaaacctcataatgattgttaaccatcagatgactgcagaaaacactttctacatcttaaaggactagagagcaggtttctaacctgatggttgtgttatacagctgaatttgaaaacactgtcttctgatatgtaaaacattggatatgtcaaaaattaaactttactgaatctgtcctccaaagcatagctgattacacattgcaacagattagtacatcatgattgtcttaagatatgtgttagaataaagctaaacgattattttgagcgcattatgcttagttagaaatagtactcacattagtttattttggttagtatttttataccttaaaattgtttcccacacctgggagagtaaggaagttaggtctgaaatgctttatttgaatcaaagaattggagaaactggtgtgtgggtttttttttttttttttggtaggtttgcaaaaatatgcatgtgcttatttatacatgtgtttgtgtatatcagctgtagagcagaaattgattatagtagtactgaatttctagttttcttttgactatcaaaaaatgattctaaatattctcagccaaatttttttattttttgcagaatcagtgtgcaaggtggtttataagataatggagtgggttttttttgtgtttagtgtgatttgttatcaggagtcttattgtaacgcttaagcattaggttttttgtctgagaaactttaaagagtaaagcagaattgaaagtggaaattttaattttgtaagttcataaaatttaatgataatacaccaaagtttatgtttaaattagggagtttaaggtttcaattctttctctctttttttgggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtggtgagtatctttcttgttgaaactttgacatacagttttaacaatagctctatataaaaggcggcagtagtatttctagcttgaagaagttactgttcagttatgtcattaaaatattttaatcctatcattttttttttactctgaacaagttactgtagaaacaagatgctgatgtgagcatctaaaaagtggactcttaaggccaggcgcggtggctcacgcctgtaatctcagcacttgggaggccgaggcgggcagatcacctgaggtcaggagttcaagaccagcctggccagcaggtgaaaacccatctctactaaaaatacaaaagttagttgggcatggtggtggtggcaggcgcctgtagtgccagctcttcaggaagctaaggtaggagaatcacttgaacctggttggtggaggttgcagtcagcctgagatggtgccactgcactccagcctgggtgctagagtgagactccattaaaaaaaaaaaaaaagcggactttagtgtttaataataagggaatgcatttatgaatatagtttaaaacatgctttcttaaggatgggaaaaatgcaggacttttttccaagaaaggaactttgaccttttaaagatttcagtttgagatccttattgttgcttcagtttgttactttttaaggtgttcaaatctgttttctaattacaatgataaactatgaatttaaaaactcattatgttttttcaggatagttcccagatttaaaaaattatttatgacttagaaaatacattcttgctttttgttgtaaacattttcagtattctccagttttggtgatgtgatttttatacctggttcattgaaatattctttttaaaagttagtctgatttcttttgcacagtcctgtaccttcaattataagtttgcctcaagctctttgtggtaggagtctgagaataagtaaacaaaaccaattctcagtaactattttcagacttaatttgcccgaattacatttcatgtcaaaagcatgcattaaggaacaaagcaatttcagtaaagacacctatattctctcctacatgttgcttaagtagataacatatcttaagcagatttacaatattaaaagcttccaaggaaactcagtaaagtaccatgtgactttttgcccctattggcagctagttcttcaatacttggcttactttaaaaaaaataccttgcatcttgccccttttgtccacctaggatagaaatcagctttattcagtgtgatcatatactgagaaacattggcttcctctacataattactggtttgagaaaatacagtcagaagattgcactgggattgaataatttggatgagaagaaagtagttctctattgaatgtagttatagcttagtgctatttatgcagataaaccacatttttgtaacagtagtagcaggtgtatttgattattaaagtgttacaagttattgggttgcaaaattaagcttttagagttatcagttttgtgggtaagttttccatagtattatgtaaagcctgagatggtactctctatcaaccactcttctatagtggatttcatttctaatgttagctcttggagagcaggtactggttgtactatactgtatttattttgaaaaatttggtgattgtaacaaaataggatatggcacctcatcttcttacaaataggctcttattttagtgactatgatccagtttatccccaaatgcaagaagtcagtttttcagttataaatgctttcaatcatttccagcaaaccttgctcagccaattcttttacaggtgaagtaatcccaagaacattctgttgcttattcattcaacaaacctggggcatctactgtgtgccaacatttgtgtgatactcctgggagtcaagatgtgatcctggccttgaagctattcttaaatgctttgactcttgagagctagtggtgttttagccacttactttttctgtacccattttttcttcactttgattttttcatttttctacctgtatgaactccaggtacttgttagcttttcgtttttaaaaatttgcatctttcctgatgtttctttagcttcatttgcaagaaacttgatgtttttctgatctaatcacttgctaagttaggccccactttccaattttctttctagctgattgtcgtcttctggagtcttccagctaatactgtgattccattcctgtctctaccatctctaacatacctggctgccatattcctttatattatatggaaataataatatgaggtatatctccattctggaattgagagtacatctttgatattctctcttcaaaaaacgtaaaatggtgatttttcctcattttatagtgagatatttagtcattataatttgttttctggtgtttattttttattgctaatgatgtgtttggcactaagatgttaaaagtgtatatgtatgatttttattgcaggcattataaactcctttggatttttatccaaaaatgaattcaggccgggtcagtggctcacgccggaatctcagcactttgggaggccgaggcaggcagatcacctgaggtcaggagtttgagaccagcctggccaacgtggtgaaaccctgtctctactacaaatacaaaagttagctggttgcggtggcgagtgcctgtaatcccaactactagggaggctgaggcaggaaaatcacttgaacccaggaggtggaggttgcagtgagctgagattgtgccattgcactccagcctgggagacggattgagaccctgtctcaaaaaaaaaaaaaaaaaaaagaattcagccaggcacagctgctcatctctgtaatgctggttgcttgggaggttgagatgggaaggtcctttgaagccaggagtttgagactagccttggcaacatagcaagaccctgtgtctactaaaaaaaaaaaaaattttttttttgattagctgggtgtggtgggatgattgcttgagcccaggagtttgaggttaacagtgagctgtggttgtgccaccacactctaacctgggttgatagagtgagacccgtctgtttaaaaaaaaaaaaaaaaaagaaaaaaattaatgtatataaattcaagaccattatcaaaaatcaaatgcaagtgagttggattatctaagctctaagcatgtaaaaaacttaagattacagcaggttacttactatatgcattgaactactgaattcaaatttcccagtttttcattttaagatttaatgattttctttactaataataacctatatgctatgatttgtaacttgcattttacaaagcaagttaaatgtggaacttgtgcgtttgtttaccttaggattaggctttactggcatcacagcatttttcagtaattactagatttcttagcatcttggatttcattgaaaaatgctcgttcagaagtaatgtatgaaaggacttgcagatacaatataaaaagtgagaaatcagggattgtgaaggtttttattcccaaaaaccttgctagttaaaataagacttgctgtaacatagcgtgtatagtttagagttagagattttatccattaggatttattaaaggaaataatgtctattgtaaatttaagataggttatgtgagagtataattaaaatatttttttgtgaaatgagttatttttatatagtctgtgatctgtctgaaaacatacaatcttgtttaaagtaaccaaaagcaaaaaccttaaggtacaatcgttagggtttgttttttggtttttttttttctggagacagagttgcccaggctggagtgcagtggtgtgatcctggctcgctgtaacctctgcctcctgagttcaagcgatccttctgccttaatgtcccaagtagctgggattacaaacatacgccatcatgcccggctaatttttgtatttttagtagaaatagggtttcaccaagttggccaggctggtctcaatctcctgctctcaagtgatccacctgcctcggcctcccaaagtgctaggattacaggcgtgagtcaccgcgcctggcccatagtgaagtttttattttgtcatttagctatatctttggaaaaatttggaaatgtattttcatctccctaactttcaaataaaagttactattaacattttgaaggaattagtagggattatttggtgataatgtctttttttaatataatttagtaacgtttgagtctttcacattgaataatagactggcagttgagcaacatggtcttaccgttgtttagatgactttgaaatatgctttgagttagtaatgttacaaattactaacattagaaatgttgtatagaaagtaagtatacaaattaacagtcgcttttgatactcatgttaactttggaagacaacagatagtatccttatttccagttttacaaatgagggaaaatttaataaaattgaacagagagcaacagctcagtctagaaactagttctctaacttcggtaacttgtatgctgtcagagattaaacacttgggtattgaaagcttatttggtggtggttactatggcatgaattagtttgaaggcatttttgcttttatcctgctaatatcttcacccttcttccctcagtggttacaacttgccaaattatagtaccttgataagatgtatttgtgtagttctaggcgcagttatcacatcagtgttttattttcaaaaataagttttgacatggaagcatgacacagatttcactaggaaaagtccattttctcttaatccctcatatttaaagacttgtttacgaagtggaaacattgcatagaatataatacactaacgtttggattttaataatacgtttgactgatgttaagtattttttgtctagtaaaaatagtgacacatgaccttttttcattgatttatgctttgtgataatactatgcagaaatgtttgcattggatttccattggtcaatttagaaaacacaggaaacatactctgtttcaagagaagtggaataagattgaaggagtagcagtcttaatgtttcaactcttcattgttttttttttaattttagaaaacagtgtctgtgatgtaagcatctgtgcatgtaaattgttaaatttgaacactagtaccaagtcatttgtcttacgcttctcataatcacattttaactttttatatttttagagagatggttattatgtattgtttataatttaatggtatttctattttacaatcagtattttggaatgagttcacttagatccttagatccttaagacagtcttaattgaactgttttctagttgtgcaggaagtatttaaaatttttggtgtaacatacttggggttttggtctgtaattcacagaaaatttatatattctaatttgtgtctattaagcatctgttaccttattctgttgtgcagaattgtttggggggtagtgcatcattttgttatgatgctggaaagagtgaagatggaaataagctgggcatttgggatgctataccaggcactagatataactcattgtcaatttgataattacaaaaccaatttttgtggggttgtgtgtgtgtgtgttttgttttttttttttttttttttttttttaagacagtctcactctgtacctaggctggagtgcagtggcacgatctcgatctcacctcattgcaacctccaccccctggcaaaatcagttatttggttatttggggcttgcaaatatattctatgaacagtccttttcaggatttgtatgatgctttataattttcaaagggtttctatattgtttctcatctgactccacagtagctctttgaaataggctgatcagtattattcctgttgtactgatgaaattataaagtatttagcctactgttgttgaaactggaaaggaagtctcttcacataaaattttatctctgccttcaaattatactccaagtataactaattctcactattttatcattttagttctggctaccaccttttcttagcttgaattctgcaagagccccctagtgttcccgagtccattttgctttgtatgattgtttccccacacagtagccagagtgatccagttaaaatgccagtcacctcacatctctctcaagctcacggccctccagtgactccctgtttcttagcaaatcttataatagatcctgtgtaatctggtgtctgggtattttttcagcctcttctactatcttccccttgtttgtgctactctctccatactggccctgcaggcagaagtttgttcctgtctcaggggctctgcacattatgtgcctttatgtttctcctactgtgctcactcacttcagtaatgtgtctgcttaagtgtcaccctctcacagggccttctctgcccttgctgaacactctgaaacagtcattctcatcattgtctttccttgcccctgcgtgttccttccttgtatgaaggtgacctgttatgatttacttatagtcattctgctataacatgacatgggcatttctgaaagtcacggtgctgtgcaacattgcaccagaccaatttatggggaaaatggagttaggagcacagtaaccaaaaacattgtcagtgacacattttaaaaagataggaacctaataaaaattgtaacttagttttacacgtataaaatggttaaagaataacaccgcaataaatggcactttaccttgaccaaaacctgacttcttgtgaaagtggccactcattggaagggttgcagttcatgaattactgtaaagtgatggatggaagatacctgatacgagacaaaaacttgtaacatcaaatgtggatggacctgactcataattcatgatgaactaagatagctattagatgtttgagctgtgtctgccttgtaaattcctgtgcagcttgatgtagctagtgtttctcacaggtgaaaatacacataagtgggaaatttgctggtttctgatagatcagtagccttcaaacaaatttgtctatttggaaacaaatgttatagcagaactgactgtattttagtttttgtttgcttgccttttgtggaatataagctccaccagaagaggaagtgagagttttaatgtttttatccaccttgtattcctgttaccttgaatagtgcctgaaactttatagcatttaactaaatggatagataaaaaaaatttggattgttataatttaaggggaatgaaattatagtattttggattagcattcctcaaacttgaatgtgtatactaagcacctggagatactatagtcagtaattctggggtgggtcccaaagatctgccttttaacaagatctcgggtgatacctacacttcactagagtaacaaggttctatagcagcaccgtccagtggaaatatgttggccacaaatgcaaaccatatgtgtacttttctagtagctttgcttaaaaactaaaaatgattcaattttagtatattttatttgacctaatatatcaaaaatatttcaacttgtaattgataccttaaaaactataatgacatactttacattccctttttggtacaagatctttgaaacctagtgtctatttaacatttacagcacatttcagtttggacaagccacatttcatgtgtttaattgccacatgtgaatgatggttattgaattggacaatgcggttctgaggaatgtgatcgccctgttggcctgtctggcttttacatatatttttatttctctaaggaaagtattttgtatgcttgacttctgaaatgccatatttatgcaaagcaagattggagttaatgggtccttgagctatatagtgcttcttgtactaaaattttgttagtacacgctcattgtagaaaaattaggaaatgcagagaaaaggggaaaaagaaagtcaccttgtatcttctcatttaagagttaatcactagttttcatagaaaacattctcatgccataaaataattagtattctgtaatctttccagaattggtttcctttgttttgttttttgttgttgctgttgttgtacttgttgtttgaggcagggtcttactctgtcatcccaggctggagtgcagtggcgcaatctttgctcacagcaagctcgcctctgcaggtcaagtgattttcccgccacccaaatagctgggattacaggtgcgcactgccacgcccagctaatttttgtatttttagtagagacagggttttgtcatgttggccaggctggtcttgaactcttggcctcatgtgatccattcgcctcagcctcccaaagtgctgggattataggcatgagtcactgagcccacttctttccagattttttgtaaaattgtttcgcattgtgttccctttattcgcttgtattaatatttgcgtagtggattaaacaaatacttggtgttgactgtcagtcttagaggactgactagaagtagttttcatttggggctcaggaaatacctactttatatttctagctaattaggaaagtcatttttcagttaggttggtgttttggttcaggcactcgctagctagatgacctaacatgctacttaatttctgagtgtttgtgtccatccctgtaggattgttgcggggttaaatgaaattgtgtatatttgtaaagcatttacctcagtgcccagactgtgacagagtagattattaggcttgctcttatttctgtgattaaatttagtgtcagattagcaacctatagctacttctaaagctgctgctgctttctttgtttagggttaggaagaaacatgctggacagtttgccaaatgagagttacatgatgtggcttgtgggaacattctaacttggaacttgcccatttccaggactttgtggttcagagatttttggggatagatgtaagggttaaaaaaacagaaaacggccaggcgcggtggctcacgcctgtaatgccagcactttgggaggccaaggcgggcagatcacctgagctcaggagtttgagaccagcctgtgcaacatagtaaaaccctgtctctactaaaaatacaaaaattagctggggcgtggtggtgcatacctgtaatcccagctactcgagaggccgaagcaggagaatcgcttaaacccaggattgcaccactgcactccagcctgggtgacagagtgagactctgtctcaaaaaaaaaaaaaaaaaaaatggtagtgcaagtttagagtaatggttcccaaattaggctgcttattaggctcccctgagaagcttttaaagttacagcttccttgactccctccccattacccagaatcaaagcaatagttgatggagcctagaaaactgaatttttaggccgggcacagtgggtcatgcacgtaatcccagcattttgggaggccgaggagggcggatcacctaagttcgggagagaccagcctgaccaatgtggagaaaccccatctctactaaaaatacaaaattaggcatggtgcatacctgtaatcccagctacttgggaggctgaggcaggagaattgcttgaacccgtgaggcagaggttgtggtgagctgagatcacgccattacattccaccctgggcaacaagagcgaaactccgtctaaaagaagaaaaagaaaactgaattttaaaataaacactgggttaatttaagtatttataaactgcagatttagggagagtacacagaagggaagaggaactctgaagtggacattaaggaatgtgagttttatcattaacagtctgattattagagtggttatttggcaaattgtgtaatgtgttcttgttttaaagaattctctatcatctagattcacagataggatttgtaagtaattgctattaaatagctaacttaatatcctgtgcaagggcatctaatgcccagcagtagagaagtttctaattggacaggccagtgagatacattgggtagtatctggagccactggtgttactttagataatacctacttaggtactacatttccaccataacacctcgtctctagcattaagctgtcctgagacacttcagtggtaaatttcatttagcttttatctcagttggaaaaatagcctttctccaagttagtagagtatacttaggctgatcttaggtgttaacaaaagatttcctaaagtttactcttaggagtatttgcattttaaaggaaatttagaatgtatgtggttgatatatttagatagtgttagtctttctgtgtaggctttaattacttctgactttgtatgacagtgccaaaagagcatgacctactattggcgtcttcctaaaggttctgacctgttctgtattcatagaactaatcttttctggtagctaaaaaagcaatgctagtgaattatgttacattggagtactttggttacgatgaagagaggatcatgatgaaatatttctgcatttaataatttgttctaacttcatagaattgtgtgcctgttgattgtgaaaagattcattgtaatggaagaaagctggagaagttggggtacagagtgacaagctgctagaagtactgttctctgctgccttcagccttttctgtggttattggggctggtttctgttctgctgcctgctggctccttgtcagtcttctaagcattcatatttaatatgcacggatacctgaatcgcagttatgatactttgatttttttttaaagaataatgagttaagtcccaaagtagtactttctaaaactaaaataattttatatttttgtgtaattatgagagttccttttttatatagctgttaaataaatgccagtgttaattattttggaaaaacagaatgaactctcccctttgagtttgaccaattttatttatttaaacatgtaaattttgtgaactttgctgctttgttcatattgcataggttttgatggaaagttgaagagttatctcgttttttattcaagcctaaatgtaatttcagttttgatttgtcttttttttttttaacccaaatctattaagggtattttaaaaatctaaatgaatcagttttgtaaatcactgttaggctttctttttgtttctaattttcttggctttttggaattagaatttttattatctctggatactttgtcgatatttttgggatatttgaaaataatgtatttcctgttgggtacaaagatctctgtcagtagataagcttttaaattatttaatgaataattatgtagtatgtcttttgtatctttatttgatttagcattttctggcagatgggattattttatagcatagttcatttcatttctcatttttaaaagcactttttgctttgtgtgttacatatgtttgcttaaagatttcggacttttggccaggtgcggtggctcacccctgtaatcccagcgctttgggagggcaaggtgggcggatcacctgaggtcaggagttagagaccagcctggccaacatggtgaaaccccgtctctactaaaaatacaaaaattagctgggcgtggtggcatgtgcctgtaatcccagctacctgggaggctgaggcaggagaatcacttgagccctggaggcagaagatgcagtgagcctgggtcatgccactgcactccagcctgggcaacaagagtgagactccatctccaaaaaaaaaaaaagacttgtaactttttttgtgaatcgtaatctaagactttgcacattgggaaatgtcttcattttgttttcatgtctgaataaattatcttttggctatattaaaaaatcatttatcctttaatttttttttccctgaagatatttctaaaaatcaaacctggttctttttcatggatagatacccattgggatgtatgactcctaatttactctcctacccagcttgaaaatttagagtttttccttctttatccttggatctaaaacttcacaaatctcactttgtaagtgtaggccttttttcgttacttctaattagtgcattttaattttttaattacattttaattttctttctctttttctttttttttttttttcttctttgagagagagtttcgctcttgttgctgaacctggagtgtagtggcgcaatcttggctcactgcaatctccgcctcccgggttcaagggattctcctgcctcagcctcccgagtagctgggattacaggtgcgtgccaccatgcctggctaatttttttttatttttagtagaaacagggttttaccatgttagccaggctggtcttgaactccttacctcaggtgatccacctgcctctgcctcccaaagtgctgggatttacaggagtgagccaccacgcccggccaacattttaattttctaaagaccctggacaataccctgaatgcttagtgcctttttgtctaaccctatccgttagagagtcatcttccacactctttttttcttctcttttacttgtttctaacttttctccttttagaactcctgttagatgttttttggttctattctacttctcttttgcctggtaaatagtaagtacagtagttagataatttttaagtgtacactccactctggggagaatctcttggcatcttctttcaaccccctgataattaaagctgtgttcatttcatccacctattccaagttttattttgggtgctgtgcttttttcatagctttttgtgattttataactgatttactagaaatactcttgagaatttgggttattttttagtttttttcatgttaaatatatgtttttctggttgagtttggtgcatcatacccgtgttactgggttcctcagatgcttgctgttcatagttgtctattcatgtttgggaatacgagactaggtcaactctatcaaatagaatatatggttgaaaatgtttgctgtctgagctgtccagtgtggtagccaccagctacgtgtatattgagcatttgaaatgtggctagtgcagctaagaaactcaatttttgtagtttttttttggtttggttttgtttttgaggcagagtcttgtcctgtcacccaggctgaatggagtgcactggtatggtcatggctcactgcagcctcaaaaaaactcctgggctcaagtgatcctcttgccacaacctcccaagtagttgagcctgcaggcatatgctgccacttctggctaatttttgcattttttatagagacagagttttaccatgttacccaggctggtcttgaactcctggctttaagtaatcctcctgcttcagcctcccaaagtgctgggataatgggtgtgagccaccacatccagacaagtttttgattttttatggtgttggctttcctttctgtgctgctgttttaatctcatgcttgagccgtgactcaaaagttactttttctgaggtgttctgtctttgctgctttctcagttttcataccctacctgggtatagctgtgggtatctcatgcttcttttaatcctttgattttcaggcctacatatctctttgcttattggacagccaccacctaatgttctatagataatcttcctaaatctttttctaatttggctattccctgtcctgattaatgcctgggaagttgtccctgattcttttttcctgtgtttatgggcaacttccagaactcattgccctgttttaaaatattgcaatatcttgtttacagacctgttgtctcattctttacccgcagctgagtaaaaattaactacaaatttaaacatactcttttcattaaccctgaaagcctgaattttataggtcttaattatgttgtattgatgacagttgtccaaaaatgagtttttctctccgcttccacatatacttatcagatacattttcttatctaatgtacataagaggccactgaaatgaactgttatgtccatgcctgaaagttagcatctcagactaggtttctggcttgtataaatataacttgaagtttaaagagttttaagttttggccaggcgcagtggctcacacctgtactcccagcagtttgaggtcccgaggtggatggatcacgaggtcagaaattcaagaccagccaggccaaacatggttgaaaccctatctctactaaaaatacaaaaagttagctgggtgtggtggccagcacctgtaatcccagctactcgggaggctgatgaggcaggagaatcgcttgaacttgggagatggaggtcgcggtgagcggagatcacaccactgcactccagtgggtgataatgcaagactcagtctcaaaaaaaaaaaaaagtttgttttatgagccaccattacccaaagttcacattactcttttctcagccactctctgccttctctataatctagtcatgtaaaagcacttacccagtcctaggcatcttttttttttttatgctgttgtcccattgtatgtgttttcatagccaaaattgtcctctctccactcctacctcaccttttttttttttcctttgccaaacctcttactccttcaaggtcccactttattttatgaagccttccttgagcctatctttattatagctcttttgtagagatttgtaattatttacatatgttgtttgcctgctacactttgagctcctaataggcagcgatttgtatgtgtgtgtggaggggggtctggtgtatatatatgtgctcagtaaatgttaaatgtcttatgtcatttgacatattcaggaacaggtgagtggcagaaatcttcagagaactgatgtccctcaaacttttaagtgcatttaagagtaaaatcataagaatttactactacagagttcctatagtgtttgaattgaagttgctcttgtattatttgtggaggaagcaaatagtctattcaggctttcaggaaaatgtgtgaactgtaagcatataaactttaaaaaaaattgtgtacataattgatgtgctaattccaaaccattatcaatctcttaagtagcccggctggttagactagtgtccgttgcattagtataatcctatagaaagctgtatgtgatttgaatactgaagtgacattttaaattttgcagttcaggctcttcactaattttattgttccttttccaaatcattgtttctcaaaccctcttaaattcatatctcactagctaaggagatttttatggttttcctttctgtagtaaattaggtagaataataggggggatattttggggtggtgttagtggtggtctgttttccagatatcctgtatctgaatattcagtaagctttttgaagctacttacacatccgtaaaacttctcagatttagtgttctatttcctgcatccttgagaatggctaattgttttgaactggtgattcattatgttgtgattttattcctaaactgactataatgatgtaaagtgacttttcatcactttgtatcagggaaaaaaaagaatgcagctattacatgggcatactttagctcttgagcttgtgcattttgacagtaaaactatgacttttacaagtaaaccgattgaaagcatataagctattataatcgagcagtggctcagttgtaaaaagtcttcttggggttgaattcacatcttgtggaaaagccaggggccacatagcagatcagtcttggtttctcttcagtcctatcttattttttatctgaaacaatataaaccagcttgccttttatcttatttactgttattttcactgaattgtttttaatggttaaacccatccccaataattaattagcttaagatattggagcgaatgctgtaggatctgaaattgtttttcagaaacagttaatgttttgagaattgatgtcattttagacttaaatgcttttatgtttcctgtctacttgtgtgtgtgtgtgtgtgtgtgtgtgtgtgtgtgtttctttttttttttttttttcctgagatggagtctcgctctgttgcctaggctggagtgcagtggcacgatctcggctcactgcaacctttgcctcctgagttcaaatgattctcctgccgctcagcctcccaaggagctgggattccaggcatgcgccacgacgcccaactaatatttgtatttttagtagagacagggtttcgctggtctcaaactcctgacctcaggtgatccacttgccttggcctcccaaagtgctgggattttaggcgtgagccaccaccacgcccagcccttgtatgtgtattgtaataatgtttactttttaaaaatcaatacattatttgttacttttcagttttttttcctcttagtatttattcttaggtatatgtgtggtttttgaaaagccatcttctgactttaaaaagcactaattttgtggatgctgcagtgatgtatcgttatggtttttcttctgcctaggctcagaatttatcagaatcaggtggttaaaatcaggcctgttggtcagagtggtagtttatattttggtttgttagcgctgtttcttccttatgacattagatactactcctctttctattgtaattctttcaatatcattaatgttgctgtcagtggaggaatgcaaggaagcatatagagggcttgtgttttgtgtagttttactttagaagacccttaattggttggcctttgggtttttgagaaagcatcatgttaaggaattacaccaaataaaatttaaaactgaaaattttgaatcatatagtcagaactctttgaatattgactggattctaatgtgtatgaggaatttcctttttgggtttggatattatgtatcatttaggattgtatgctggtagagagtattgttaactcgataacaagaattaaaatgagaaaaaaagagtattagaacagtcttgggatctggatgttgtcgtttttattttggtttttagtgttttgacagtgagcaaatccacttggctgctttttttttttttttttttttttgtcttcttgggtaaagaacaaggttgaatttgataatctccaaggtccttttcagaataaatgatttgagacctgtacaggagagcctttcgatttttgtactttaatttctgctttcaaatatttgttctgtgtcctgccagctcatggtaactttccctgcccgaggtagtatttatggcttcatttgtttgtgtggagacgaatggaatattttcccccaatgttcatttaatattttcatcagtatatagagaaggatggaacaggaaaatagttatctctggatttattaggtttaaattgagaaacaaggttgaaaattttcacaactattataaacaaatcttttatagtttttgctgtatgtactgtatgtactatttgtttacaaattttgtttatgtaaaaagtgatttactttgtagccttgttaatacagctttcaatttagtaaatcttaagctgcttgccagatacagtattcattttctgcttaagtcaggaaatactcattttgactcttgaaatagtagatactaagcattttaaacttaatccactgggcaaatacaatttttatttctggtgggtttaatttttttaatgaaaaatgaatttcatatttcagaaattcttgtgtatttgtattttaaatgtatggctttttctttttcccttaaggcactcatggtgttgaagaacaaaggcattatatggttttatagtgccgtttaagattgagggaagggttgttactgttttaagttaaagttttaaggttgttaaggtatataagtagagtgtaaatattaatacagtcagccttatatatccatggattccacatctgtggtttccccaaccacagatagaaaatatttgggggaataaaaggatggttgtgtctttactgaacatgtacagacttcttttttattccctaaggaatagggtataagaaatgtttacattgtaataggtatcataagtaatctagagattttttttctcttttgaggcagagtcttgctctgttaaccatgctggagtgcagtggtgctattttggctcactgcagcctccacctcccaggttcaggtgattctcctgcctgtctcccaagtgtccaggactacaggcgcataccaccacgcctggctaatttttgtatttttagtaagagatggggtttcgccatgttggtcaggctggtctcgaactcctgacctcaagtgatctgcccgcctcttcctcccacagtgctgggatttataggcatgaactgccgcacccagccttagaggtgattttaagtacacaggatgtgcataggttatatgcaaatactacactacttcatataagggaattgagcatctgtggaatttggtatcagctggagcatcttagaaccagtctcccatggatactgagacatgactgtacctaaatgtgatgatttattttttgtgaaaatggattttttcaaaatgcagatatctagaatcagttaatatttgtaaagttgtttgcttctgttgctgtggaatggaaggaactactgaggtttaataaaacttaagagttgtattaacttaagttcatttttgtatcttggtttcccttattttgcttagctcattgttctcccttatccccaatatccacgaatagctcgtgaatttgttcactttttctaggttgggccatgattgtttcttgctctaagagtcatactaccccaccattccctcccagttcattctccacattgcagtcagaatcaccttttaagaaaagcacacttgcttgttctttttgtaaaaatcttttattgcccttaaaatgaagcacagacattacagtggccaactcctatgtctttctacttttccacccctccgctttgctctttcattgaagatgttctttgaggtaagagttctgacttatcttgggtacctcacacatgctttttctttctagaatactctctttccatcagctccttttgcctagttaattccttatttttcaggcttcaacttaaaagttacttcctctgtcctctcaacccccaagtctaggttacttagcatatccgttatcacatataatagtttatgatgatagtattttagtgtctgaaacagaattgtgtgttttcccctcccaaacctgcttttctcaggtcttgggcattttgttaagtggaaactacagtttcccaattgccaggccagtaatcttgagcctcctccttaaccggtctttctgctttccaaccttctactcttcagtatctttatgtagcaatgagctccagttactcttctgctcaaaaccctctcagatgtccttgcaagtggctcatgaggccctacacgttgttaactcctgcctagcccccttacctctccaaccttatatctctgagttatgctcttcacttaggtttactcagtcacatgaacattgtagttccttgagcattccaggcacattcctgccttacattagagaaaatgttattcagtgatacttgtttaaagcacagtaaggaagattttttttttctgggactattgcagtagatacaagaaccactgcaaccaggtcttggggttggtgggagtgttgggctcaactctgaatgcagcatgagcaagtgggaattcatagcaaggagtagtgtaggagtcagtgggtggaaaattactaaggaaacatacagtggtgagggggatttggctaaaccaactgctatggtttgagtgcgttccctaaatttttatttcttggaaacttaattcccagattcatatattgatcgtatttggaggttgggcctttggcaagtaattaagattagataagtcaccagtgtagggcccccatgatggcattggtggctttgtaagaagaggaaaagagacctgagcttgtgtgcacttgacctcttgccatgtgatgactggcaccatgctgtacaactttccagcttccagaaccacgaactaaatgagcttctattctttataaattacacagtctggtattcagttatagcaacagaaaactaggacaccagccaagcaggattcctgctgaatattggccagggtgattagacatcacctgggagatagtggaggatgagaaccctgatcagatatcgagcatatctgtttgagatactgatttcctttcctttggatagatatccagttgtaggtttgctggatcatatggtagttctattgttaatttttaaagaagcctctattctggtttccattatttccaccaatagtgtacaaaggttccctcctctgcaccctcaccaacacttaacctcttgttttttccataatagccatcctaagaggtgtgagctaatagatcattgcagtttgatttgcatttctctgattagtgatactaagcactttttaatatacctgtcaaccatttgtatgttttaaaaatggtagattcaatttcgttgcccattaaatttttttttttttttttttttttttttgccattaagctggtgagttccttatagattttggatacttaaccccttatcacaaatatggtttgcaaatattttctactattttgtaggttgttttttcgttttgttgatttttttctttttttcgtgcaagaagctttttagtgtgatatagtcacacgtatttttgcttttgttgcctgtgcctttggtgtagtattcaaaaaattattgccaagaccaaagtcaaagagctgttttgtcccctatgttttcttgtgggagttctacagtctcagaccttatattttcagttgttattcattttgagttactgattgtatatggtgtacaacaaggatccaatttcattcttctgcgtgcggctatccagttttcccagcaacattttttgaagaggctttccatttccgtttctcattgtgtattgttgtcaaagcttatttgaccgtggaagcatgggtttatttttgggtgttctgttgcattggtgtgtgtttctgtttttataccagaaccatactttttttattattaccatagctttgtaagatgcttttaaatcaagaattgtgatacctccagctttgttctttctcaaaatgcttagctatttgtggtctttttatgttccctacaaattttgggagtttttttttttgtgttgaaaatttcattggaattttgataggtataagtcacggttatttaagttgaacagcctttttctaataacaactggtaatataggtgtttatatcctgactcaggttcctgtgccagatttttaaagataaatttgagtgccttgtaatattgactaataaactgttaggcataatttaatgcattttcagtgccaataaaaatcaccttattgaagcaatgtgataatattataaaactgtcaatattatacagtgtcattagctatataaaggatatgagattttcttttgtataaacagtcaaaattggaaaataaaggaatagttgtaggctgggtgtggtggatcacacctataatcctagcacatggggaggccaaggtgggaggatcacctgaagtcaggtgttcaagacccacctgaacatagtgagaccttgtctctacaaaaatttttaaaaatcagctgggtgtggtggtgtgcccctatggtctcagctgtttgagaggctgaggcaggaggattgcttgagcctaggaggttgaggctgcagtgagccatcattgttccactgcactccagcctgggagacagaatgagacattgtgtctttaaagagaaaaaggaatagctttattaaaatggtcctggaatgtggaaaaaatgtctttggatagattttgatagatgttaagaaaatactcttaggggtcaggctcagtggctcacgcctgtaatcccagcgctttcagaggccgaggtgggtggatcatgaggtcaggagattgagactgtcctggctaacattgtgaaacctcgtctctactaaaaatacaaaaaattagccgggtgtggtggcaggcgcctgtagtcccagctacttgggaggctgaggcaagagaattgcttgaacccaggaggcggaagttgcagtgagcctagattgtgccattgcattccagcctgggcaacagagcgagattctgtctcggaaaaaaaaagaaaatactcttagagtcacttgaaacactttgagaaactccttgtgggtcatcttttggcctatctctttccttataaaatatctacaagaaaactcaatctttagagagaaaactttgtgaaattatttttctcctttttttttctgttgccactttgttctctagtgtttaaaatttaaagattttattgaggagagtgatttacaatcagaccttaagcagttagggagctcagcctgcggtgtttgaggggaaagctaatatagggtaaatgcagaagcagcgcaaagaaattatttgatttcttaatgtttgagcagttgccttatttggactaagtgggaagttcaagacattgtaactaatacctatttggccacctgtgattggctgagtgtgtttcattttcattaggaagccgggtttgtttaattttaattcttttgagttatgtgtagcaatctatttgtataaatataaattgtaaaaaaaaattatgtaagtgaaccacctgtgttatgttccaaaattttctattttttatgttgttcctcattgccttcattgtatcagagactaaaatcatgggtattaatgaaagcaagtaaaataatagtgagtttgctttacagtgaatcaataaagtctggtgcactcaagaaattcaaggaatccaaaggtggtgctgtcctgtggtaaagataagttgcaaagagtagaatataatttttgtgcactgtgggctttttacttgatacagttggctggcccttagaggtcaagtattgcttttgatgttattggaatgttggaaaatatcagaaaatcctagaatgacgaatacgggtagttcatttggtgcaaatcaacccagctcaatttgttaatataacaaatagaatgtgtaaaataaagctttggaggtgggtgtaatattttccatgagacacttaacgtagtacgtaaatatatcaggcagcctagtgtgtcaagtactgtgggtatggtagacaacagattagttaaatctctgctctcgagaaacctgatgtgtgtgtgtgtgtgtgtgtgtgtgtgtaagtctgatgttctcttgggtgcgatagtatatgagttggtgatagtgctgtcttgtagaaaaataaagctaggtaaaggaggaagtagtaagatatgcttgggaagtaggagttgcttttttatgtaacaatgaggaagctaagcctgtggctttgggagtgagggaagtgtgttctaggcagagaacagtaaatgtccaggccttatggtgagagtgtttgtttaaacaagttagctaccagtgtgtttctggtgggaaagtaatgcaagatgagttcagggaaggagtaacgagttgacctaagaaggaaacggaggcaaaattaatatagagatttcctttggaccaaggttgagcactgcagccccaaaaacactgggaggtgttctgtttagcatttgtgacaagcaagtttgtaaagacaaggaaacaaggagtgggctgatacaaggatgtttgatggcagttcccactggtttacagaaataacactgattattgttatcgttaatgataagggataagttaaggtgtccagcatatcattgttaggttaatttacggctacttggtgtcagtctagaacccacatagcaagaaacttcaagaggtgattagttagcttgagcggggagtgagacatgacttcgtgtcacatttcattgcctctctgggcctgatgaaagggttcacattcctcagatagatgtttcttttctttctcacaagggctagatcatgtaaggtcttgcaggcttttggaaaggattttggtttttcctctgaatagaatgacttggattagggtaatgacaatagatgtaatgtgattctggataattttgaaagaatcaactgactgatgaactggaagttaagaacgaagaataaggccaggcgtggtggctcatgcttgtaatcccagcactttgggaggctgacatgggaggattgcttgagcccaggagttcgagaccaggctaggcaacatagtgagactctgtttctgcaaaaaataaaataaaaaatttaaaaattagccaggcatggtggtaggcacctgtagtaccagctgctaggggatgggaggcacctgagggggcaatcacagatagcttgagactaggaggtctagcgagccgtcctgatgccactgtattccagcctgggcaacaaagcgagatcctgtcgggagttaggagtgtgtgtggggggcacgattttaagccgaagcaggcattagctggaattgcttattgagatgaggaagactatagagcaaaatgtttgtggtgtgaagagaatcgggaattttgtttttttgtgtcgtcttatgcctgagattctggtttagacaccaaacagatgttgagtaggcaaataagtaggtagagtctagagtcgaaggcacagatttgggctgaggttatctgcatgtacatggaatttaaaaccgtgaaactagtatattccacccagactcttaaagaaattgagtaaagaccaggaacctgcagactctgtaaaggacacatgtaaatatttttggctttgctgctatagagtctcttgcaaacgtagtagtattcaagtctgcctatatagtgtaaaagcagccacaggcaagatggaagtgaaggggtgttgccagctttgaccagtaggcagattttcctaatttgtacactcctgctgtagacaggaagttaaggctttggggggatccctgtgttactatgttgaggaggcaaggatatgaggagagactagcaaatgagaccgagaaggagtggcatgtgaggtaggaagagaacctagagaatgtctactgaatgccagatgaagagaatgtctactgaatgccagatgaagaggatgtctcaaggatatgtgagtgtatactgtgtctaggtctgccagtagatcagatactgtaataactgaaaatctgcaacctagagggcattgacattgctggagagcagttatcagtggacttgggaatatttcaaaatattttagcttatgttctatcttttaacatgaaatattgatggccaagttacacaaacagtaatacaaggtgatgatcagctacagctctccagaactgggtactcgccactcaattacacataaaggaagcccccatgtactacctgttctcagtcattttattctctaacccttctcttcccagaattgtcctgattttgtcattcccataatttgactatcttgtttctagtttggatttatccaaaatgcagttttacagattttcctttgacaagaatttaatccaaaatgaaaagttcacttttaaatgttttttttttaaagatggcataaacgatttacattagagcacgtgtgtatttaatggaatttgaccctgtgggaaaaaaggattatggaacttttaagttttttcgctaggtgggataatgggtgaaataatacaggttttttgaaaccccggcgtctttaacccctgggccacagaccagtacctttctgtggcctgttagcaatcaggcttcacagcaggaggtgagcggcagttgagcaagcattggagccggagttccgcctcctgtcagatcagccacggcattagattctcataggagcatgagaaccctattgtgaactgtgcatgcgaggaatctaggttatgtactccttatgagaatctaactaatgccttatctgaggtggaatcgtttcaccccaaaaccatcaacaccttcccaaccaccctctaccctcattgaattggaattgttgggaagaagggtaaggatgagaagcaggtagggtgcagagactaggagctgagtatgatctgtgatatgctacagacagctgagattagttctgttttctaatagattttctttttgagatggagtcacgtgctctgtcacccaggttggagtgcagtggcgccatcttggttcactgcaactttgcctcctgagttcaagtgattctcctgcctcaacttcctgagtagctgggattgtaggtgtgcgcaaccacatctggctaatttttatatttttagtagagacggggtttcaccatgttagccaggctggtctcgaactctgacctcaagtaatccgcccacctcagcctcccaaagtgttgggattacaggcatcagccaccaggcccagccaattttctagtagattttctatgtgtttttttccagtttcttaagagcagtgacaatatttgaaaatttgttgcaaatataatgattgatcattttacaaccatgattttttggtctgatatagtgattgatctggtattttacaacatgatttttggtctggtatgtattgtctttgcacataggagatgctgaatgatatggtgatttagtaagtgttattaatgtttctgaatttgaatatattttcagaacatatttttatgagataagaaaggtagtaaacattaataaagctgaaaacatttaggcatttcattctgtgcttatttgaagaggttaaactaattacattatggctatactgtaaccaaatatcagatgttgtataaattgtagtgcattaatgacagtgatagaatgaaaataacaaagttagcattagggcaaaacctctagcctgtggttgtcttcccagtttgtggctttgggctttttttttctttaatgctgtttttcaaactgtgaaaaatgtattttttactaccttctgcaaagattttcttgaaaaataaataacggtgaaatctgtaacaattactagtgtgcagcgggtgatcaaaaattttattttcttttgtgttttatgtttgagtaaaactctttggagttaggtacaaagaactatattactctttcagcatgactcttttattcaattttattttttgtagagatagggtttcaccatgttggccagggtggtctcgaactcctgacctcaagtgatctgcctgccttggcctcccaaagtgctgggattacaggtgtgagtcaccgcatgtggccgagcattttagcattactcttttcaagtaatttgattcttttccttctagttgggaagattagtaatacccagtgttcctatcttttcttaattttcacttaatggccaaccttagtgattatgttctaggaggtagaacaagtgaggttttagaggaaaaacaaaagagttaatagttctctattttaggaaatatttgttagaattcttaaaatgctatattttgtaacagtaatcagttaagtttgggaatttttatagtatattttgacataaggtatctttagtctttttggttcttcaacatgttttagatttgtggcagtttaatgatagcaacacaagagatttagtatacagtgggtttgtttgttttttgtttttgtttttttgagacggagttttgctctgtcacccaggctggagtgcagtggcgcgatctccgctcactgcagcctccgcctcctgggttcaagcaattctcctgcctcagcctcctgagtagctgggactacaagtgcatgctgcctacacccagctttttttttttttttttttttttttttttgtatttttagtagagacggggtttcaacatgttggccaggatggtcgtgatctcctgacctcgtgatccgctgccttggtctcccaaagtgctggaattaaaagcgtgagccactgtgcccagcttagtatacagtatttttaacaagaattatagtaaaatattatttgaatagaggcttgttttctgaaacaccatccaatctgaaagtagaagaaaaaggctgggtgtggtggctcatgcctgtaaccccagcactttgggaagctgaggcgggcggatcccttgagctcagtttgagaccaggctgggcaactccatctttaccaaaaaatacaaaaatgagccaggcatggtggtgtacacctgtagtcccagcaactctggaggctgaggtgggaggaaggcttaagcctaggaggtggaggttgcaatgagccaagattgtgccactgcacgatagagccagaccttgtctcaaaaaaacaaaaccaaacaaaacaaaaaccctaggaacaagaacaatgggaagggaaaatgtcctgtggtcagatactgttgttgtagctagaaggcaaaaatgagtttttggattaagttttgatgctgactgaagtcatagagatggaagaagagaagacagagaaggccatggtggttagaggagtagtgggagtgatgaaaacacattagtggaaattaaggaatgttagtggggatactgaggagcagtgacaaaagaacatccaccaacaatgtctttatcattagggacaaggagaacaataccacactactcatgcttgttaataggcaggagaatagacataaaggttatacttgggtttaaacctcacctgtttatatttagctagttttttaggggaagaaaaatctattttgagataattgtagatttacctgcaattatgaaataatactgcagagaaattcagtatacccttcatccagtttgccacaatggcatcaccttgcgtagctgtagtatattatgacagcctcaaaattgataatgataatccccattgtctctattgagattttactagatttgcatgcagtgtgtgtgtctgtattttgttccatgcagggttggttgttgttttttgcatgaatacgttaaggtgactaccgccacggtcaagatacagagcagttccatcacaagaattctttgtgctactcttttaaaggcacagcctaaccttccataacccttagtaactactaatctgttctcagcctctctagttttgtcatttcaggaatgtgttatgtataaatggtatagcattacccttttgaaatgtgctttttttcactcagcaaaattgccttgaaaaccatccaagttgttatatgttcctgttttaaccgctggtttgaatgtcccacaatttgtttaaccatacgccattgaaggaaatgtggatcgtttccaggttaaggctgttagcagtacagctcttataacattcatgtacagattcttgtgtgaacataactttttgtatctctgtgataaattcccaagagtgcaactgcaaaattcatatggtaggttagctgcttaacattttttacttttgttttaaagagatagggtcttgttctgtcacccaggctggagtgcagtggctcaatcatagctcactgcagcctggaactcctgggctcaagcaatcctcttgcctcagcctctggagtagctgggactacaggtgtgcaccaccccacccagctctgcttaatgttctagtgacagttaaaagcagaataatcttcacttattgtcatcaattatcaaataatattattataaattgttactgtttttatctgttgtcttctcattacatttttctgtaggttattatggaaatacctgaatttttaaaaggaatttgctagatgctaatttttaaatgtaccaaattagcttttcattttgctcataaaataacacaagcagctctttctgtacaacctgcactttaattttggtcagtacatactgtataacaaatacacttcttgtttaatgtatttaaggtaatttattttgagcctgtcaaactcttgagctagtatgtttttacaggtaattttgctgccactctgtattttcgagatgtttaaaaatattagagtgtgcagaaagcaggagcacaatctagaatctgacatttataccaaagtttcatacttatagtactgccattgtgttaaaaaaaaattagagtaaaatatagtactgaaggctacttactctgccttagacgacgtaggagacttgaatcttaaaaagcacttcagttttgtttgatgcctaataaagcttggaaagtcagacaaagctccagggaagaatactttctgtcttactcttttggtgtcttataccagctttggcatataataaatgttcaataaattaaatgtttgttaagtgagtattgtgtgtgcacgtgtgtgtgtgcatatgctgggagtagggtggggcaagtgttgactgtttttataaaaaaatagaaaaagtgtgaggaatatattttgagtaaatatttactgtataatgtcagtccttggacacaaaacaaattaagttgtcaaaataagcacatggtaatcagagtggctattgatctcagacagtaagcaggtgagtttagctggatttggtgtacactgtcagtcctcaaagtacagctactccatttgtgaatgtatgttgatttttcttatgattgtctgtattctgtagtttcctctcccccagtgtattcgagaatgtcttcctattgcttttactcatgaatgacatcttagattggaaaataattttctgggtcacatccagtttttttctcttaccataagacattactccattgtcttctggcatttagtgttactgtggaaaagtccaaggtcagcccatttttgttttgtaagtgatatgcttctgctgggatgcttttagaatttttgttaatgggtaaaattcagcagctccaccaggatatgaggacatgtgtcagtttttttcagttctttatttttgctggtatgtggtgagtccttttcaatctgcagattcagatcttcttttatttcagggaagttttgttttattatccccttgaatgtcctccctgtttttttttttttcaggaccttcagttttgcatatattggcttcatctttcatattgggcatcttatctctaagtactttacatttttgtcttatgtgctttatggtatttctctgttctgtttccttatgattgacattgctttcagtcatgttattcttttgctacttctaatgtggttttatttttaaataatttcatctttttccttaagttcctctaaattccagctctttttttttttcttttttgttggggggactttatctaaagtttttggtttcctgaaatttctttcgaagtatattttctttatgttgtatacccccacttccatgtctgtacaggctttgtgtgtgtttgttttgagtggatccagtgtggatagtatgattagatactctctgattctgcgtcttactcttttggacactattttaattgtgcccttaaaatttggtgtttgtaatctgaggccaggttaaggaaagagctatgaaaggcatttatttggaagagagtgataaagtgaggaggttatatatttactctgaaggtttacagtatttgatgaagtctcttcttagagattacacctggggatccaggcaaagatgtagggtggcgcagggctcccttctgacaattctctacatcactgggccaaaaaaaggcagtttattggtacagatgacccttctctcccacctcttctgcctgccataagttttcaaaatatgtagccttgacaagaattggaacttgtaccttcctgcatttcagtgtgggcttttcttttttttctttctttctttaaatggagatgaggtcccactttatagcccaagctggagtgcagtggcactatcatggctcactgcagccttgacctcctcagcttaagtgatcctcccactccagcctcccaagtagctgagactaaaggcaggtaccaccacaccgttgtagagatgggggtctcgctatgttgcccaagctggtctcgaactcctgggctcaagtgatccgcccaccctggcctcccaaagcactgggattacaggcctgagccacctcgcccggcctcagtatggatttaatttgtctcttgaaaccatttgtcagagacggtttgttgagttatgacttgccttgttagatttgattacatattctttttggtccctttagttatttttgataggtgttatagagggcaaatacagaaacatattctcaaactgtcttctttttgaaagtttacttttaacgtaattttcagtgtcagtttgctgtcggattcatctgagttgtttgcaaaaatacattattccagttgctgaattaatggctttttaagtcaattggaaataggtcttttaagataactttcatatgattatttcaatattagatactaagttctttttttgttgttgttgttttgagatggagtcttgcactgtcagccgggctggtgtgcagtggcacggtcttggctcgctgcaacctccacctcccgggttcaagcaattttcctgtctcagcctcctgagtagctaggattacaggcacccgccaccatgccaggctaattttttttttttaatacttcaagttctagggtacatgtgcacaacgtgaggtttgttacatatgtatacgtgttccatcatggtgtgctgcacccattaacttgtcatttacattaggtatatctcctaatgctatccctcccctctccccacaccccacgacaggccctggtgtgtgatgttccccttatgtcaggcttatttattacagagacggggtttcactatgctgaccaggctgctcttgaactcctgacctcatgatccgcccaccttggcctcccaaagtgctgggattacaggcatgagccactgtgcccggcctaagttctttttatatgagttgggaattccaacacccagataaatagtaattagagaacatatatgtccctgtgattacatacaatatatgcattgtacatgtggattacatacaatatatgcattgtacatgtggagttgctgttaaaaatgatggtgtaagaggcacatttattgatgaatgaagaagttcctggatactaaatagaaaaatccccacacaaagtagcatgattctatttttggttacaatatgtacatatagaaaaactataaggagactcaccttttctaagtgtttttctatagcctgttaatactaataactgttctttatagaaaatcagataaaatagtactgcagtttttaaaaataatggtaaaaatagatttatgagaatttcgttcttgtgcctggtggtaaatgatcattatgcaaaaactttttcatattaaggaaacattcatctattcctacaattagttgttaatgctttgttggaaatctgtttgaatgttatcaactgctctcttttgatagcatattttaaagacataaacatttaagaattatatttttgccagtctgattattcagccattttgtattcctgtgctaaggggtgtatatagttgtgaattctcttattctattgtttgtcggcattttgcagttgattacttttatgattgaatctgtttctggagcatatatacactgagaattaatctctgaatgtttgaaacagttcctcagtgaacttctataatctagttcggctagagctgtggctgggcaaggaggttggtggggaatgcaaagattgggactgaagggagagtgaagagatatgtctagagatgttgtcatacatatggtttgttggggcttcccctccagtaatcattgagattctgtttttatctttagtacagtactttatagtaagtaacatttccatctgtttctttttgtgtataaaattggtttaggcagtgtggcaatatgtactttcccttgaataaacaaccatttcatagttcaacagcaccaaaagtgtccaatattgggttatcaatggctctatccaaaaatgcacctctggttgtctcagcataaaagcaggatgactaagcacccaaaacagatggagttttagaataaatactgctttgtgagcacatgtctcagctgagacacatgagcagtattgaaattgccttatctgtaagggagaatttacttaaagttttccttgaggtaactctgctgtaatacgctaccttttttctctctttaataccacatatttttgggaaaagtactattccaatttattttattttgtacagataatagagtggaggctagagtaattttaaagttactagttaccaacttttattctaagtatttttagtgggtattacaggtatagtgtgttgtcttaaaacttttttgctatgcttataatagttgtatttaatagatgatgtttatattcttggatatgacactaagatttgttatctccagccttcggcagctcatctgcagacactctctgtatcccttattattaaatgatgctgtatggagcccagagggtctaagaacagactgaattaagagttgatccttaatcacccactatcctgttgcaataggagcagctctgcttttaagtattggactttcattcatgcatttattttattttggagtgtactgtcagatctgggcactgttgtaattatgaaattattccagtggcatgtcaggaagatccctgtcctcagagtttctcttctagtggaagagacagacaatataaaatatataaaaggataattgtgtgataaggaaatagtgattcaaacagtagtgttagtgacgtaggcagagtagttacattggtcagggaaaggctgacttatgaattaacacctgaaggatgaacagccagccatataaggaaagaactctgtggctttaaatagttggggaaaaaattagataactgtttttctagaaagactcttcttctttagttgtgttatccttaaagatatacttttttttttttttttttttttttttttgagttggagtctcactctgtcacccaggctggagttcagtggcgcgatcttggctcactgcaacctcggcctcctgggttcagacgattctcctgccttggcctcttcgagtagctgggactacaggcgctcgccaccacacctggggtttcgccatgttggccaggctggtcttgaactcctgacctcacgtgatccacccaccttggcctcccagagtgctggaattacaggcgtgagccaccatgcctggcccttaaatatatacttttcatgtgcttttttgtgatgccgcgagtactattcagaagcatcgaaaaatgcttaaaagtgaaaagtaaataattttgagaatttgttattcagaagatgagatctgttctttctttagtttagtatccaaggccccttagtagtctagcataacagctttacacatctgttacatcgcaggtacagtaaccgtgttcctgtcagactgttgtactttgccctctgaatctttatcaccatgtactttcctacttttatgctgttgttcataatgtgtcccttgactgaaggttgttgtctactgtaccaagttgaaatcttctgtgtgagatgatttttgtagcttgccttactttactatcttaatgtaactcagacagatgaaagcgcagcatgtacttgaagattgctttgtgctcattttcactccttttcagattgagaggtgagttccatgtggcttccaaagttgaaatccacttcttggttaattagggtcaggaggtaaaattacttggagacacctatgtgtatgcaggtacctgcctctgtttctttttgccttctgttcttgtaactctaatcagtcagcttggaaaagggataatactcagttttttagctatattacttgctcaccttttagaatcttattataatttgataaatttttataaaacttactgttttacactaacctatattttttctctcagaggaatgctttcctcccttagaataactacttaatttaaaaataaaacagggagcaatataggatgtaattacactgcataaaagcagctgttgtccaggcacagtggctcaggcctgtaatcccagcactttgggaggccgaggcgggtggatcacgaggttaggagttcaagaccagcctggccaagatggtgaaaccccatctctactaaaagtacaaaaattagccgggcttggtggcaggtgcatgtaatcccagctacttgagaggccgaggcaggagaattgcttgaacctgggcagcagattttgcagtgagccgagatcgcaccactgcactccagcctgggcaacagagtgagactctgtctccaaaaaaaaaaaaaaaaagccattaaggagagatgtgtgctatgatgggggcttgctttaaatttggtggtcaagaaaggcttttctgaggatgtgacatttaagctgagaaatcaaacatgaccaagaaatagagtgggagatagaggagagtagatacagaatgtataaaggatctaaaaatcttactcttggctgggtgtggtggctcacacctgtaatcccacactttgggaggtggaggtgggctgatcacttgaggtcagaagttccagaccagcctgggcaatatggtgaaaccccgtctctactaaaaatacaaaaattagcctggcgtggtagtgggcacctgtaatcccagctacttgggaggctgaggcaggagaattgcttgaacccgggaggcagaggttgcggtgagccaaggttgcaccattgcactccagccttggcgatgagagcgaaactcagtctcagcaacaacaacaaaaaccttactcttgaaatcttagctaattccttagtgaaaagtcagatggcaggggtcaaaagaagttagaaacattcataagtatctcattttagactttgttgtgattatttcagctgtgtacagtgtcaggcaatatcttatttgacaagtgaccacaggtgggcccccacctaggtagaggcaaaatctgaagtgaagcccagattgcctgattgctagtctcactaaaggagtggctcttaacatggttagaccagccatctcttttaaaaaatattttacatggctatttttttttctatttttaagatatttgttagtattattgtagagacagaatctctccctatatttccctaggctggtctggaattcctgattatttttaaaaatcgagatgaaattcacataacaattgtcatctcccccccaaaattactgtatacccattagcagtcactttcattttttcttctcaaagcccaactccccaattactgatctactttctgtctctctagatttttgttttctggatatgtcatataaactgattacacagtatgtggtcttttgtgactggcttctttcacttagtgtttgcaaagctcacccatattgttttacatatcagtacttaggctttcgcttcctaggttaaaattttactccagtaattctcagagcctataaggtacatttaagccataagagaatgtcagtacagcttattccagattcacagtcgtgcaccactttctattcaaagcatcccatgggattaggtgttgagaactgaagaattaaggactgtgtctaagctagacaaattaaagtcacatgtatagtagattgctttttttggtgggggcgtaagttttatttatgtgtaattcacataccataccattcagccatttgaagtgtatagttcactgatttttaatatattcacagttagtagtcaccaatgttctaaatcaactttagaatatttatatcacttacaaaccctttaactgtcatcccccaacacccccctcaccctcagctctaagaaactattactgcattttctgtctcgacaggtttgtctattcttaatgttttgaataaatgggctcataccatatttgatcttttgtgactggggtatttcacttggcatatttttgagattcatttatgttgtagcatgtattagtactcatttctttttgttgctaaatgatattctgttgcatgattatgccacattttcttgtcaattggtaaacatttggtttttattttttgactttaagaataatgcattatgtgtttttttgttttgttttgtttttgttttttttagacagtcttgctctgtgtacagtgtcacgatctcggctcactacaacctccgcctcccaggttccagtgattctcctgcctctgcctcccaagtagctgggattacaggcatgcgtcaccacacctggcttatttttgtatttttagtagaggcggggtttccccatgttggccaggctggtctcaaactcctgacctcgggcagtccgcctgccttggctgcccaaagtgctgagcttacaggagtgagccagtgtgcacggcctgttgctgtttttgagacagtgtctcattctgttgcccaggctggactgcagtggtgcaatctcagctcactgcagcctctgcctcccgggttctggcgattctcctgtgtcagcctcctcagtagctgggactacaggcacacagcaccgcacccagctaattttttgtatttttagtagaggcggggtttcaccatgttgcccaagctggtctcaaactcctgagctcaggcaatccgcttgcctcagcctcccaaagtgctaggattacaggtgtgagccactgtgcccagccaagaataatgcattatgaatattcatgtacagtgtttgggcatatattttcatttcttctgaatatgtacctaggcgtgggattgctggctcatataactgattggttggtcggtggtttttttcatctctttttcactgctttattcttgtttgccagtatagtgccagtacattttaggtacacaagtagatgtttgaatgaatgaatgaatcaatgaatcaaagaaaaagttacattaatggtacctagagcttattatttggtaaatgttgatgttctgtttaacccaggattatagtacttgtttattattagtattttgtatatatcttcaactaatagaggatatcctgtttttaagtttttgtttgtgtaagatttagttgggtacatttgcagatttgttacttgggtatattgagtgatgctgaggtttggggtacgaatgatcccatcacccaggtactgagcatagtgcccaacagttagtttttcaacccttatctcctcctttcctccccttctagtagtccccagtttctgttgttgccatctttacgtccccgagtacccaatgttttgtttgtatatatgatgtgcttttgttcttttttatggctacagataactatgcttaacattttcaggaactaccagactgtttgccaaagcagatgcagtattttactttcacattagcagtttgtataagagggttccagtttttctgcatcctcaccaacacttgtttttgcctgtctttttgactatagctattctagtgggtgtgaagtgttatttccctgcaggtttgatttgcatttccccaatggctaatgccattgttcatctttgatatgcgctttggcaatttgtatgtcatctttgaggaaatgtttgttcagattttttactcatttttaatcagattatttttattgagctgtggagttcttactggtagaattaggtaaaagtcttaccagatgtatgattagcaacattctatgtgttgtcttttcactttctggtagtgtcttttcaaacacaactcagtttcattcttttgcacgtgccgcctcccattttaaaactctcctgtcgcataatgtttccataaatgaagtactgtgtatgtgaaggtgatctcataatgtatttttactgtaccttttctatgtttagatatgcttagatacacaaatactaacattgtattatagttgcctacagtcttcagtacagttacaggctgtatagatttatagcctaggagcaataggttataccacatagccaaggtgtgtagtagactataccatctaggtttgcgttagtacactcttaggatgtttgcacaacaaaattgctcgacaacatattgctcagaacgtatccttgtctttaagcagcacatgactgtatggtataaaatcgccatagtaatatatacataataacatatactgcctgcagatagaaataatgttacgtgtaattttcacaaactctttgtagcactgtgctaaaaatatgtagccatatatatatatttaagataagatacggcagtactgttttttaaacaatgaaatttgttgagtgtttcatctagcgtttatctctgccacttcaatgtttgaacctgtcaacaaaggaatctacttaatgtcatttgtttgtgacagatataaggcagatgtattatatatatagcattattgtcagtggtgagatttttccaagtagtgaacattttgataaaagttccaaaaaatgaccttattataaactaaagttgtattggttcatgtgtaaaaaagaattaagttttatacagtacaatttgcatagcagctgtattcctggaaaatttagcatgctgtgctaagcagattttggttctagactcagttaattataagcagcttgttttcagatgttagacagttctttgggagacatgtataatgcccagtaggcatccctggccccctttcactaaatatcagctcaccttcatggagagcaatgctgtccagtgagtctcatatgcagttttaagttttttagtagccaacatctggaatttcaattatatttattatttaaccagatacagctaaaatacttcatgtaatcaatataaaaatattaatgtgatattttgcatttgtttttttacctaagtcttggaatctagtatctattttacacatacagaaaatcccaattcctactagctgtgtttcaagtgcttagtagctatgtgtggccagtgactgtcattgaatagcacaaatgtagagggagtaactgtacaaccagctgtcaaattgttgatacttgttgtgatccatttttccctcccgcaagagacaaaacctggttagctataagtttcgcttttcaccaccaggtttcttgatatacagttggtaaattgcagaatgatattattataaactaaagttgtattggttcgtgtgtacaaattttttttagtcaaggataatgctcagaagttacttccatttccatgttcttacccctaaatagctgcatttttatcctaatggttttttttgcattattatctcttgaaagtaattgatttccatgctgagctgcttgtctgtgctattcaagtttttattagtactctgataataaagttgcataattttgaacggctttgttctatttttcccataagactttttaatatgcagttttgcagaattcagtcttttcaaggcgaacatttatcatgttatagcagaaaaaccgtatagtacagatatgtggctttcttggtgaaactcttttaagtgctgtggccgctggttaggagtgatgaaaggccaaggacactggaaggtagtacagcattcagagtaacagaggaagaagatcttgggaaggtactgacctgtagagtataataatctctgtaagtgaagagggtatgatcatcagtttatttttagcatattgccatcttttcaggggagattcgttgagtgtcctctaccatttgacttcgtaaacctttgtttcccaatgtgtggcctgggtgctaactatactagaaccatcctgggaatgcctattaaaaattcaggtattaagccaggcatggtggctcttgccttcagtcccagcactttgggagaccaaggcaggtggatggatcacttgaggacaagagttcgaaaatagcctggccaacaaagtgaacgtctctactaaaaatacaaaaattagtgggacatggtagcgtatatctgtagtgccagctacttgggaggctgaggcacaaggatctcttgagcccgggaggcagaggttgcagtgagtcaagatcgtgccactgcattccagcttgggtaactgagagatcctgtctcaaaacaaaacaaaacaaaaaaatttaaaaattactgtgaattagaatctctgagaaagacaactttgagatctacaatttttaatatactaaagattcagatccactactgagctttattcagtcctatttttgcttttgtctgaaagcaatatgagatggtagatgtctttgaattatttcatttagtatacagatatacctgttccttccttagtgtcttaaagagaataaagacactaagacttctaagtctgtggatctggtaataaattctggcggttgtcagggtctgaataaggacataaatgccataatattttgctcctgagtagactgaaaactgttgttccacctttttgaaagctggttgcctttcccactgccatttaatcatatagagttgtatgtcctccctctgctttccctactcctaatatcctggttcccttttgtaaatggaagggcattgtaattgcttaatgtccatttctcgctgagtcaggtatgttttgatgaattttttttggaccattttctgattattttcctaggccctcactctttgaaactataggttgtgtccttctcacccttaaattttagcttctgaagtttcagaagatgccaaatagggattattctgtcaaaaatactgaagattttgtcagggaaaatgtcattctcttgtaccgacccttggacggtggtctgaaactagcatccagtcatgttgttacatctccattttataatttgccctggctaagcactggaagggagaattttgctcaccatttaagttcttaaagttgcaagcttaagtatagagcccctatatctgtcctgctcttctccctaaaccaagtcattcccaatagcatccttttcttagactcctttaagacttaactttatcagtcctaactttaatttcttgaggttggtttaaatgtacaacatttaaaaacatttttatcccacttactcactgatacagtatttcttgggtagatgaatttttttttttttttgtcgttaaatagcgagcttttccttggtaatatacacagtgcataaaggtacttgactgtataaatggcattgcctccgttgcttttttggatcattgtgtgacccagtgtgtgacccaatgaagcaatggagacaatgctgtttatacagtaaaaagtaccctttatgcactctgtctctcaccagcatgtatatattatcttcctttgtgtgcttgaatactcactagatttgggattgaaattctgagttcaagttttatgcgtggattctgctcttactggataggttcagaagtcttactatattctttctcttagccttagattctgtattataataaaagaaatctaaaacttgtgaggtcgcatataaaaattcatgtgatattttaagataggagatttaaaaggaattttgtgttgtagcacttcttttcggtatggctctagaaaatcataaccaccattaccccagccttgggaaggatgtgcacaatcagtttgttcttctacttgtgtattacttcagtttggaaagagatacacggagaaagtaagaggctcaaatgaaataccaaagaaagtatgtaaggtaatataagctgaagcttttattctgagacatttaactttgtttaccttattattgtcattttattcaggggcaaatctgcactaccttcaggtccaaagggcatctttctagttggaatgtaaagatgtactgcctgccatgctttgtataaaacctcttatgtgaatttgaaatctgtttaagaatgttagtttattcttagtctttcagaaaaatatctttatcttactcctcacccattttaagttttgtttttgataagcagtctaagtaaatctccatagaatgtggaatctggtccctatccaaaaagctcttgtctttgaaaataatttccccatcaacaactgattccgttttctcttttagagaagtcaggctggtgtgccttgatgcttatgacttgattattatgctgtgccttctgaaaacacatacactagacctaaaagttagttggtaacttctgtcaggctggtggaaggcataccatttctttagaggtataattaattggaatgcttgtcagtatttgagttttcattgacttcaggaatagtcactaaagcggagtgaatttctggatcttaacctcatgagagaggtcaatagacctcatttgtaatataccttatgtttgtagaatacctgtcaggtctttcagcaaacttttaatgtggcactttcatttcatagatttaagcatagaacatactgttcaagaatgtgtgcaaataaatgtctgagtggggtatctaacccaggctttttaatggattactctgggatttatttcagtcagtaagattaggtttttttccattactgtcgacaaacttaaggaaattttcatggaaatcccactctgcgagtagtgcatatatattctagtagtccatattactagttctacttcttatattcagttgtaaatctgatttttaaaaaatctttggagttatatctgaaaagtagaaatttcagcatagatctcatgtttttctttaaaacttgaagtattaattttcctttgttactaagcattttgggatcctaaaaccatttgtgaggtttggtgattctctaagactctcaggactcaacatagtcattatcatgactgtgacttactacagtggacaggtgcaaagagaaaaggcacatggggcaaaatctgaaggaatccaggtgtaagcttctaagaattcttgcctaagagtcatacaggatgcacttaattcctccagcaacaaattgtgacacacttgtggaatgttgtctaccagggaagctcactagagatttagtgtgcacggcttttactggatttggtgagttatataggtactctttgccttgcatgtaccaaaatttcagactccagtaggaaagcaggtgttcagtacaaaccatattatatacccaaacagcttaggtacaatgagcgattcttttttttttttttttttttttttttttttttaagacgggttctcattatatcacccaggctggtctcgaactcctggactcaagggattcccctgcctctacctcctcagtagtcgggactagtgcaagccactgtgcctggcctcagtgagcacctctttcacctctttatcagttagggttgtgagatccctctggaagtctagattcccacatgtctgtcaagggccagctgtgccagaaagcctttctaaagatagcagtctctgggcttctgttaacttttcctgtatactcagcctttttgtttgtttgtttgtttgtttgttttttgagacagagtcttgctctgttgcccaggctggagtgcagtggcacaattctcagctcactgcaacctcgcctcccaggttcaagtgatgctcatgctcctgcctcagcctcccgagtagctgggactacaggcacacaccaccacgtccagctaacttttgtatttttagtagagatggggttttaccatgttggtcaggctggtctcgaactcctggacctcgggtgatccacctgcctcggcctcccaaagtgttcagcttatttttgactgatttcttcttgattctgttcattcatagagcatttattgaggatttatttcttgcttcctgttatttaaaagggggtttagggtattctatctatataagtagaatactgtacagcaagatgaaatcaaaataagtagaagaacccatcagacttcttaggaaatatcctctatcataccacctacgttgttcttaagtaaccattgtacttaggtaattctctttgatcttttgtgacatcactagctttcttgagtctttgaatctgcatgtagtttccattataagcagacccttatctgagggtaaatcttggccattgccttttttcctgtcatactcttacttcgtccatgaacttttttagtgcctgctgcttacatgcaaagcagttagtcacctctcctacctttgacttctaatagaaaagacttccaaatccacatctacttaacaccttttcttctgaattcctagttctgtattaatcggaccattttcacttggatatctaaaaccttatagtcatcatctgtctcagttcacctttcctcttaccatttagttgtttctattgattgaaataatattcctaactcatttctgcttttatccaccctggttctaactgataattcctggaccactggagcatttaaattgctctttgcacttctagtttttgttcataatagtgtagcctccatgccactcctagatcacttactaaaaaaaataccagttggattatgttactttgttgctgaaaaatctagaattaaggaatgatattgaaatactaacattagacttctgtggtgaacctttttgtgtcattcatcaaagtgtttttgcaagtctggatttttataccctgctttttcttaaagcaagagaaacttttttctgtggtcactgacatatacagattttcataaaacttgagttactcttaagcaatttttagatagagttggacctgttaggaaaagagtcttgatgtcatctttatcatcttataagtgagcaccttccctgagactctttaacttcttgaaaaaagttgatgctgttttatttgaaaaatcgtcaagactattaaaaggcaaataggggaaactgttaagaaattgaaatacagttgcaaaaacatactgataacagtgacttttagttctgtatcatttgagttcttgtgccttttttctgtgcacattgtacttctatttttgtccagtaaaactttaagaaaacccagaagttgctacaaatgataaagataaggttttgtttctctcaaaaaggttgttatatgctgctgttccaggacatatcaggatgacaactatgtataatatttaaagccacatctttagtaggttcacagatactttatatactataaaaagtatgactgtgtatatattcctaatgcttatgtaagatgttcgtttagagatataaaataatatctagtatgatagaaaacagtttagattaaacatgaaatacagtttacttgtaattcactttgttctttatttttttaagggaccagttactctccacaagaaaattcacacaaccacagtgctcttcatagttcaaattcacattcttctaatccaagcaataacccaagcaaaacttcagatgcagtaagtattataaacatgtccaatatggtttctttggaattttttgcaaaaaaaaaaaaaaaatacaacccatggcaagtcttgtaaaatctaatgtctttttttttaaaaatgtttcaatcacagtcttaatgtgtttatttgatattattattatcctattttaaaccaatgagccaagcttattaatggaactgaagagttgtcagaagatagtatctttggtattacttaattaggattcctgtacaaagcaatgtttttctgttgtgatatctgagataaaaagaacttcaggctgaaacttctttaaagtggtctaagttaagcttactttctttccatagtgtataaactccttataggatacatttattatctactgtgtcttacacactctcccagacgctagggatatacagttacctgtccacaagggtgtgaaacccagtgagggattttaaatattttcagaagtttagtttaatgaaataagttatttattttgaattttaagtcataggtttaaatgaaatttttaattcagcaaaaaattaataaggttttaattcaccaggcatatgctaagctgcatatatatggaatgtggcccatcttaaaggaattctgggacctgtggtagagacagaaaagtaaacaaatagtgcctgttaaagttgctttggagggtgctcaacacaggactcccagcttgggtgaggaagatagtaaagtataactaatgcttcccaacaggctgactaaaacttgggcagtaaaagagctctggacttcatagcatacaaaggaatagagcttgcaacgatgtagaagtgtaaaatagtgtagcacggttagagaactgccagaattttgacagtgtggaaaaatggcaggagctaaagttacagaggtaagtgggaggcatatcataagaagctctatgtcatgccaaggaatattaattatacatatataaggcagtggagaggtattgaaggatataatcagtaaaataacatcatatttgcaatttaaaaaattatctcgggtagcagtgtggaaatataggaaagaatgaacaatgagaaggctgacaaaggtgtaggttgagtccaactgattttgctttgagtatttgagtgatcatcatgtcttaattgacgttgaaagaccttcagattttatttttgtttcttgttgaagcagtgtggatagtacatttccatagaaaattgagacattaggataatatttggataaaaatagatagtattagtgtccatttagaaaattatactattggccaggcacggtggctcgctcctgtaatcctagcacttgggaggccaaggcgggtggatcacttgaggccaagatggtgaaaccccatctctactaaagatacaaaagttatcctggcatggtggcaagcacctgtaatcccagctacttgggaggctgaggcaggagaattacttgaacctgggaggcggaggttgcagtgagccaagatcaccccattgcattccagcctgggtgacagagcaagactgtctcaaaaaagaaaagaaaatcatgttaattgttttaacacagaatttaatatatgggattggttaagcagatactgaaaaaaaacaaaggaaccctcaggtaacacatacagtaatcaccactcaaggctattgaacaaccggatgaatttggggttttagaacccagtagcatagaggaggagccccacagagctggtagtaatacctctgagggtatggtgaagctagttctagtggtgggatggtagccgagagctggtaacaacggcggctgctcctttctcctgcctttcattcgtctaatgcttctaagaggaaggaagccatctggctaaatagagagtaatttgcactgtcccagctctagcatcacagagcggactatcaaagggtgggactgggactgagaaaacagctcgctaagccttcacgcgtgctatcgtcaaactatttgtgatgggtcattttctttttcctttcttttttttttttttccaagtagggaagggaggatgaggccaagtggggagaagggggggcaaatcattttcagtgagatgtatattcaggattttagaatgaatctgcctgttttcctggaaaacagtctattactttacaaagtaacactaacctaaagttccacttgtcattgacagtttagatttgctatttgtctactcctaggacagcagcagcccttgtgggcattgttttttttttattttgtaaaacacaaatgcaaacaaaacaaacacctcattcagggaagacaaactttgattattaggattttacagcagtgggtttaacccagtgaagtcagaaagaataaataatgggcgtagataagcttgaatgattcaaatcataagggtgtcagggaacttaattatgtgagtgaaagttgaagaccattactagaatagataaaatgttttgtgtttctggaatccgcgttctggtttctctagatttcacctgtaggtgcataagtagtggtcttttgcattataatgtacctagtgggaatgatacaaacagcccttatgaactgtaaatttaatcttacctgaaaagttggctttagagttatctacacagatatttgggtatgtgggtgattttttaaaatcaagttaactattaaaaaccaagttgaaattatcttttattttcagtatcagattaaggcgttaacatttaatgtacttccctgctaagtcctctgataaacatttattgtggggtgtttaccgcagagcctggcttatggtaaagattaggaaaagcttggtgaatgcctccttcacaaaaaagtcatgggaatgttgggcgcagtggctcacaactataatcccagcactttggaatgccaaggcaggaggatcacttgaggcttggagtttaaaaccagcctgggcaacatagtaagcgcctgtctctacaaaaaaataaaaataaaaaaataaatagctaagtgtggtggtgtgttcctgtggtcccaactacttggaaggctgaagcaaaggattgcttgagcccagaaggttaaggctgctgcgttgagctatggttgcgccactgcacctccagcctggccgacagcaagaccctgtttcaaaaataataataataaaaggtaaaataaaaaaatcatggtatgacttgtagattattttagattagttgtgcatatttgatttttcaaagggggctctgaattaggaaaaaaatgttgcttatttttatttaaagacactgtaattgagattttcccttctaaatattctatgccaattttgatttgctgggatgtgcttaagttcaatcctgtatgagtttgcattcatattccagctcatcttgttatcaactaagtatcatctgcatactttggagcttttgagtcttgagccaggcgaggtgcttcccacctgtagtcctggctactcaggagactgaggagggaggctcgcttgagcccaggagttggaaaccagcctgggcagtataacaagacctcatctcggggaagaacggaaaggaaagaaaaagtttgagtctcatcaatatctaccatattaaaaattaaaactgggaaattattcatttcatttaaaatatcaattgtaaacccattatatggtaacatatgtaacatctttgtgaaaagtaatttttaaaaaaatagacattgaacatcttagtaatgtttgacttaatagaaaaagacacttagaatttcataatttcgtatctgcttctgcattcaatctgttatgatacatccagtgttttgttgagcctctgggtaaacttcactgtatgcttgtggtaaaatgaggaagaaaaaaataatcatgttagtattattatgaaaatagttctggtcttgtgaaaggctgttggggttccccaaggtttcctggataacacttggagagctgctttagagcatatattggcaaccatcccaggccaaatctagaaaactttaaatgtttgcaggcctttcgtttaagtcctcaatattagttactctttttgtaaagttaagaaatttgacacctgctattgcacatcggcattgtaaaaattatcccataatttgaagggtttctttttccttaactccttgaggatggcagtggggtggagaaaataaagttattggtatgtgattgtatgctctaccctggaattctgttaagtgtaaggtatcagcttggactaatctagaatttgataggcaaaatcaatgtagtgtggtagaccggtgctcgggtttgtgaactttctgtcctggaggttgtgccagaatgttaatcacttaaatagaatgtttagttcagctgacttttttttttccttaaagcacaacttctgtgaaagaaacagtatgtttatatattcaaatgcaaactccttatttcctccaggataagttggcaaaccatcacttggaagagcactggcctagaccatactgacctctggtgtcctctgtccactagtctcaaatctcattctacctcttcagttcagtaattccacataaccacttggcaagcaaaccaagccttccagataacatccgtagaagggatcagttgcataataatttatgtatagggaggagtaggtggtagggaagaacttcctgaatttggccctttgtgattgggttcctaaagcttgattgtaggcttctggaagctagtgggattgaaaattaactctccactgctttttgaggtgtgagggcgcagggctgctttgccaccctcattattttgggatgtaaacctgagcatataaatacatggcagagtctgtgatctttttccaactgccttcagaattattaggggaatttccagactcggtgttaatttagtggaaataataggcatttggaaaccagagttttttgtcctttgataaaccactaattagttttgtgacctatagacaactcataagttctctcagcttgtttcctagttgttaaaattaaagctgggccaagggtaaggcagtgaataagacttcatttcctcaagcttgaaaattgtggcacgatacagtgaacccagaaggataggctatgatagtatagtacattatttcatttttttaagtggtttaatctttttaaatattttttaatttttctaaattgacaattctacatatttatggggtacatagtgatgtttcgatacatacagtatatttttataatgttcaaaagagtaatttgcatatcatctcatttatttgtgttgggaacactcaaaatcctcttttctagctatttgacaaaatataatcaatgttatttcagtaagctcctttgaaaaaataaggaattcaaccaggatagttgagattctaccagatttcctgggggcaattagatacttaactaatctttgtgagattcgtttcgtggaaactagacctttcagatctttctaatttcattatgttacgttgtctataaaactacctggaagagactgtacctgagaatttttgaaagaccatttttagttatgggaaaaagagtgatactgctaatcctgtatattacatgagaacaagattctggtttatgtgtacttgatccatcttgttgattttgaaggtgaaacaaacttacagcttttaattagctttctgtttatgtttacatattttggttccttttctcactgagtaacagttaatacaggcaagattgttctcttttataccatatataattagtattgtgccttagaatttagaactgatgatttcatgccatcatctagtcgagagtgcattccccacccccatgttactggatttcaacaattaaaattgtggtgggagattttgtcatgctttctaaaatcaaggtgatgttaatttcacagttttctttctgtgcctaacaatctaatttttattctgcttaattttgatattttataaagttctgttgtctttgaagattttcataaactaaggtcttataaatacttacacagataattgcattctagttcagagtacctttatctcataagtgttttcctgtatgtgtgctttgatgttgttgatatttcatgtgattaaatagtattaacattttctaattgtaaaaaatatatttttaagccttatgattctgcagatgactggtctgagcatattagctcttctgggaaaaagtactactacaattgtcgaacagaagtttcacaatgggaaaaaccaaaagagtggcttgaaaggtaattagcttttaatctaattaaacattatttctctagcttggttctactggttaacatcttacagcattaaacattctaatttagcttttttatagtgctgcccatctacactttttagttgcggtggttggttgccccttcgtgttttccatagtttgtctttacttttaaaaacaaaaaacctggctgggtgcagtggctcatgcctgtaatcccagaactttgggaggccaagacgggaggatcacttgagcccaggagtttgaggccagccctggcaacatagtgagaccctgcctctacaaaaagttagctgtgagtggtagcatgcacttgtagtcctagctactaagaggctgaggtgggaggatggcttgagcctaagaggccaaagctgcagtgagccatcatggtgccactacactctagcctgagcaacagagcaagatgctatctcaaaaaaaaaaaaaaaaaaaaaaaatctaggatagataggcagctgtccacaaaggacttttgaatagtcagtatagttaataaaatacctacatttatgcatctttaattttgatggaaattttaatagtttaataaggccgtaatgtttctttcacatgtagaattaaaattgctgagctttggttatggcgttagtggtataacaattggtataattttgccattagtgagacatgttagtgttctgtttgctacgttccatctcacacaccagttaaattatgaccatgttcactccttttgttttctgtataccatttgttaggcatttggccagagctgtttagtatggaaactcatgcccttaatgtaatttttatatgtttatctttttttttatttttagagaacagagacaaaaagaagcaaacaagatggcagtcaacagcttcccaaaagatagggattacagaagagaggtgatgcaagcaacagccactagtgggtttgccagtggaagtaagtattaattttttttctttgaaatgtatgtttgacttattcgtatttatttttcaaatctgtatccattgccatctacatatgtaaattaaaataaatagaaacatacggagattcttttatgttggatttattataccctccaccattttggtccctgaaaagggaaaagatacacggtcgagtagtacaggtatgtgtttcccactacacattatggctataatggagttgaattgcaaacagtaaaattttgttttggattggtttcccctgatccccccagacaggagcttcctctcccaccctacctgcctgcccttaagttgtgtcctattaaactggacacaaatctcaccggcttttagtctaataattgaatcatagctacacacagtgacaccagaatagctacttgtttttttatgttaccagtgagtaacttgtttatccttgtatgtagaaactaatttcaccatgatcacagatctgtgtaacatctctagtttgaatttccacacaattttaaaatgtctactagaaaacttacacctttttgttccaaggtgctcttcatctataaaaccgtgggcatacttcagtgttcttctgaggccaaattttgtgctcgtgggacaattttgtataacatacatttattttgtaattcattctccaaatttgaagctttattaaaggtattctatttccactggcttcccttaacttgaataaaatttactcccagtgccgtggctcatgcctgctgcaatcccagccctttgggaggccgaggcaggaggatggcttgaggccaagagtttgagaccggcctgtgcaacatggcgagacccagtgtccacagaattaaaaattaaccacgcagctgtaatcccagccacttgggaggctgaggcaagaagatgacttgagccctggcatttggctatgatcttgccactgcactctagcctggcaacagagtcagactctgtctcaaaaaaaaaaaaaaaaaaaaaaaaaaattaactgtcacatagacttcctgggttccttttgcaattttgagaagaatttcaagatgatgttttctgggaattcttagacttcaatgtttcaatcctgctcctataactcaaaccaaaaagttgggggtgtatttggtcttagaagggattattgagtttttgatgggagaaaatatttaagatgaaacagtaacatacatctgcaggattaagtgttaaatttttaaatcagtgaaattgtatataatttttttaatggtataaagtactgaagttggcatattaaagaacattgaattttgagatggaagaattagattctagtcccatttctttttatatcttaataaactgacttttgtcaaacaattaaaaatgagaccgaggttttcctctagacataaacaagttgcacccagcttgtgggttttttgagcaaattgcaggggaggggatgcacagaaaatgagtgacagatggctgggtgtgatggctcacacctgtaatcccaacactttgggaggctgaggcaggcggatcacgaagtcaagagatcgagcccatcctggccaacatggtgaaaccccgtctctactaaaatacaaaagttatctaggtgtggtggtgaatgcctgtaatcccagccactcggaaggctgagacaggataatcgcttgaacccaggaggtggaggttgctgtgacctgagattgcaccactgtactccagcctgggtgacagagcaagactctgtctccaaaaaaaagaaaaaagaaaatgagtgatgagtgatagataagtataaaaataactttttaacttgtttttcttcatgatttcaaaagtaggccatattcgtaaataggtaaagtttttaaattccatgaccctggaacattttggaatatatacttttttttctgtatgcatataaatgtgtatacaaattacatatgtatgtatttgaaaaatgggattctgtgttgctgttttttacctgttcttttattcagcaatgtgtcaggaatatgtttttatgtctgtttataattctgcagttgttatattgattgcgtaggtataccttcattgacaaataatcccctatcaatgaatacttgggaggttttcagccttttcctactgtaaacaagattatgatttcatatctgcccacttctctgattactgccttcagttaaattcctagataggcaaatgatgagtcattgtgtctgtgcttgtgttgaaatgtagtcatgtatcacactttttttttagtttaggtgatgtttgaggaagaaccttagctgtgttgttgcttttttaaaaaattggtcaacttagtaataaagtgaataagccattcaagtatttaacttagtctatccaaaacatattggcagagtgttaccttgtgtttcggtgtattggtgtttgtgtagagtatggcttaaagcttgttcttgactaccaataaaagaactttaggggatggcagagggggaaggattcagaagatttttacatgtaaagagataaagtaggttttaatgaggtttttgtttttgtttttttgcaatatattaagtgtttgtaaagcactaaaatattttaacaaaggccaggcacggtggctcatgcctgtaatcccagcactttgggaggccgagacgggtggatcatctgaagtcaagagtttgagaccagcccggccaatgtggtgaaaccccgtctctactaaaaatacaaaaataagctgggcgtggtggtgcgcgcctgtaatcccagccacgtgggaggctgaggcaggcagaggtttcagtgaggcgagattcatgccattgcactccagtgagactctctcaaaaaaaaaaaaataaaatattttatcaaatgttaatattctccacaacttgatactgaaaattatatggataaaatttttaatttgcgtttaactgctactaatttttatttttgcaaacctgtgctttatatgttgatggctctatgtttagagaaaccttacttagggtttctcaacagaagcactaatgacactttgggtgaagtaattgttatggaaggctttcctgttttgtaggttgttgagcaccataactggcctctcctcactagatgccagtagcatacctcccctctctccagtcaggacaagcaaagcaccaccctctgggagggtgacaaacaggcactgctttaactgtgtttatctagagttgtaagtatagaaagctgttacagctatagcgtcccctgttcctgtaatgctgctgccctttttgtttttttaattcaaaaatgttagaagtatcatccttaattttcattggagtacatacgcttgatacattttgactagcgatatagaactgaaaggaagttttcttggttgaggaaataaaaattgtatacagggttgggcatgatattattcctgctatgtctgtctctaaaggtttctgtcttagttgtacctcattgcaggtagaaactgtagaataaaactttttaaattttatgttcatgcaagttgatagcttacttatatattactatcatacaacagatgtttgtattctgttcatttttgtagatttttatattgtatcatttataacacggaattttatgtagtaagtcattgtcagaagacctcgtgctttgatgtgattgactttttgggtggtattccggtaccttttgttgtggtgtaccatgtagtggttgtgtactgacagctttgaaactgacttctagtttgaatgttcctccttcgttgttttgtcttggtctttacaattggaggagctgtgaattgaaaaaaactatacaataatcaacagagagggcatcctttagtaaaattattgtacatcacatgcttggattttaggtcgtttctctccttggaggttattttaattctttagttattgttgggaatattgtaatttagattggacactttgaatgaacttcaacatgatagttgaaattttcgttctttttgtactgttttgtggaatcatggtgttagaatttaaattgatagattttgaactgttttcagtatttctgagcttaaagtatttttgtggctttaaattgaaagaggatttgtttttaatacacctagtgataagtagattgttctgactatgctgcgggtgttggacttctattttcagatagcattatgcatcatgattttattaactctctggtatttgtaacattaaaaatactacagattggtttacttactgtgttcacagttcatcataacttcagtcatcttaaaatgatttcatttaagccttcttataaactgctttagaggcaactaattgtagcttagtattcagaaagaccaggctaataaagcctaatattcctttgcagttgaaccactgtgaataattcagttattaaaatctgtgacctgtagtgtaaaagaacgaagcatttactttttctgcctttaaaacattttttaaaattttataagatattataactccatatgttgattttttttttttgtgttttgtttgaactacagtgtgattctaaggaatccttaaaaaatgtgtagcacccttgaaatatgagtatagatgaatatttatagttgagcaaaaactcctcctcttccagtattgcatatttacatgctagtggtaaaactgcagacactaactgggtttgcagttttataaaagaatatgtaagtacaagtatgttgctaaattagctgatgttaaaggtaggattctaatgtaatcttttttcttcccccttctgtcattccaacatctgttttttcgaactgtgaactaaagtggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaaggtatgccattattactagatgctgcacgttgaactatagtttctaagtttcttctaagtttcttatatattacattatttcctttggctctgaattataaatttttaaaaaagtcttttagaatgtttctgtgtagagttaggtgtagagttagcaatatttagcttttttctttaatttataattatccagcctcagaactgtttcttgcctctgaattttaagtcaagtgcttaatttataacaataatggtttaagtaatttgttaaagtcaagtaactgtctcttcaattttctgtttttgtgatcattgtcttgacagtttagtttataaatcgtctcagttttctcttaatacttaatataaatagaggtattttaaaactaatgtctgtataacatttcattattggtttcagtttgtgattagaaaattaagttgtgggccataagataaggcgtgttaatgtctgaattggaccttaagtctgaagagtggaagttaaacgttgcaacccaaattgcgtttatccaactcagtgtcaataatcatagcatgtttaaaaagttacagaaaaatttaagaacaactacttggaaggtgtgacacaacataagcagtgtgataaaatttgcatagaccattcacaatctgaaacttgtacttcatagtatgttttaagaatctaaggaaattaaaatgtagtaaataaattgtcacaggtagatccattagcagaccattagtaagtgttgatgcgcttttaaatgtgctgtgggtttaggagaggcttgatacattaattcacattgattcaatttgttgacaaaagggctcaaatagttggatttcttttgtttctgatttcctctctccttgaactacagtgtgattttaaagaatcctaaaaaagaacttgtagcccccttaaaatctagattaatagagactaatatttatagttgagcagaaactcaactataaatacattttatttgaaattttcttattacatgttatatgcatgtaatacatgcatatgtattatacatgttatttgaattttccttgttattcaaccatatactttagtatatatatcatacagtgcataatgtgtcagattattgcttgttccaaatgtcaaattcggtaaagatggttcgtaccaaaattcatacataaaatgtcagatttaccctgtgacatatttgcaaagagaaatattgagagatgaaatctgaattaatgctatagttaatatattttccataggacattttggtttcttaagttcctataattttgacaatttgctcacagaaaattttactttaacaatccttgtcagttaaaattctgatgaccctttgaaagtatttatcccatgtcacctttgtacatttaacactttttaactcctttttgaaattctttctctggcttctgtgatactacactccttcagttgcctatttctgttccttcctgcttacatatcagcatctcagccttttttcctctgtttggttctttttcttgttaaccatattccttggtagtcattttgttactgttatgactaccaagtctttagttctagttcagacttacgtatctacttaccttctgtaaactcttagtatttgttacgtatcctcatatacagtgtgtccctaatttctccctttcccacaatttattcttagattcgcagtaattgacagcactgttcttcctaactttgccttattcttaaacattctcacccacccacccattgagaaatcttgggctctttctcctagcactcattgaaattcagattctctctctctgttttaattgtaaaaatctttcgtggagatttcacttactgaaattcaggtcatctctctccgtttgttaatttgtaaaaatcactgtattgctcagactggtctcaaacttttggcctcaagcagtcttctggccttggcctcccaacgtgctgggattacaggtgcgagccaccgtacctggccaggttctcttgaaataatctcctgattatcttcttacccagtctatccgcttaacagtggcatcattataccatttaaattgaattgtgtcggctccttgcttagaaacttctagtggttttttaaacatccagatgataaagtccatgcttagattatagcaagcacttgacaggatggttgcagtctgttttactagcttggtctccatccgttgcactcttaattctctgtaattcatctgttgcaaacttggacatttgttaggacttgccattatctttcctgtcctgagcttttgctaaatagaacatgttctttctttcattgctgtcctgttgaatccaatactcttttgttacaacacttaaacattgtaatttcagttttttcacttagattatatcccctctagggctcaacattatgttttactgtattttgtactttgttcaccttctaacccttccctccatgcagtttgatgctaattgtcttatgttcattttagtttattccttaaaacaacactggtgagggaaggtaatatctcttatcttagaaatgaagagcctaaacattaccccaattcaaacgtgtggtgttagaggcagcttctccacaacactgttctttcctcaaaaccaaatgtaatgaaagacataacatacagcacatctatgtcagttcggacgctcgtaatgtaaaatttctgacagagtagattcgagtttaaatttcacgaagtgtgtttgctaatcacaagcatgtgcataatttatatatagtattcttaaacttgtaggaagaaactcgattacctaccatggaattatctgtttttataggggaaattgtgcagtctttccaagtacttctccttgtatgttaattgaagactgttacatccttagataagttttatagcaactttaatctttacagattgttttccatttagtctgtttagattgttcatttagattgttctccatatttctgaaatgtccatttgacatattttttttctcaacggagacatccatgttatttaaattaagctttctattgactcttctcatcagtagatgattaaaatgattaaaacaagtaaaattagtgattttacttgtttaggtttttcttaacaactaaataatttatattaagcgctgatggttcaaatcaggttggcctgttgttcttaagcactgatagtatagctgagctgtgtctaaagatgtcagtggttgatgctgtgtataagagcagagtctttgtctttcttaaccactgctctattcctagtgcttgacagataataggcagtgtgtaaatatttgttgtagatgcctatacaacagtgtgtaaatgttggatggatgcctatactacatgtgtgtaatggatgttgtataggcatccatgttctatgtgttaaaatatttgttgtagatggatgctacaagaacaggtgttgagagttgggagcacttgcactggtcatggtttttaaaaaagtatttggagaaaaagaagtttgtgtatgtgttgtgcatctgattaaagcataccagcaatggatttagatctgtttgatgccagtgtgtcatttgagagaaagaacctaaggtgaattcaagttttgtgcctgcatgagtagtcagaacggtagagaaagctgcagagctcttttatttttgcagagaacagtcttgatgttaggtagagtgaaacaagggagtgaggtgaccccatttaggtctatagttgtttgttagggtaacatttgaacatctatgtatgatcactttattggaccaccatacaacaagtagagaaagtctgatacaccaaaaaaatacaaaattgaattttatcagttggcacccaaatggccattttaaacctgctctaactctgccatcccttctagattggtgaaatgacaaaataggaaacgtgggtccttattgtttgctatgaccaagttgtcaggagagtttaatatccttattcagtaagttctctatttagtgatttagaattatgatttattagcagagataaatttgaaaacaaaacaaagtagccatagaattagacctatttagtaatctcaagctagctctccgtatgaacatgtgtaaataatcacatactcacatgctggtgccatatgtaaagggcaggacagactagtcgttttaatatgaggtgtgagtcagtcacttgaagtaaaatttccttctgtttttatgctatctgtagactaaatgacaattgaatgaactcaaaaacttcagtatgtgttaaagctaggctcttatagctgatgtagatggtcattaactggcagtggtagtgggccaacttcagcactcagttgctttgctttaaaataatttttaggcttactaaatattcatgaaaagttagaaagattggccatagttattcaaatatttattgaataatcgaataacttagtgtaggaatttagtcttagtcattaaatttaactaggtttagtcaacttaatgaagaaataactgataaaaaatattaggaaatattgtttgtaatttgagggtaaggaaagtcttcatcaagacccaaaatggatttgtctttttaaaaattaataaatttgaccacatagacatttaaaacttctttataaaaagtacaataaacaaaggttgaaagataagtatcagacaggagaaaatacttgcgacatgtaacaggatacattaaagatacataaaaagatacatacaaagcagaatgaaaaagacaatccaatagaacagtggacaatccaatgaacagaaaattagagaagagctgttgcaccatatacaaaaattcaccgagaatggatcaaagacctaaatttaagaactaaaacaccgaggctcttggaagaaaacaaaatctaaatggtattggagttggccatgatttcttgaaatatgataaccagagcacaggcaacaaaagaaaaaaataggcacattggacttcgtcagtattaaaaacttgtacatcaaagggagtgaaaatgctattcatagaatgaaaatatttgtaaatcacgtatgttgataagggatgaatgaatatatgtagaagtccagcttaaccatgtaaaacaacacggttcataaatgggcaaaggactcgaataaacatttctgcaaagaagatatcctggtggccagtaagcacatgaaaagatggtcagcctccttagtcattagggaaatgcaattcaaaagccataatgaaataccacttaatacccattaggatgactattataattaaaaaatggaaataggtgttttggagggtatgaaaaaattgaaacccttgtacattgttggtaggaatgtaaaatgatgcagctactctggaatacagttcggcagttcttcagaaagttaaacagaattatgtgtaggatctggcaattccatttctagatacatacccaaaagaaaggcagagactcaaaacatgcttacatgcgggtgttcctagtaattcacaacagacaaacattagatagaaacaatcaagtgttcattagcagatgaaaggatacgacgtgatacatagactaacaatacaatattcagccttcaaagggagtgaaattctgatacatgctacaacatggatgaaccttgagaatattacatgaaataagccaggagcaggacacatattttatgattccacatatactagggtacccagaatggtcaaattcatacagacagaaactggaatagtagttaccagggactgtttggtggtgtccggggtgggagtgggtgttaagtttctgtttgggaagatgaaaatgttctggagacgtatagtggtgatagttgcacagaaatgtggatgtacttaaagacactgcattatacttgtaaaatggttaaaatagtaagtttgatgctgcgtatactttaccagggtaaaaacaatgcaagagaaagattgccagtgcatgctgaaaattaagattactaggaggatatttttcactcttgagactaatgacaacaattgaatgttgggaagcacagtatgtgggagtgtgtaagtgggtcttgctagtaggggatgtcactttagcaaaatctgttggaagttgcttatcttttgtgtgtattaacatgaagattttctcagttgaataaaacaagttaaagaatactttctttgttgtaaaacagcatatttatatacatttataaatgcattaagttctagaaggatacatgagtaaaaatatgaatttaaaaattaaagtcacagatttaggtgttgtcacctacctaccttatggttttttcctactacacttacatacctcttcataatctgctctatgtttcccatgtaacaccactattacaaaatagataaagcaggctgcctttgtagcagtaatttgagtttcatgtgtccccatgtcctgctcagtattacagcaactgtcaaaacacaacaggaaagtaatgattagaagtgcacttattaccagtatcattttagatcttctgtatattgaaaaggatttgagataccagaaaaatataggtaagaaataaagtttgactttagtttatgctctttacagtagtttgcaagggtacctataacaagagttgaagtgataatattttaaaccctagaaagaggttatagcaacagatttttatgcgtctagtctttggtaggctgccctgccccagcagaatttggaaatacaagtgaataatttataattataaagcattaagaagttttgtctcttaaatacatagaatttaaaatcaaagggtgatatttacagcacatatcaaataattggtcagatatacaagtcacagaaatgtcaaatgggagagtgaaggaaagtttaaaatagcttaggaagagatcacaaaatatcctttgaaagatcataggcacacacaagtcaacactagagctaaaaccagatattattccattactaaagagtgattttgaaagaccatttaaagtaggagtatccaatcttttggcttccctgggccacattggaagaagaagaattgtcttggtccacacgtaaaataaactaatgatagctgatgagcttttaaaaaaattgcatgttttaagaaaatttacaaatttgtgtcgagccacattcaaagctgtcctaggcttcatgtggcccgtggcccatgggttggacgagcttgatctatagtagtctaggtttccttaatgcttggaaaagtttgcattgaagcagtgagagtagggctgatatattcttcaagcgcagaagaaagcattgaactgactttttaatgaaaaacactacattctctcacgtaaattcattctttgtgtttagctcttttcaaagatgtggattttctgtttatgttcagtttgttgcaaacatgtaaaacatgttattaagcatattagcctcatatcctaacaaattagacaaaaaggtttcagacaaatgaagttgttaattaaaattatgtatttgtaggccaggtgcggtagctcacgcctgtaatcccagcactttgggagactgaagcaggtggatccacgaggtcaggagatcgagaccatcctggctagcacggtgaaaaccccatctctactaaaaatacaaaaaattagccggtcgaggtggcaggcgcctgtagtcccagctactcgggaggctgaggcaggagaatggcgtgaacccgggaggcagatcttgcagttagctgagattgcaccactgcactccagcctgggtgacagagcaagactccgtctcaaaaaaaaaatatatatatgtatgtatgtatatatatatatatatatatatatatgtatatatatatatatttctatactaaaagtacactgattttttttaagttattccaaagttttgttgcctttgtgtttacaaaaggtggtttatttttataagattatttaaaataagtttaagttaaatttgtctctacatagtgttacttagctttatgaatatagcataaaatgagctattcatcgttttctttgactgttacgtcgatggaagtgtaaggcctaccttcccagcattatcaggtgttttttttttttttattgtttagcattatcagttttgaggccaatcaagatgattggcctagaagttaaatgcgaatgcatgtgtacatgctcctgttacctgtattgaagaatgctgtcattaactggcacccaggcagcaagtgtatgttgatgccattttggtgccgagtcctgttttctacaagggctacagagaaaagtacaacaaggcccggcgtggtggctcatgcctgtaatcccagcactttgggaagccgaggtgaacagatcagttgaggccaggagttcgagaccagcttggccaatatggcaaaatcccatctctactaaaaatacaaaaaattcgctgggtgtggtggcatgcacctgtaattccagctgaggcaggagaatcacttgaacccggaggcagagattgcagtgagccaagatcacgccactgcgctccggcctgggtgacagagaacgactgtatctcaggaaagaaaagatacaacacaattcctctcccgaggaagctcatgttcctagtacaaaggagggataataaatgttatgtaatagaagatactgagtaatacactagatttgtgtaagggcactccaaaccaaaggggaggggcacccaatcaacactttaaatataaaacttctaccttttatactatttcagtgataaaactaaaactacctctcagaatagcattttatgtttgtattattaaactcagcttttagtattatacatgtagattgaggcatgtaacataagaaatatgtaaataacttacaacatgctttggaaggacgtttgtatgtgtgtctttggttgagagagtggagcaataaaaaaagtgtaaatatagcatgctgaagacctgcatggataaaagatttcgcttctgtccctgatcgtatctttattcaattcagttctccacattgtgctatattttttcaattttgctttatgtttttcttttgtttgtttttaaagttaaaaggaaccttggaggttctccagtctatttttgcataaacagcaagtagtgccagaatcacacatagaacttctacaagttgttagatatgcccaggcttccgttcagtaaatgtggcttggagcccaggtatctggtttgttttgttttttaactttagaagtgattccgatgagcagtctgttgaggactaatacctttattaaaaggtttaataaaatcaaaccttttcatagagaagttgtggccttcagagatgtcacttgcccaagagtcccataaatattaagtagaatcaactggtttccacactactcacctgtaattccccaaaactgcaaaagaagtctatccttggggtaaataaacagaaattaaggatgtttttgttattttttgttaatgatgatgtgtattttttttattttggagtattttcccttttgcttggcttgatgagcaacactgaaggatttttaagcccttctgctaattttcatgtctcgtagatttggtagcaccaaataaaattgtaaacaccttgcactttcttctccaacttgtttctgttaaaagcagaagaaaatttacagaaataacaaagaatgaggataatttcagggggatattaatactagtttaattcatgcagtaagtagaaataaagagtttatttcattattaatattaatcaggatgcccccaagttgtgtgtgaaagaacctttaagagggatgtgatctggagaatactgctaatatgctctataattgattgccccataaaatacaatagctgacagcagttttttggttttttttttttttagacagggcctcactcccattgcctaggctagattgcagtggctgaatcacggcttaatgcagccacgacttcgtggctcaggtggttctcccacctcagcttcctgagtagctgggaccacaggcgcaagccaccacagctggctaattttttgtatttttagtagagacggggttttgccgtgttgcccaggccggtcttggaaatcctgggctcaagccttgcaaaatgctgggattataggcgtgagccaccacgtccatctgacagcagaattttcgcaaggaaaacatttatcgttttatttgagtttctttatgcttgtctatgaatccagaacagtaaagctgaaaataataggcagtctgctggattcaagcaccttcctttaaaagtgtatacccttacgcaaataaaaatatcttagtccttctgagttcatcatggttaatcaacacatttttgaaatgtacttaaatcagctgtgagatccacactttagagagctattatccctagttctttcgaccattatagtagtgtaaaaagactcataggggagtctgttttcaataagcttgctagtactgtatatatgatcttgaaaatcttaaagaaataggttgtttctagttttatactaaaagcaaacagagtgctgttgtgatagtctttgaattttctcctgatttacatatatctgagtttcactgagggtgtgtacctaaaggggaattactgggtcatgtagtgttcgtatcttcaacttttctaaataatgccaaattactttccagtgtggttatatcaatttattatccatcagaaatgttgagtaaatgttctcattactctttgccaacatttggtatgtctgactttaaaatttttgcattatggtgagtgtaaagggttatgttgctttattttacattgtcctgattctgaatgaagttgagcatcttttcttgaatttcctaggcattcaagttccttctttgaaataatgtcttctgtacatttttctattgggcagtttgtctattttgacgtatagaaattctttaaatagtctgattaccactactttgaatataattgttctgctttttgtaactttacacatctgcttggtgttatggatacctttctgtgttttcctctaagagttttaaagacttaaatacctacacaaaagttcagtctacctttaactggctttgttttaaatgtaagtttttatatttggcagggcatgtcctgctggcagtgttctttttcttcaggttatggaatcttcaggatttatgttactagcttgtcaaatagtattaacagtgctcttggggctttgattacagttacattaaatctatataaataattgaaacaacagctttcaaataattttccatgcgtattttatacatcctttatttctaaatactatgaggtgggttgtttttaatattaaagtgtcctttttaataatcttaaaatgaaacaaatagctcattgccttatatattgaattacaaaagggaagtatgtagttacaaaactcagttattaagtataaaagtctcttctcatcacatctttagcccattttgggtgtaaccaccttggtgtacctaccctgatttgtattaagaccagtgtcttattgaggtaggttgttactgtggccataaacatttttcaccttatttcatgagatataaattaaatcctgtagaattatattgtccttttatcctaatggaagcttatttgaatgtgtggttaataaataattatctttgagatagcattggtggtagacagattggtacttttcaaatcagatatgggtatgatttaccaggttttatggcttcaggttatctaacctttcttgttcagctttcttacctatgaaatagggtgagaaatgtctaaatcattattctagtcatgtgaatgtttactgagcatcttctgtgtgctccagtgtgtaagggttaaatgagattacttacgttaggtgcctggcacatgagaggtgttcctttgatgtttgttccaattttctctattcaggtaatttttcaggctgattatctttttatttagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaaggtaaatcttcataacagttttttaaaaatttatttgcattgtgcaaagttatgtaagtagtaaaatccccagtttaggaatggtctttgttttcttttgaaatttatagttgaacacttttttttgttttgttttttgtttttggagtttggaaatttatatccactgtagtttaagaccattggtagtataattgagttagtggtgcttggatcttgtgtatatttttcaatacttgttatgtgtctggtagttactggaggtaagccattctatatacataatgtgtatggtgaaattttacattaaaacaatcgagcgtttgttgaaatcggtattaaaacttctggtatgtttctaaaaaacctgtataaataattactcagaatatttaaaatatgctaattactagaaaagtaggaattcaggtagctacttaaaatactttcaaaaaattctgagaagggaggagataggtactagataaaatgttgccatttttttcctggtgaattgcattatttaattccagccttgcttttcagtaatgctacttacgtttcagaatatttagtcagccactttgaaaaagtatgaataaaagtagatgtgttaatttggaaactattcagattcacacgttaattcctaaaagcactgcaaaattttctgttgaaaatgataaatttttaggccgaggcgggtggatcacctgaggtcaggagtttgaaaccagcctgaccaagatggtgaaacgctatctctaataaaaatacaaaagttaaccaggcgtgatggcacatgcctgtgaatcccagctactcgggaggctgaggtacgagaatcgcttgaacccaggagacggaggttgcagtgagctgagatggtgcctgtacactccaacctggctgacagagcaagaccccatctcaaaataaataaaaataaagtgatcaatttttatgtacattttcacataatatacttaaaagtagtgttaagtggttaagttcttatcctaaaaataaagctatctcaggctagttggtcattagtctgttcttactgtccttaatttttttgtatttttattttattctctaaccacgcagttctcttgtgtggtaggtaaatgtttcatttaggcaaagtggggcttttagatagtttgaggaggccagatgcagtggctcatgcctgtaattccagcacttgctgaggctggtgggccacttaagcccagaccagcctgggcaacatggtgaaccccatctctactaaaaatacaaaaacttagccaggtgtggtggtgaacgcctgtagttccagctacttgggaggctgaggtgggagaataacttaagcctggaaggtgaaggctatggtaagctgtgattgcacaaccctgtctccaaaataaatagttgaagaaataatagttaatgtcaataataaaatatcttacacatcaaaaatacatggtattcctaaatactttttttttttttttttttttgagatggagtttttgctcttgttgcccaggctggagtgcagtggtgcaatcccggctcactgcaacctctgcctcccaggttcaagcgattctcctgcctcagcctccctagtagctgggattacaggcacctgccactatgcccagctaattttttgtatttttagtagagacagggtttcactatgttgggcaggctgctcttgaactcctaaccttaggcgatccacctgcctcagcctcccaaagtgctgggtgtgagctaccatgtccggccaatactcccttttttgtatccatttttagatttattagggtggatcttgatataggatttgaatggccagcttgtctaaaagggcaatcacatgaaatagcagttgtttatccagttaattccatataacatactgaacactcacatatgaataggtttctgacataattggaagttcctgtgaacactcgttaaattttgtagagagactttgttcaggtgatcatcttaattagtgtaaaagaaactctgttggtttacctttattgtaaacccattaagtttctttttctctgcctcagatcatttcaaatttgggacccattgtattactcctatctagtaggcttttattttgagagttctaggttgaaatattccagtttcttgtgagttctcttccttgtcaggttgttactaatgccacataagcctcttgtttttatatgaatgtatgaaataatatgtttttagttcttacagcagctgtgacacaagcctcactgcagtctataattcataagtttcttactgctggaccatctgctttcaacataacgtctctgatttctcaagctgctcagctctctacacaaggtattcttactcatcttagatatctctagaatggcatcttgattttgttttggaattaatagcccttttttgtatttagttttttctttcatttttttttttagttttttaagagattagctacaataattttgttttttttgtaacactggcatatacagtagtatttttatttcctttctttttagatgaagcaagctttgacatttgtcttaaggtattgccatcaaatctgtaattatttaagacagtatttaattcagactttgttattaatgagtttttttatgccaaagctgaaagtaaactatgatgtgccatatatctttgtgaaacattgcatgtatttgaagagttgaagtttggttcagattgacgttagatgttttttgactggataatatggaaatgctcattttctgccttgaattagatatccctcttcatgaaggtatccaaatggagagagatacacataggagcaaatgggaagtgaaagggtcactttgtcagaaagctgataaacagcaggaatgccttgtctggaatggaagtataatggtgcaaagactcttgcaaccctctggctagcctcatgagcaggagactgcgtgggatacctgggcctaaatgtagaataagaaagaagaaataaggatggtgaggaggccttccatgtgagattaggttcaggcctagcttcctgttccagccacataaaggagagtgggccacactgggtgtgcttacctctgaacacacagctcacttagtcagtgtggcccagtgagaaggtcagattctgatttattccaataagtgttctctgggtaatatgggggtgggggggtttagagtaatacaaatatctttgccacatatattacaaaggactttagttttttgttttgttttgtttttctttaaaattaattgcttccctcttttacagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggtatgtcacctttgagggacattcggaaaagaaactacttacttttggaaagtcaataacattttagaatctgttatagaaaaagccctctgagaatgaggtgtagtggtggaatgaatgacaggtatgatagtagatgcagcctagaatttctcagttcactgagggatagaggggggctttgaatctgtgctactttaataaaccatctgagtctgttccctaatggttttgggatttgtcacatggagagtgagataaagaggatatactgagtcttaatatttgtagaattttcaaactccaaaagacatgaatgaacatgttttccagtgacttttccatatttgtatttcaaaaatgaggcagtttctgtgctaagaacttaatgtatgtttagctttcacatcgtgagaatcacttgctttatttaatagatgagaaaatcaaactctcagttaagtttttgtggtagagtcagaatttgaaacctaggtgtttgtgaatacagggacccattttactaagcttatattgcctgtatttgtcccagcagaatcttacatggttggctccataggtgcagttagaaaattgctggtctaaatggtaaatgtagggggaatttcttttgagtagttttgaaacagtgggctgtttcagactttttaatgccaaataattctttgtaagatattaagcagaagcccaaaaataaaaatgcattgaaatataacttgaaagaggtggttggtcagcttttaagtcttcccgtttgttcatcccttccctaccttggccattgatcattgcatgttttagggtcaatttagattgatttttaaaattccaagttacagttgttagtttattatgcagttccttatcatttgccagtattttaaggaggaaagaattaaaatgtgagttttggcaaaagagatgttatttttggagcttagaacttgtcttcagggtggcattttaagagtatagtaaatagtggttaaaagtgaaataagtggtagtattggttttatagtcacttgtaaactgagcatttcaactcctttaagaaggctgggcgcggtggctcacagctataattacagcacttaggaggccaaggcaggaggattgaattaggccctgggcaatatagcaagaccccatctctacaaaaataatttgaaaatttgctgggggaggccgaggcaggcagatcacttgaggcctagagtttgaaacaagcctggccaacaggcaaaacccggtctctactaaaagtacaaaaattatctgggtgtgctggcacagacctataatcccagctactcgggcggctgaggcatgagaatcacttgacctgggaagtggaggtgcagttgagccaagatcacggcactgcactccagcctgggcaagagagtgaaactctgaaaaactttcttgggcatggtgatgtgcactactcaggaggctgaggtaggagaatcacctgcgcctgggaattcaaggttggagtgagccaagatcacgtcactctgcacttgagagtaggcaaccagactaagaccctgtctggaaaaaaaaaatcctttaagcaggtagctgttcgttttttgtgttccaaaaacttcttcaagttgtttttaaaataattgaacatttgagcttttatgtagtgcttataaaatgttctttataagacttgactagaattgataggtaatattcagaagttaagcaggacattccagatttgttagggagaattattaatcatatcccctcaccccaccaaaagaaaaacagcagtgaggtgtgacttaatcacaaaggactccatctgcctttgtgcctcaatttagagcttatattttaaactgcttttctctatgtggcttctgaatataatacatatcctgattggcaatcatggacttcagtctacctctgtagagtaacatctctttgaaaaactctcatgttgaactttatatgggccataactcattttctgatagcccaatcacatatttctccatatcattaaaatctaagcatccatatgtgtatgatgtggtagcatacataatttacttttattgatataaaagtaacagtaaatcagaagagataataatgtattggaaagaaaactgagctgtaaaggagaactagttactttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccagccctagtttgatagggaagtaattttatgaccttgggccattttcacaaagaaatgagatctaagtttcagaacttgactgccacattttacatgtttcaagacgattacctagattttggggggagagatgtggattagatttggagaccatctcaccagattttgacatttcaggttagtactccagtagttaagcaaggaccagtgtcacagtcagccacacagcagcctgtaactgctgacaagcagcaaggtcatgaacctgtctctcctcgaagtcttcagcgctcaaggtaggttgatattgtatattgagaccacattgttttatttaatgatggtacactgcattgtttgaatattatatctgtaaaatagaacttaacctttaaactccatgaataccctaaagtaggcttacatgttgtaaaatttacaaagacaaacctgtatacaagaggtaggttattgtctctagtagtgaagcccgggttattttgaagaaagtggctctttaaaattttacacagtggaatatgacggggctaaagatttgtgatacttgtaccagaaaggcacacgattttacaatatttgttggaattaccttactttttaacctcctcatagcagttttggtttgagtatattgatgaaagccaaagtctggtatctaaaacttgggccaatgtttcccaactggtatatgtcaggctttcccaatagcttaactgtgaccctatacggatggctttttagatagttctatactgctgtattgtgttagcacttttctttgttcattaacaacacaactttaaatgacatttgttgaatgaatggttttcatttgattgattttcctgttttttatttcatgctatgaggtagcaaaataattcaactgttgtttttattgttgttttctaaacaagcatttcagaacttacacctccaaatgagagttgttcccttcaaaataatgaccttgggaagctgtctacttactccagcaatgttgccattgctctgaacatttttgggaaattcttcttttaaattgtttttagaggctgcagtattattttaaatatcctcagtgatgaaaactcttcatcctttgggagatttagtttttggaaataactgaaattcattcagagccaagtctggtgaagcaggtaggagatcaacttgggtgattaaattttttggttctcaccaccatatccccaaccctggcccaaaccattcagttttaaaagaagataaagaatctcagagtgttatttttttggttttgttttgccactgtgcttgttcagtgctatccaataaaatgtctgtattttgcttcacattatttcaccctctgattcagcagttctgacgttgaacaaaggcaatatatattttccccttatctagatgtgtatgagcagtcttcagatgtgcatctacagctgttaaaatgtgactttttttagttatattattagtgtttgtggtacacaaagttaacaggttctgctctcagatttggagagtagtttacatttgactctgacagtagtgttaaaagggttttttccccctaaagtgttttgaggaatcatatactttggattattaattctctttatttgacattaaaataacaaatttttcttaggaatttggatatctttaagttaataaaaggtattaacatgcagtttctaggataaggatacccagaaactacttttaaacatactacacattcaattctgttttctagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggtatgttatgtacagcctagattttacctttggatgattagcaaaacagaatttaatcaacttctagagaatctaatgtgaccactgaattcaagcaatatttaaaataatgaatctctaactttgtagtcatttaaaaaatatttgatatataagataacttttctggttttacaaaatattttaacataattataggcactgttgtcaagtactcagcagttagctcagtgcttaatgccttatatttattttctctacttcttaaaacagctaagcagtgtagatagagttgaagtccttaagaccaaatagtgcataagaccttgatcccagggtcacccagttaacagtgatgtggctcaaagccagtgtactttttccactcagcttctctgatagtttcagattccattagcactgttaatctactggccaagcgcagtggctcatacctgtaatcccaacactttgggaggccaaggcaggtggatcacttgaggccagccaggagttcgagaccagtctgaccaacatggtgaaaccccatctctaaccacaagtataaaaattagccaggcatggtggcatgcacctgtaattacagctactcgggagcctgaggcaccagaattacgtgaacccaggaggcagaagttgcagtgagccgagattgcaccactgtactccagcctgggtgacacagtgagactctgtctcaaaaaaacaaaaaaaaaccccacttaattttctatgactctctcactagactagcaactggaagttaggaaacatttttgctttgggatgagagaccttaggacattccagttactgccatttgcctcttgctttttatcagataactgaccatctggggtgttcgaaagtttacagagaatatgttgtgtgtcttacgatagaggagtatagtgaggctcttgaatcaatatctaatacctgaacttgcagaaatgacaatctctttggctgacccagcatcttttattaaccacaaattatgagtcctttcttagtgctgtattagcttcaggttggaaatcctattttctccaacttagaagagaaatattaaaataagtaccttccacccttagagacagtttcttaaaacaaattaattttccccattaggttcaccagcatttttgtgtattgaagggaaaaggattattctctaatcctagtataaaattgtactcagaaatttaatgttttattttgtgtatgttaatgtttatattttatgttttcttcatttctttaattacaggcatcaagattacgcgaagaagcgcataacatgggaactattcacatgtccgaaatttgtactgaattaaaaaatttaagatctttagtccgagtatgtgaaattcaagcaactttgcgagagcaaaggtaagtctttcactgaaatatatttttatgtttctcaggattatgattcttaaatcgaactaaagaatgtaaatcacattttatttatgaaatgtaaagttctcttcgatacattgatcacattctatcactgcattttcataagttaatatttctcgtgaaggataaagcctgtcgattttctcttaacccatgatgaatgcttcattagacttttctcataactccataagctgcaataatatattactgaaaaaatgaaatattgaccacaactaattataaatgtcctctcttgctgagggtgtttccattgaaatttcagattatttgtccttgcatcatcaatagatcccttgaaaagtatagaaagaatttgtctagcaagtttagtgtatctgctgtcttagtatttttcacctgaactcttgtcttgtatttcttaatctagtgtttcactcaagtagaatatctaggtcacaataataatagcataggtattattttttaatgcctattacagaattgaggacaaacttggcaatggctttatgtcctgtctgtgcaagtcacagagttacaggtcgattgaatcttgtcaagaaaccataaatatttagtaaataccaaatggagtttatagtacaacttgaaaaagtaagtttatttacagttactaaaatatctggaggtactctctgagtaacaacttgggttcttatagtcagattgctctgaaagtagttctaacaaacttcattttggcttgttacatcattcgacttttgggaaattattcattattgcatcttaggaaaacagtatatacagtcaaatatcaagccagcctgattatgcctaattcatgtgtacaggcaataaatattatagttcccagaagagaagagtaaaaacaggaaatatttttacgttcatgggaatctgggtaactggggtttgtgtgtttcaacttttggtttttggcttcatttttatgtacctacatctacattgagaattgctcttctaaatgattaatctcttacacctggttaattctactctttactgtatagtgggccagaaaacatgcagtataggtttatttcatgtataatagctactgctttctttattgtgatgatacggtttataaagtaatacattttaagttgttagagccaaaggaattattaagaaattgttagaaaaggctgggcgcggtggctaacgcctgtaatcccagcactttgggaggccaaggtgggcggatcacctgaggtcaggagttcaagaccagcctggccaacatggcaaaaccctgtctctactaaaaatataaaaattagccgggcgtaaggacaggtgcctgtaatcccagctactcaggaggctgaggcagggagaattgcttgaacccgggaggcggagattgcagtgagtcaagattgcacccctgccctctagcctgggcaacagagcaagactctgtctcaaaaaataaaataaaataaaaagttgtttgaaaactaaaacatcctttcatcatccttatactttaatagatattatgtattaaatgtttactttgtcttaactgtaaaccaatttatagttaaataattttttaaatttctttgccttaattagaaatcacttgttttaatttaaaaaattttaattataaaagctcgggttttctgtaatatttgtatatgtacacaggttctaatgtctgcttttttttttcaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaac

SEQ ID NO: 38555 - DNA, 17491 bp, Homo sapiens
cctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatggtaagtgaagcaaacgggtgatgaggagcgcactcccatgggattgcgaggacctctccccttttttccttctcagtttctggtcccacccccttagcccctatccccacctggaccctccgttctcaacaactttgcagctcggaaggagcagctgggcaagagcgatttcttttgtgggctatgctgttctggagccactgaatgccagttgggggaggggttgcgcagcgaataccccccatcccaagtaaaccagaaggctgagacctgcgtagcacctgtcattggcaggagcccttccctccttccagcacacacccaaagtccgggcaaccagtatacaagtctgattccctccctgtgagctaagagtttagcaagcggagagtttatttattttagagcagaacaaaagggaaagaggaaaagagctgggaaaaatgggctactaaaacaagcaatttttaggggctgactggtattcctcatcccaggcagacagctgatagtattcctccagccacctgggtatgtatctggatccttgagacaaagcattcttggcccaaataaaggtcactaagctcttgtttcttccccttctctcaagggagagctagatgttttgttttattttgttttgtgtgtggggtaatctacaaaatctgcaaagtctgctttttctctcccgcaaacagtccgtaatccccaccttgccttctgtggatgaccagagccaggccctctgcaggttttcccctctgcagagttggaatcaatcacggaaggtgactggccaaaacatctcctctgcaacctgggggctgggctgctttccccagttgggcgtgatgaggacttgctcttatgctgtggagtactaggagatggcagggaatgtttccagcactttcgggtctgtcccttcttcccctgtcactttgcctcttcttttccccaccccagctgcttctcgtcgcctttgccagacttccaataatgggaaggagcacatcattgggctctcaaggtcaagagagaaaggagcttaggggaggaacagaaggggaaagagaaaagaggcaagcccttttagggctgaggcagggaggaacagcctcacacattgcgaggaattcatagctctcctgaacccactgcagagctttccagggccccttaacgtgagctgcaaatggatggagactggcaaattatattaatagatgctcagaaaatgtttgcaggcagctctggcttctgtctcagggtttaagctggagctttccatttcttcctcaccgcaggatcaccctagggttggggagggtgacaagggcttaggtctagccccagtggcaaatccttacatgcttctccttctcccttcccctcctcccagcatgtttgaccagatggaattgaaatcaggtcaaaatgagtacccgaggcagcctgcactgggagaagagggacagggtggggtagcagaagccaccaaatggcttgaagaggttgggacagagggacagggtggaggggaaatgccattatatttctgtcttggtggtagcagtttggtgttagattatgaataaatgaacatgctcttgctttacttttcatatgtacatatatttatatatttgtgtgtgtgcatcataggtatgtgtaagctttccctagccttagggacacactacctttcttcagtatactccctgccctccagaccctagtcagctgcttcagaggcccccccaagctgcaccctaagtacagtgttaggctctgcaggcaatccaactaagatggagtcaccgggaagcttcctaccagcttagcaggagctcacaaggaggaccagccacaaatgggtttacagtatgtttcttcctagaaatggagctgtctagtgcagcctaatgaaaggcagaagaaacaaatatgaagatttcatatcatacataggaacatatttaaatagatatagtgtaacacagcaatatagaaccattgtgtgtgggtgtgtatgcacacttctgcacttctgtgctaggggcatctagagggaatggaaagattgtatctaactgagaagtagacgtcacaatagtttgaagaggattttcagactgcccttttccagggtcctctcctgcattgagcatcgggccatagactggagattgctctctggcataaagcctactgcatagtgcctgggcttggcccagctttattctcgttcccataggaaagggagggaaattcagttctagtacagagaaggtgctcaatatgtatttgtggagtggttgggtgaatgaatgagtcattgtagcattgccttggcttgttaccacccttcagatttctctgtttggctcttgattatgcagttcaggagccatttcttgcctcttagagggactctctaagaagcccctgtctctcagaggcagagtctctcagaaccccaaccctagatcagctgggatgattatctgggattttttgttttccattaaggagtggattcctctgcatcgaggaggttagtcatgtattgactgcagtggcatttcttataagatctcaaagcgttgttgctgctgttgttgttttaagattatttgttctttagaacatgtctgtgaggtagatttagtgtattcgttatttttattttactgatggataaactaaagcagaacaagtttaatgacatatccaaggccagaaaggtaagctgttgttggagcagagatgagaaaccaagtccatgactcaatactcccaatagaaagatcattaatggttaaaactgttggtttttatggatgccagaactgacaaccgattcttgagaacacctggcacagtcttcctccttttattgtaccagtttaactgcccaatgcatattttcaattttgttttactacaaaatcaatttttaaaatttagatttttgatttgatttcttttttctttttctttctttctttttttttttttttttttttttgcttttctgccaactattttttttcttgttttaaaatcatttgtgtaattcttaggtgttatcttctccagggagaatcattgctaaaaaaccaaacaaatgactatgaacttttctcctgtttctactggagaagccagcaagggttagtggaaagagtgcaggctttatggtcacacaggcttgggttcaggtcctgctactcttggtgtctcagtttctttattcttaaaatggggataagaatgcctaccacttaagaaacagaccatcctaagggcggggggtggggggaaggagtgcctaccttagaaggctgtaaacattaactgagattatgtataaaagtgtctggtacagtgtttgctatagtatgtgttcaagaaatgctttgggtgaggtgattatgataagtaattctgttttatggagtggtttcctaactgatttaaatagctagtttaagggattgaaatcaagcatatatatatatttatttatttatgagacggagttttgctcttgttgcccaggctggagtgcaatggtatgatcttgggtcactgcaacctctgcctcccgggttcaagcgattctcctgcctcagcctccggagtagctgggattacaggtgcgtgccaccatgcctgcctaatttttgtatttttagtagagatggggtttcactgtgttggtcagtctggttgcgaactcctgacctcaggtgatccacccatctcagcctcccaaagtgctgggattacaggtgtgagccaccacccccagcctgaaatcaagcatttagaagaacaagatgctattttcatgtgcccttgtggacagacctttatgcaatcaattaatattgaaaaatccacacttgctgctgtgtagtgtacagtggatctcatgcagaacttccagatgcatctctgaatagcccatttggcatgtgttgtcccatacctcctccagatttagcaagtatcattatagagtactctaaatcccacgtgaattcaacatgactggccactcccttgactaaatgcctttattagttcacttgaaaatgggagacagcccttaaaagtgctgggacgcagtttcctgtgcagtgactgggaacatataaatagttggcttgctttaaatctggtgttcagctttttgtagtagtggcttcatcctgtaagcacaggggaccacatatgaaaagataagaaaacaccaaaatcctggtgacaataaagccaagagattttggtcctgaggatgactgggcaagtccctgattctttgcatcccctcatagtaaaggtttgttgatttgatttatttgtttatgtgtagttaagtgcccttctgtttatgtaatcctgaggaaacactcccaatatgtttgggcagtttatttaatgtccataggtaatcttttaagcttccaatcactgctattaattgctttccaactaggtaataagatagtaatttactgatgtttagactgctctctgaggtggtacagtacatttattttcagagaggaaaccgagaccctgagaggtgaagcagctttgcttaattcacacagcctgccatcacaagctaaactacatattagagtttatgttggggagcttgtagcctctcagtatggacaaaagctgagtttgtttcagacagatctttgactgacagtaggagtcagtcttctgccctaagatgcaatctgggaagggtccactttgactggtacgatcaagcatgccagcttcctctttaggtgggcattacatgacagtggaaagtagaataggtcgggagttcaagaccaggctgaccaacatggagaagccccatctctactaaaaatacaaaattagccaggcatggtggcgcatgcctgtaatcccagctactctggtggctgaggcaagagaatcacttgaacctgggaggcggaggttgtgctgaaccgagatcacaccattgcactccagcctgggcaacaagagggaaactccatctcaaaaaaaaaaaaaaaaaaaaaaaagaaggtgtttagcattcatgtggcaatttggcaattaaatatgtaatggctttttattacatttaaacaatgatctatgattcacacaggctttatttcttacagagattcagaaaaatcacacatgagtcagtacattttgcagcacttatgtaggctttatggtttaagatagcaaccaggctgagattttttgccaaaatatatttttatcagtgctttcttctgctttcatatagttttttttccttgtaaatcttattgaagtataacatatatactgaaacatgcacatagcataagtatgcagctcaaggaattttcagaacattcccatgtaacccagcactcatattaagaaaaagcacattgccaggtgctgtggctcacgcctgtaatcccagcactttgggaggccaaggtgggtggatcacctgaggtcaggagttcgagaccagcctgggcgacatggcaaaaccccgtttctactaaaaatacaaaaattagctgggcttagtggtgggtacctgtaatcccagctacctgggaggctgaagcaggagaattgcttgaacccaggaggcagaggttgcagtgagccaagattgcactactgcactacagcctggacgacagagttagactccatctcaaaaaacaaacaaacaaacaacacaaaacaaaaagaaaaaaaacaaaaaaaaccccacatgaccagcaccccagaaaccttcctcatggccccttccagttactacccccatcaagggtaattactatcctgacttctaacaacataagtcaattgtacctgattttgaattttatataaatggaattctacagtatattagccaatttatcttttccttttacctaattggcatgagtgaactgaagtggacactatttgccctgtgttctcattttgtattttgtcctgttagctggcttgggctggttattaattgtaatcaaagattaatattatttgacagttttgagctgttcaaatataatatcattaatatgagatcatggatcctgctgtgtggtgaagaataaatgacaaaaaggaaaaaaaggtatgactaaagaaaggctctggctgggcgcggtcgctcacgcctgtaatcccagcactttgggaagccaagctgggccgatcacctgaggccaggagttctagaccagcctggccaacatggtgaaaccccatctctaccaaaaatacaaaaattagttgggtgcgtcagcgggcgtctgtagtcccagctgtttgggaggctgaggcaggagaattgcttgaacccgggaggtggaggctgcagtgagccgagatcgtgcagctgcactctagcctgggcgacagagtaagaatccatctcaaaaaaagaaaataataataaattaaaaaaattaaaaggctccataggccaggcgcattggctcacacctgtaatcccagcactttgggaggctgaggcgggcggatcacgaggtcaagagattgagaccatcctggacaacatggtgaaaccctgtctctactaaaaatacacacacacaaaaaaattagctgggcatggtggcacacacctgtaatcccagctactcaggaggctgaggctggagaattgcttgaacccaggaggtagaggttgcagtgagccaagatcgcgccactgcactccagcctggcgacagagcgagactctgtctcaaaaataaaaataaaaataaataaaatttaaaaataacaaaaaataaaaggctccatatgcttttgactcatgtctgaatcataatgtcctcataccacaagaatggatctgcttgattcatcaatgattttgttattaaaataattaccgtggcttgcaaaaatatggatttctaattgtgtgggtttttgtttttgtttttgagacagcatctggctctatcactcaggctggagtgaaatggcatggtctcggctcaccgcaacctctgcttcccaggttcaagtgattctcctgcctcagcctcccaagtagttggaactacagacgtgtgccaccacgcttggctaatttttgtatttttagtagagatggggttttgccatgttggccgggctggtctcgaactcctgacctcaagtgatccacccatcttggcctcccacagtgctggggttataggcgtgagccactgcacccggcctaattgtgtggttcattaatgatcaaatgtgtgtgtgttgccctcagctgatgctatgacactttgattatttacctaaatctccaaaatgctcatttgatttattgaatctgaggggaaactgaggtaataaaatacttagtaattttctccaagcaatttagtggcaaaactaaaattggaattcagcttaagaatcccagtccaaggatattgctagatgattgcctttgattgcaggggtttgagacatttaactaagcccatctttttcctgtttttcttccccctatacggaaactatggtttcagagcctgggttattgcagtggaaagaacacagacctaacaaagtgaattgcaagagccttttaagaaagtgaatctgtcaactgtctttattcttactatccatacaattaaagtctttagagacctagttactatagactgaagacatgtgacccttctattgtttaacttgaggtggcctggaccaagcataatgagggggttagcaataataggattctttttttttttttttttttttgagaaggggtttcgctcttgttgcacaagctagagtgccatggtgtggcctcggctcactgcggcctctgcctcccgggttcaagcaattctcctgcctcagcctcccgagtagctgggattacaggcatgcgccactacacccagctaatgttgtatttttagtagagatggggtttcttcatgtttgtcaggctggtctcgaactcccaacctcaggtgatccgcccgcctcagcctcccaaagtgctgggatgacaggcgtgagccactgcgcccggccaataggattcttttgatgtcgctattctactccacaggagaagattgatggcttcctataatgtcaagacccatccaagcttagtcccatctccaataaactaaacattccctctttggagtcctagaaaataaatcctgtctgtacctactcagttttcaatgaaagatttgattaaatggtgtatccacatgcagttttctcttgagaaacagaggaaagaaagaagcaacagcggcataaaaatatacacagctgcagtttaagaggttagctaaactaaaaaagtaatacgccgttctactaaatggagagaaaaaagattactgaagttataggaacttgatttaaaacatggagtttggccccgggctacagattgcactatagtatagataagagtttgtacctgaataatgggtggttaagccctagtcaaaaaagaagtgtttccagaagccattcagccagcatctggaagtcttggctcctaactgactataagaaactcatcctgggctgggcacataacaaggtcaggagtttgagacgagcctggccaacatagtgaaatgtggtgaagtgtctctactaaaaatacaaaaaattagctgggcatggtggcaagcgcctgtagtcccagctactcaggaggctgaggcgggagaatcacttgaacctgggaggcggaggttgtggtgagccgagatcgtgccactgcactccagcctgggcgacagagtgagactccatctcaaaataaataaataaaataaaaataaaaatacaaaaattagccgggcatggtggtgcgcgcctgtagtcacagctacttgggaggctgaggtagaagaatcacttgaatccaggagacagaggttgcagtgaactgagatcatgccactgcactccagcctgggtgacagagccagattccatctcaaaaaaaacaaaaaacaaaaaacaaaacaactcatcctgtcttttgtgtttatcacatcagaagtttacacttaggatttaggaattgcctcttgagaacttttgtgttgctaattagaaatggcccttactgggcaaccgtggtggctcacgcctgtaatcccaacactttgggaggctgaggcaggaggatcacttgagcccaggagtttgagacaggcctaggcaacatagtgagacccagtctctacaaaaaaacttaaaagagattagccaggcatggtggcacaagcctgtaggcccagctaactcgggaggctgaggcgggaggatcacttgagcctgggaggtcgaggctgcagtgagccctgatggtgctgctgtactcccgcctgggtgacagcgagaccctcagaagtgttaagaggccaggcgtggtggctgacgcctgtaatcctaacactttgggagaccgaggcaggtggatcacctgaagtcaggagttcgagaagagcctggccaacatggtgaaaaccagtctctactaaaaatacaaaaattagctggatgtggggtacatgcctgtaaacacagctactcgggaggctgaggcaggagaatcgcttgagctagggaagcataatttgcagtgagccgagccactgcactccagtgtgggtgacagagtgggattctgcctcaaaaaaaaaaagtgttatggaagcctctggggtctacattttttccccgtaatgtccccctgctaccatcaccaggatgcaaagggagaaggataaggcaagtggcatgtatttaggttaatgagaggaaaggggtgggcttctcaccaccaccaggtaccctaaacctcagctcagctctgccccacatgggtctggcccctttcagcccaaggttttactctgcctactggtcaacctctctcctaatttctctatgaaaaatccttgatttaatctaagatgggaagagagaggaagaatgactaacactttgtatttccatataggctcaggaatagggtaggaactagggtgaggtggaattttaaataaggacagtctctgacaaggcaggtttagggagaagtgagtgaagcagggtcgtgcaagtgtagcgtcggagcctacctttatttaaaagtttcatatcttgttcatcatggatattatttacctaatcagtgagtgtttttggtgccctcttaaattttccacccaaggtaagtagccttgctgactttaccttactccaggcttgttcaggacctttcaaataatttgctcagagacacccaactagaaagcggcaggatcactttggaaagttaaggcaggccacatagccaggggctgtctctaaaaaaaaaaaaaaaaaaattagccgggcatgatggtgcataccctgtagtcccagcaacttaggaggctgaggcaaggtgggagaattgcttttgagccccagaggtagaggccgtagtgagctctgatcccaccactgcactccagcctcagtgacagaatgacagtccatatcaaagaaaaaaaaaaaaaaaggctagaaagtggcagagctgggatttgacgctaagtctgtttgcatccaaaccatgcttttttctaaaccattagtcttttaagagtcctcataggcgattatcttgggccactcatgataattaatccattaagtaaaggtgcattcacttgttaatatttgttccaaatctagagtgtgtgaacactattttaagtgccagatgcttctgagaggtcaagttggctttctgcctcattcttacacttgtctagcatttggcacttttgactattctcttcttaaaacttatcttggtgtccatgacctggtctctcctggttttcctcctgcttttctaaccatactttcttctatctgctttgtggactctgtctttccatttctttctttctttttttttttgagacagagtcttgctctgttgcccaggctggtgccatcttgactcactgaaacctctgcctcctgggctcaagtgattctcgtgcctcagcctcccggatagctgggattacaggtgcatgccaccacgcccggctaatttttgtattttttttttttttttttgtagtagagacagggtttcgccatattggccaggctggtctcaaactcctggcctcaagtgatctgcccgcctcggcctcccaaactgctgggattacaggtttgtgccatcacgtccggcctctctttccattttttaaatgtctgtcatgcatttttttcccactgtatataccctccctgggcatactaatgaccatccattctctatctttagtccagacttctcttactgagctgccttaccagtcatctacacttggatgccttagaggtacttcaactcaaaacccccaaattgagttcctcattctttcctgatccctgacccccgcattctgttcctcctgattatctgatatatacccatacttagagaatggtaacacctatctatctctccagcacccaagccagagacctgagaatcattcttgactcttccctttccctcagtgcccacatccaatgagacaccaagttctgtagaattttttttttttttttttgagacggagtcttgttctgttgcccaggctggagtgcaatggcgtgatctcgggtcaccgcaacctctgcctcctgggttcaagcaattctcctgcctcagcctccagagtagctgggacttataggcatgtgccaccacgcctgggtaattttttttgtatttttagtagagacggagtttcatcatgttggccagactggtctcgaactcctgacctcaggcgatccacccgcctcggcctcccaaagtgctgggattacaggcgtgagacactgcacccggccagattttgctttcaaagcattcctctactctgtccccttcccgtgtcctcactgccattatgctagtccacatctcttacctgatctctttgtttccaggcatacttcccccaattcatcctccacactatttctagagggaccatcttttctctctctctctttttttttttttttttccagacagggtcttggtctgcctcccaggctgcagtacgttggcacgatcacagctcactgaagccttgaactcctgggctcaggcaatcctactatctcagcctcccaaatagctgggactacaggcacacactgccacgcccagctaattttttaaaaactttttgtagagacagggtctcactatcttgtccaggctggtttgcactcctgggctcaatcgatcctcctgccttggcctcccaaagtgttgggattacaggcgtgagccaccatgcccggcctatttccagagggaatttctttaaaagttcctcctggcttataagacaaagtccagctccacagcagaacagatattgttctccatgatctaattcatatttatctctcctatttcatgtctcccctccttcccttccctctatcaccctatgctgaactgaagtggtatttggccatatttggtgtgtcagggtctttgctcatccagcttcctctgcctgcagtgccatttccttttttatcttgcaaacacctgctctactttttttttgagatggagtttcaggctggagtgcctcaccacccacttttaagattccactccaaattttctgtcaccatctagggagatttgaccactccctctggtgtgcctatactgttcctgctacataattgtatccagcacttataacactttattgcacttgtgtatttacatatccgctcttccccttataaacttcaagcttcaggaagacaggacctttgaataactgacacttatatccagagtatccagaacagtgcctagcacaaggaggcacttaataaatattgaactcagatgagagcacctcctggaaagcaaaaaaaaaagaaaagaaaaaagagaaaataaacattgaatgaatgaatggatactaaaagaaaacaaagcagtggaccaacccaataagacacttgataaaatctcatcaatttactccaaaatgaggaacaggccaaaatggatagtgaaaaatatgaatgatctgtaactctaagatcaatataattctgttactttgtgatcttatacagatctctatttatgtaccactaactgtgctgctttatgttgtttacatatctgtttccccctactagtctgaaagcttcatgaccctgtctaatttatctctgtatcattgatgcaaaacccataataggtgtacaataaatatttcttgaatcaaaattaaggaatgaggctgggcgcaatggctcacacctgtaattccagcactttgggaggccaaggtgggcagatcacctgaggtcaggagttcgagaccagcctggccaacatggcgaaaccccatctctactaaaaatacaaaaaaaaaaaaaaatcagccaggtgtggtagtgcatggtagctatgtgggaggctgaggcaggagaatcgcttgaacctgggaggcggaggttgcagtgagccaaaattccaccactgcactccagcctgggcgacagagtgagactccgtctcaaaagaataaaaataaataaataaaataaaataaaatttaaggaatgaagctagccaaagtagcttcttataaaggtttggggatttatctcaatgaaatgagaatgattttgtcttactatattttaaagatatataaagggctgacatttgcatacatttttatttttctattttctcagcaaacactttcatttttatagattctacaaatataaactccagcttcgctcttttctgaaatataacaaattccaatttagggaagttcaaattagtgaatctttaccatactgtgccttaccttgtttcattttgcttagtattcatatgcatctgggttttgacaaagcaggcactagaaaatatggatgtggctaacatgtaccagtttttatgggcctagtgaatttttaaaaaattctttttatttatttatttatttgcttatttatttatttatttatttttgagatggagtcttgctctgtcgcccaggctggagcgcagtggcacgatcttggctcactgcaacttctgcctcctgggttcaagtgattctcctgtctcagcctcccgagtagctgggattacaggcatgccccaccacacccggctaatttttgtatttttagcagagatggggtttcaccatgttggccaggctgttctagacctcctgacctcaggtgatctgcccacctcggcctcccaaaatgctgggattacaggcgtgagccactgcacccggctaaaaaaaagtattaatgctatttatgatttataatcataaatgcttttaaactataaaatcaaattattcgccttattacctttggtgcttgtcttagtccattcagactggtataataaaatagcataaactgggtagcttataaacaacagaaatttatttctcatagttctgtaggctgagaagtccaagatcaaggtgggagcagtttggtgtctattgagggcccactttctcttcacagatggtgccttctaactgtgtcctcacatggcagaaggggcaagtcagctctctgaggcctctgttataaaggaattaatctcatttaggaacactccaccctcatggacataatcatttcccaaagccccacctactaataccatcatcttgggggttatgatttcaacatatggtttttgttggggacacaaacattcagaccatagcaaagatgctactaaggtttaaatcacagggattccagcagattgcttgtgtttggattttttttttttgatggagtctcactctgtcgcccaggctggagtgcagtggtgcaatctcagctcgctgcaatctccatctcccgagttcaaaccattcttgtgcctcagactcccaagtagctgggattacaggtgcccgccaccactcctggctaatttttgtatttttagtagagatggggtttcaccatgttggccaagctgtctccaattcccggcctcaggtgatctgcccacctcggcctcccaaagtgctgagattacaggtgtgagccactgtgcctggcctcttagtttaattacatataattaagataagaaaaattatatataatgggacaccagtggctggtgtgaaaggggagaggactctgcttgtgttttcttcattctaatgttaaaatcatggttaatgcagtaatttccttacaatattctcactctagaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcgcgcgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggagg

SEQ ID NO: 38556 - DNA, 13729 bp, Homo sapiens
agcagtgccagggccaccacccctggggaggagccattgggctactcttgaggggccagaggtgagcctgaacactccacagctgctgctcctagggaggagctggtaccatgggtgtcaggcaacagttggccttgctgctgctgctgctgctcctgctctggggcctggggcagccagtgtggccagtcgctgtggccttgaccctgcgctggctcctgggggatcccacatgttgcgtgctacttgggctggccatgttagcacggccctggctcggcccctgggtgccccatgggctgagcctggcagctgcggccctggcactaaccctcctgccagcacggctgcccccaggactacgctggctgccggctgatgtgatcttcttggccaagatcctccacctgggcctgaagatcaggggatgcttgagccggcagccgcctgacacctttgtagatgccttcgagcggcgagcacgagcgcagcctggcagggcactcttggtgtggacggggcctggggccggctcagtcacctttggtgagctggatgcccgggcctgccaggcggcatgggccctgaaggctgagctgggtgaccctgcgagcctgtgtgccggggagcctactgccctccttgtgctggcttcccaggccgttccagccctgtgtatgtggctggggctggccaagctgggctgcccaacagcctggatcaacccgcatggccgggggatgcccctggcgcactctgtgctgagctctggggcccgggtgctggtggtggacccaggtgagggccttggagccagtggagaatggaagggggcaagggcagggactataggacaggggttctgctgggactggcagaggcccttggtccccacctgcctactttcacaggcaattataatcaagacttatgagcagaaagtagttctcaggtcatcagagtttaattttcccacaatttgaccaaaaatactaatgatgggattctttaccaaacaacatggatgcttttctctactagctgctcctctgcctgcatctgtgggtctcagatcccgcctcgcaacctcaaaggtgagccttgcctctgtttctcctctgacccatctctgcagacctccgggagagcctggaggagatccttcccaagctgcaggctgagaacatccgctgcttctacctcagccatacctcccctacaccaggggtgggggctctgggggctgccctggatgcagcgccctcccacccagtgcctgctgacctgcgtgctgggatcacatggagaagccctgccctcttcatctatacctcggggaccactggtgagggtgcccattagccctagcaccagcctctgaactctcaggctgacctgaccccacacttgacttgtgactcagtgttgacctctgaaaccactttaccctctgattttgacatttgttttttgtttggctgttttttttttcgaggcagagtctcgctctgtcgcctaggctggactgcagtggtgcaatctcggctcactgcaacctccacctcctgggttcaagcaattctcttgcctcagcctcctgagtagctgggattacaggcacacaccactatgcccagctaatttttgtatttttggtagagacagggtttccccaagttagccaggctggtctctaacccctgacctcaggggacctgcccaactcagcctctcaaaatgctgggattacaggcgtgagccactgctcccagacttgattttgatatttggcctgaactctgacccccaatgtaatttgagaggtcaatgccagaattcttcctgtgtccagtaaacagccactgaaacctttgatcttgacatattactttcagtccaaattcagcctgtgaacccaaccacaaatccctatacttgactgttctctgagagcctcaaaccccaatgtaggcctggctgttggagatctatccctctggtcaggcccctctctgtgctgtcatgtcaccaccctgcccttgccatgccttcatcccaaggcctcccgaagccagccatcctcacgcatgagcgggtactgcagatgagcaagatgctgtccttatctggggccacagctgatgatgtggtttacacggtcctgcctctgtaccacgtgatgggacttgtcgttgggatcctcggctgcttagatctcggtaagcccacttctgaggatccctccagtctacaggaccacgggagtaagtgtcggcgtggggctgtcaaggcaaaaagacaccataggttacccagcaccctgtgttctcacttttgagaagggacacccaccaatgactaccagggccgcatggacagaagcttggacacccacacagtccctgatggccatgctttggtcaggaggtgacaagacctgatacgagtgatggtcacaggcatccaaggaaggtgtggtgctcaggagatgatggggatgctggcccagatttgtgacatggccccaagggcagctggagtaggagtgctctcaagcactccacagggctgtctctctggactcttgattcagagtctagatggggacctctccatagcttgttctttttgttttctctcttttttttttattttaatttttatttatttattttttttcgagacagagtcttgctttgtcacccaggctggagtgcagaggcatgatcttggctcactgcaacctctgcctcctgggttcaagcaattctcctgcctcatcctcctgagtaactgggattacaggcgcccaccaccacgcccggctaatttttgtagttttagtagagacgggatttcaccatcttggccaggctggtcttgaactcctgacctcgtgatccacctgccttggcctcccaaagtgctgagattacaggtgtgagccaccgcacctggctattttctctctctctctctttttttttttgagacagagtctcgctctgtcgcccaggctggagtgcggtggcatgatctcggctcactgcaagctccgccttccaggttcaagcgattttcctgcctcagcctcctgagtagctgggattacaggcacgcaccaccacgcccagctaatttttgtatttttactagagactaggtttcaccatgttggtcaggctggtctcaaactcctgaccttgtgatctgcccacatttgcgggcatttgcctcccaaagcgctgggattacaggtgtgacccaccacgcccggcctttttgtgttttccagctattatcatggccatgtgtggttgctcatgcctataatccctgcactttgggtgccaaggcaggaggatcacttgagtccaggagttcaacaccagcgtgggcaacatagtaagaggccatctgttaaaaaaaaattttaaaaagccacgcatggtggtatcgggggaacctgcccctaatatttcaatgtaggttctttttttttttttttttgagatggagtctcgctctgtcgcccaggctggagtgcagtggtgcgatctcagctcactgcaagctctgcctcctgggttcatgccattctcctgcctcagcctccccagtagctgggactacaggcgcctgccaccgcgcccggctaattttttgtatttttagtagagatggggtttcacatttagccaggatggtctcaatctcctgacctcatgatcctcccacctcggcctcccaaagtgctgggattacaggtgtgagccactgtgcccggcctcgatgtaggttctttctattttccgtaagtgctggccagctgagaaataaagagaaagagtacaaagagaggaatttgacagctgggcctccgggggtgacatcacatatcggtaggaccatgatgcccacctgagctcaaagccagcaagttttattaaggatttcagaagggaagggggtgtaagaaccgagaataggtacaaagatcacatgcttcaaagggcaaaaaacggaactactgatcagggtccaacaaagatcacaaggcaaagggcaaaagcagaactgataagggtctatgttcagtggtgcacatattgtcttgataaacatcttaaacaacagaaaacagggttcaagagcagagaactggtctgacctcaaatttaccagggcggggtttttccccaccctagtaagcctgagggtactgcaggagaccagggtgcatctcagtccttatctcaactgcataggacagacattcccagagcggccatttatagacctccccccaggaatgaattcctttcccagggtcttaatgttaatattccttgctaggaaaataatttagcaatatctctcctacttgcacgtccacttataggctctctgcaagaagaaaaatatggctctttttgcccagccccgcaggcagtcagaccttagggttgtcttcccttgttccctaaaatcactctcattctgttctttttcaatgtgcgctgatttcacattgttcaaacacacattttacaatcaatttgtacagttaacacaattatcacagggtcctgaggtgacgtacatcctcagcttatgaagataacaggattaagagatgaaagtaagacaggcgtaagaaattataagagtattatttgggaagtgataaatgtccatgttatcttcacaatttatgttcctctgccgtggctccagccggtccgtctgttaggggtccctgacttcccgcaacagtggtgagcacttgtgagcgattcttctgcctcagcatcccgagtagctgttattacaggtgcccaccactatgcccggctaatttttgaatttttagtataggtggggtctcaccatgttggccaggctggtctccaacacctgacctcatgatccacccacctcagcctcccaaagtgctgggattacaggcatgagccaccgcgcccggccaaatttttcttttttttttaattatgaaaagtttagctgtgcccggtggttcacgcctgtaatcccagcactttgggaggctgaggcgggtggatcacctgaggtcaggagttcaagacaagcctggtcaacatagtgaaatctgtctctacttaaaatacaaaaattagccagtcatggtggctcacgcctgtaatcccagcactttgggaagctgaggccactggatcacctgaaatcaggagtttgagaccagcctggccaacatggtaaaaccctgtctgtactgaaaatacaaaattagctgggcgtggtgatgcgagcctgtgtttccagctactcgggaggctgaggcaggaaaatcgcttcaacctgggaggcgggggttgcaaaaagagtgaaactcccttgcaaaaaaaaaaaaaaagtgaaaatagtttgatgacatctcatgtatcttcgcccagcatcaataattgttaacatgttgccagtttaatttcgcatatacttctctgtttcttttttgtttgtttttgagacacagtctcgctctgtcacccaggctggagtgcagtggcaccatctcagatcaccacaacctctgcctcccgggttcaagcaattctctgctgaggctgagcctcctgagtagctgggattacaggcatgcgcctccacacctggctaatgtttgtattcttagtagagacggggttttgccatgttggccaggctggtctcgaactcctgacctcaggtgatccacctacctcggcctcccaaagtgctgggattacaggcgtgaaccaccgcgcctggcgtctgtttgttttcaaacttttatcatggccaggtgtggttcctcatgcctataatccctgcactttggggtaccaaggcaggaggatcacttgagcccaggagttcaacaccagcctgggcaacatagtgagagtccatctgttaaaaaaaaaaaaaagccaggcatggtggtgagcacttgtgagcgattctcctgcctcagcctccctagtagctgttattacaggctcccaccaccgtgcctggctaacttttgtatttttagtagagacagggtttaaccatgttggccaggctggtctcgaactcctgacctcgtgatccgcccgcctcggcctcccaaagtgctgggattacaggtgtgaactaccgtgcccggccaaatgtttttttttttttttttgagtcggggtttcactattgttgcccaggatggaatgcaatggcgcgatgtcggctcactgcaacctctgcctcctgggttcaagcgattctcctgcctcagcatcccaagtagctgggattacaggcatgtgccctcacgaccggctaatttttttttatgtttttagtagagatggggtttctccatgttggtcaggcttgtctcaaactcccgacctcaggtgatccgcccacctcagcctcgcaaagtgctgggattacaggcgtgagccactgcgcccggccaaattgtttttttaattatgaaaagtttaggctgtgcccagtggtttacgcctgtaatcccagcactttgggaggatgagtctggtggatcacctgaggtcaggagttcaagatcagcctggctaacatggcaaaatccgtctctacctaaaatacaaaaattaccggggcatggtggctcacgcctgtaatcccagcactttgggaggctgaggccggcggaacacctgaagtcaggagtttgagaccagcctggccaacatggtgaaaccctgtctctactgaaaatacaaaattagctgggtatggtggtgggcgcctgtatttccagctaccagggaggctgaggcaggagaatcgcttgaacccggggcgcaggggttgcagtgagccgagatctagccattgcattccagcctgtgcaaaaagcgagactctgtctcaaaaaaaaaaaaaaaaaaaagtgaaaatagtttgatgacatctcaggtatcttcacccagcttcaataattgttaacatgctgccagtttaatttctttttttttttttctttgagatggagtctcgctctgtcgcccaggctggagtgcagtggcgcaatctctgctcacggcaagctccgcctcctgggttcatgccattctcctgcctaagtctccggagtagctgggactacaagtgaccgccaccacgcctggctattttttttgtatttttagtagagacagggtttcacggtgttcaccaggatggtctcaatctcctgacctcgtgatccgcccgcctcggcctcccaaagtgctgggattacaggcatgagccaccgcgcccagggccagtttaatttcacatgtacttccctgtttcttttttgtttgtttgtttgtttttgagacagagtctcgctctgtcgcccaggctggagtgcagtggcaccatcttgggtcaccgcaagctccgccccgcccgccccccccccccccccagggttcaatcagttttctgcctcagcctcctgaatagctgggattacaggcacgcaccgccacaagcggctaatttttgtatttttagtagagacagggtttcgccatgttggccaggctggtctcaaactcctgacctcaggtgatccacctgcctcggcctcccaaagtgctgggattacaggcgtgagccaccgtgcccagccacttccctatttttttccagaatatatcagagcaaatcctagacactgcatctttatgcttgtaaatattgcagtacatatctctaacatataagcactgaagaaactgtaaccaaagtgattattacacgtaacaacattaatatcatatgatgtccttaatatcatatgatgtaaccccttaatatcatatgatgtccagtctatgttcagatttctccaatgggctgttttggtttggttttgtttttagagacagagtcttgctttgtcacccaggctggagtacagttgtgtgatgttggctcactacaacctctgcctcctgggttcaaacgattctcatgcctcatcctcctgagcagttgtgattacaggtgtggaccaccatgcccagctaatttttttgtatttttagtaaagacagggtttcgccctgttggccagtctggtcttgaacttctggcctcaagtgatctgaacacgttggcctcccaaagtgctgagattacaggtgtgagctactgtgcccagccaattggctgtttttttgtttgtttgtttgtttgtttgtttttaacaattaaacagtctccccattgtatttgcttgtaggtctctgttcccctttcatctgcatttcttgttaaattggaaactttaactagaggtgttgttagattcagtttttttctttttcttttgagacagggtctcactctgtcacccaggctggagtgcagtggtgtaagctcggctcactacagcctccccctcctgggttcaagcgattcttccacctcagcctcccgagtagctgggactacaggtgtgcgccaccacgcctggctaatttttgcattttttggtagagatagggtttcaccatgttggctaggctggtctcaaactcctgatctttcaggtgatccacccccctcagcctcccaaagtgttgggataacaggtgtgagccaccacgcccagccccctatatcttattaatccatgtgtccatacgtcaatacaaccatacaaacattcaccaacccacccatctacctactcacctacttcctcactcattcattcattcatccacccacccatctatccatccttacacctatccatctttctctttttctttttttttttttttaagacagagtctcactctgtcgcccaggctggagtgcagtggcgctatctcggctcactgcaagctccgcctcccaggttcacgccattctcctgcctcagcctcccgagtagctgggactacaggcgcccgctaccacgcccagctaattttttgtattttcagtagagacgggtttcaccgtgttagccaggatggtcttgatctcctgacctcgtgatccgcccacctcggcctccctaagtcctgggattacaggcgtgacgatcctcacccagccacctatccatctttctacccccctgcctctgcatgtcactgtccagccatccatctactcactcactactctaactgtccacccatccatctactcactcactactctaactgtccagccatccatctactcactcactactctaactgtccacccatccatctactcactcactactctaactgtccacccatccatctactcactcactactctaactgtccacccatccatctactcactcactactctaactgttcacccatccatcttctcactcactactctgtccacacatccatcttctcactcactactctgtccacccatccatctactcactcactactctaactgtccacccatccatccactcactcactactctaactgttcacccatccatcttctcactcactactgtaactgttcacccatccatctactcactcactactctgttcacccatccatcttctcactcactactctaactgtccacacatccatcttctcactcactactctgtccacccatccatctactcactcactactctaactgtccacccatccatccactcactcactactctaactgttcacccatccatcttctcactcactactctaactgttcacccatccatctactcactcactactctgtcacccatccatctactcactcactactctaactgtccacccatccatctactcactcactactctaactgttcacccatccatctactcactcactactctgtccacccacccatctactcactcactactctaactgtccatccattcatctttccatccatccaccatatccatccacctgcccacccatctgcttagctgggcattcatttatcgtaatcaagagtgatttgagcttcgagtcagtgacaagccaaaataaaaattaaaaatgtggctgggcacagaggctcatgcctgtaatcacagcactttggaggccgaggcgggtggatcacctgaaaggtcaggagttcaagaccagcctggccaacatggtgaaaccccgtctgtacttaaaaaagtacaaaaattagccagctgtggtggcgggtgcttgtaatcccagcaactcagaaagctgaggcaggagaatcgcttgaacccgggagggagaggttgcagtgagcggagattgcaccactgcactccagcctgggcaacagagcgagactccgtctcaaaaataaaaataaaaaatttaatatttacagcccttatttagcattgctcactttataacaggcacggagctttcccggcatcctggagacaggatttgaacccaggcctgcctatgctcttctagtgagagcagtcctggctgggccaaggacacaaagatgaactcagtattgtcctgtatttcagggtgtgggggtgggtgagcacaggtgctaaaagcagcttcttacaacaatttggaagcatgacctgaaaccccctctcctgtcatctcccaggagccacctgtgttctggcccccaagttctctacttcctgcttctgggatgactgtcggcagcatggcgtgacagtgatcctgtatgtgggcgagctcctgcggtacttgtgtaacattccccaggtgaggctctaagattagggctccatggtgaacacccaagtatgaaatcccaggtaaaggtctcaggtaaagattcaggtactgaactcaagtccctcagataatacacctcatgcaagaaccccagataatgagtttcagacaaggcttccaataatggtttctttgatagctgtgctaccttgagcctcagtgtcctcatttggaaaacagggataatagcccctacccctatcatgagaatttccattaaaaattaattaattaaaattaaatttccattaaattaaagttctaggtaactactcttaggtgagaccccagatgaggcctccagtcacctctggtaacgtcccccaggcaaagctctgaggtcgcccctgcaggtaaccctctatttaagactccagtaactactctcatgtaagtaacccaggtagatcccttaggtagaggtcccccatcaccttccaggtaactcccaaggtaaggacccaggataacaccccctctaggtaaaggttccaaggcatgccccaagagcacctcctcctcacccttctggggacattcctgtagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgagtgagtgtgcgggtacctggtgtgcagctgccctgaggctgagcccacaggacctatgtcaacactccaccctccaccccagatgctgtccccctttgagctggtgcagttcgacatggaggcggcggagcctgtgagggacaatcagggcttctgcatccctgtagggctaggtatgggggttgaggagcctttcctgggtggcaggggtggcgaccctcagtcttctgcttggctggaacgagctgctcaaaagcttgacgttggtgctcactagaggggtctgcagccttcatctggaccctgagccagtggcctgccttaccaccatctggggcctccgcctcagcttctcggctctgtccagctcccctgccttgatctcttgctctgatttactgggtctctgggtgtccatctgatttgttctcttgagctttctgtggaagacggcattccagccattggtcccttgtcctgtaccttctgttagtgtcttctcccagggccttgcaaggtcctggtcatatctattctcactgccatttgtctgtccgtcttccatcccttgttatccttttcctgtttctcatgggctccccataccgccttctctatacttctctctcattttctgtgtcgcttgtcgcagtctctcaaggtctctgaatgtctctctcatctctggatctccctgtctgtgtctttgggtctgtccttggcagggtgctgggtgatgaagagtccaccgttgttgaaaacctccagcagggggcttggctggtgggctccaggggttcttgttcctgctcctaccccaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccggtccgaggcagggtttctcggggcggggctggcgcggggccacggacgctttcagatcctagagggagtcaggctgaagaggcgggactttcctgtcgtaagagggcggaacttggagtcaggacttctcacgcgaaggcggggcttctcgattttcgagggggcggggctgactgggcctcctgatccccaaaaggggcggggcgggggcaagaggcggggcctctccttcccgggggcgtggtcacaagcgccggctccctccttgcagatggaagggcgagaacgtgtccacgcacgaggtggagggcgtgttgtcgcaggtggacttcttgcaacaggttaacgtgtatggcgtgtgcgtgccaggtgcggagggttctcattttaaacttccaacagctttgtgggtggaggggtcgttattctgattttacaggtggggaagtgctagggcccagagaggtttagagacttgctggctctcacagccagtgagcagagctgggcgaggctggagggtcagctatgggccctcgagatgggtcagccgagagtgaccagactgctctctaggttgtgagggtaaggtgggcatggctgctgtgcagctagcccccggccagactttcgacggggagaagttgtaccagcacgttcgcgcttggctccctgcctacgctaccccccatttcatccgcatccaggtgagcccagggtggcctggtgggtgggtggaagatcatagccagggggcgggtggatgtcacagtgattggaccatggtcactgccctgcaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcac

SEQ ID NO: 38557 - DNA, 55399 bp, Homo sapiens
tcctggttaacagcttatgggcggggagctcggcaaaactcagactaaaaacagaaaaagagaaaagaaaggacaaattcgatacacccgcgtcggtcctccagagtttgtgaaggggtgtaaacatgtcggagtctggggagatgagtgaatttggctacatcatggaattgatagctaaaggcaaggtaagtgatgaggcgcggggcgccgcggcctgggcccccgactccggcactacctggcccgccactgtgggcgtccgtgtccattccagcgcctgggaagggcgggaggctggaatccaggagccgcgctcgcagcccgggcgtcccagcagctgcggaatgcaaagtagccgccttttctttattgcgtggcatctctgaaataagccaagaggggactttcggacgcttttggggccagctgggcagcaataggggctctcggacgccgaagggcgagagcccagcgtcggaagatggagaggagggcggggcgttggccaagggggcgctgccccaccaaccagggctactcaaacgtggtgacttcgagtgggtgacctcgcctgcctgggcgcggagcgtggagggagggtccgcccagcgagtgaacaggctcgaagtgtgcgatcagggtcagcccgcagtcagagcgtgtggccggtaaatagggacagcacgttcgttcgccctgccctggccttttcgggcctctttccaggtccttagctgctgctgctccaggccgggaatatttaaagcagccttcttttggtagggaggggaagatgctggaggagcgggatttcagccccacacctgtcctggagcctttaggaacgcaggctggcgccgtcggtggcgcccgcgacgacgccctcagcaggcggggtggtgccgggcctgagtcagtgcgggaggctgggctccgcgctgcatccgagaaattgccggcagaagctcctaagtggtttgcaggcggaacgtgtcgggaagtacggaggctgcacagtgcactgccctccggaactcgcagacggagagaaggcgggaaagggcgtcagcgtttgccctctgcgcctggagcttcgagaagaggtgatggcacaaaggagcactcgactccctgtgcgcggttaacagaaaggaggatgattctgtagccctgatgtgagcacctgaaaccctgcagtcccacaccccactaactccaacgccgcagatatagcatatggagtagttttagattcatgcccgacagtcctatggccccagggctggggagctggtttaatgcactcttagcctaaaaagtcccaaatgaaccctacgcctctctgaattctcttgttctacaggcactgaatacattcatcagaaacagaatattcattaacatttcgaaagtgaagctgtgtcttgggcctcccctaccatttacaaccccgggccagaagtacaattggagaactctccttccacttttcttccaagcccagactccatcctgcacctcaaggggccttcagcacacactgtccagtatatccgagctctttgtcgccccagcagcagccccttgaccacccttcgggcctagggtgcatattgcggcccacccttccctctgaagaatggaccctgggaagagaagtcctgataagagaaagggctggctctgagcaaagaggcaggcaaccagaggagggccagaaccacggcctctaaagagcgagaggtgcaggcaggacaccgactgcccaggtctaggggaatgcctaacaggggcatctatttgggaacgttgaggggctagggggcagggaggaaaaagaatgcctttggttgaacaaaataaatggactactcttgataggatggagaataggatgatcgataggtgaattttgtcctatggcgctcagatattcttcaaagtaagccagaattgtattagttggctatgctttccttcaatagcagacaaatcctgaaattctgagagaataatttcggggtaggacccagggatttgcatgtgaagaacagcccaggtgaccatgaagccgactgatggatgtcctatgaacacgaaatggggaagtagggcagaaccattaaaactccttataatcaagtcaggtaaacaaaaacaaaaccctctcagaataccaatgggttcatcacagtatgctcactataatgaaaaaacacaaactaactttctggcttcatttactggatttctctgctctctctctctctgtctctctcttcactaggcttcagcaatgggcctgcagcaaacccatgagcattcccggttgacttctaaaggtggagaggcccgctgtccctttgaaatctctgaggttggaaagcagtctctcccaagaagaacttaggacaattcctctctctgttttgtgggggttggagggggagagttggtctggagtaggctcctaaccatttcaacgtaagcttatttcctaccactctcctcaggctcaaatcctgccccgccccgcagccccagcactagcccatttaagacccctgttttgtgtgtgattatacaggatttgaacactgaatattaaccatggaatagcagacctttgagactgacttgctttattttcctctgtggggttcggttccactttgtagttcgggtttgtaatgtaaagaataatgggaaactggtctaattatgagagttaagagagtagaggcctgtagttggcctgccctccgccccaccatccctcaaagttgagaccactgagttaaccatcctcttaatttctctcacttttcccccagatttgtttcatccttgtactggacttctcaagctctgtacataattaaaaatacatagctttacatttttacaaacttaatacctggaatatatgcttgttgtaaagtattcaaacttcacagaaaggttcacagagtaaaaagtctaagttcatgcccacctccaatctcattccttccccagtggcagcagtttgtgtgtctatttcaaattaaattagcataccgtatgttctctgaaatgtgggaagtaagccttttttcttagggtaacctaaaacctacaggacaaactggatcagcttatttactctattgtgatggctactttaatatttaaagtacacagtgatatctgccattgtgacctttctgctcatcaaacaatactgcataagtgtagttaatacttacgatcattctcaagaggcttaaaaatgaaaatgtatttccttacatttcactagcagtgaaacttttaccatttctgaaagctgtcttttcgcttcttttgcagctaatctctttggattaaaagagaggtttccaaatctgtggtcaatatctaaggttactcaaagcagtattttccaactgttttggtctcttgtaagatttgcctcactaatttttttatcaccgcttctggaatcatataatgaagatttgatgacaaggaatatagaattcaaattttagtatatctctttgtattttgtgtatttagcatatttacatttatgtgtaaatagccagaaggtacattcggttcccataatttaatatttactgttcaggcacatctaagagcataatggtttcagcaaaataagagaggctttgtaaatcttatatttaattttgatactgaaataggcaatgataccattacttggtgaattattttaactttgaacatctttgaggcacaaaaaattcaagaatttttacaaacacaaactttaccttaaaaaaagaagacacttacactctgaaagaattagtcttggaaagtcctcaaatctagactaataaaaggtcttaaacatctcctgggaccaaaacaaaaataccaccaaatgatctctttcagaaggacgaatagatagttgctcacacaactaaaatctaaactggggtgataatggtaaggttgtgcccactgcataagtatttttatttttatttttatttttttttgagacacagttttactctgttgcccaggctggcgtgcagtggtgcaatctcaggctcactgcaaccttcacttctgggttcaagcgattctcctacctcagcctccctagtagctgggactacaggcacacgccaccatgcccggctaattttttgtattattagtagagacagggtttcgccatgttggccaggctggtctcgaactcctgacctcaagtgatctacctgccttagcctcccaaagtgctgggattacaggggtgagccaccgcatccggcctacaaagtattttttaaaggttttttaaatatatgtattgaaattgggtgaaatgtatgtgctgtggggagtagggaaggcaggcagaagatttagatttttgtaatatcatttgaaaagagctactttcataaatataattttcctcttatttttttttactatattgcgctaaagataatttgaaaaaaaaaggtgtctcctaaactactttgtaaaaggatgtttaaatcagatttttagtgaaattgtaaattctgtgttgtatactcacctgtgggcagtgcaataaggatgctggactgagacccaggtttgaatcctggctttttagtatatggccatgtagtatatagcccatagattaagcatattacttaatctatgggcggaggtggagaggaattttagttgttacatgtcttctctgaaaagaattatacctatttcacagggttactgcaagggttaaatgaatcttttatgcaggtttcctaatactgttatcgacacatcataggccctcaataaatgaaagctattacttctagcttttatgacaacagggttgggccttgagacaccttatatccacattgtgatcattaagaagtggaggtagggctgacagataaaatacaggatgtagacttgaatttgaatttgagataaatactttttttttttttagaatatgtgcaatgtgatatttggaacatatactaaaaaattatcatgtatctgaaattccaatttaactgggtgtattgtgttcttatttactaaatctagtaaccctacagggaagaataataagatgtggtcaacagagagggacctgctagattgcctcaaaatattaccagttttgtttacctcaagttggccagaaaacttctttgcccactagttatgcagctaatacactcatcattaatggaaaaatgtccgtgagagcagcactgggttcctctcatcttcctaatagcaaattgttgctctggtgctactgtttagtagataaatgcttactagattttgtcttaaataaaagcttaaatggtcgagaagacaaaacatcaaacatcagtgtacaaagactaggtatttgtgttaaactgagtgctaaaagaattcagaatagagggagataatcaatgaaatcaaaactaataaaggaggctccagaagtgcaacttgaaagatgaggaggatttggccaggtagtggaaatctgaacttgctggctctctggactcctctcccctgactttgttcccatagaaacactttatgactggtaagcttggcctgtcagtagcttgagtcaataattgatagacaataccattcattatccctttactggtaacctcctgatacccagcagtataggtggtccgtgtgccaatctactggaaaaccctgtaatttactttatttctgtactttttattttctgtaagtccaggtgctctcttgattttatacctatggctgcttaattattaggggttcccaaaagggggcagagtttagggaatatgtggccatattaccttgtttctatttcttgtttagtatataccaatagaatggtggtaccctgcctgtctgatctcagagcaaaccaattaatatgcaccatggtcattaggacttgacccagccatgaatttaatctcttgttgggtattaggaatcaatatggaaaaagaccaagtcagcttatggagtagtatatgatttatagggtaaggggtttatattttaaatatcaagcaatgaacattgattgaggctctgttttatcaaagcctgaattgtgtgtgtttggagaggggaatcttgaccttttggacttcatgaagtagatggatgtgagagagctcatgcccctgtgatagaagagcaattaagtaataccagaagtagaaaagtagatatcacaatgaaggcaagagtattgaaggtctgtggacttagggggataagaataggataggttttcttgttttgcattttaacccagattttaaaataaactattgaaaaaggaggtgctaggatactccaaactgcggaggaataggcaccaagggacagcatatacaatgtaaaataggggaataatgatttttttaaagttcagatatttcatgccattcctgctaaaaagccttcaaaagctgctcaacatctacaaaagcatagaggccttccatactttaccagacttattttgttaccacaggtttaccaccctctaactcctgctcttcaacacatgcgtgcgcgcacacacacacacacacacacattcaaatacacatgtccacacaccccccacccccttatgttccaataccaagctgcctgtggtccaggactgtagcttattctgctccttgtgcaaatagaggcatgaggacagggctacacatatggaaaatcatctgtaaatactcaacttataggctactgttgtaatctaggcatgcggagagggggcttagagtgggcacaggaatcagctgtgaggatgagaaagaacagaatctggtaacaaactatgatttaaggctgatcagagatagacagggaagaagaaaggaagataaaaagcaagcaaacaaaacccaccaggattttaacttgaggaactgggaagggtcttggtatcctgggaggctgggatatttcgatgctgaaacagagaagttgatgacttgacacaaagcacggcagcccagggagacagaaatgatcagggaactgggaaagcagtggtttaaaatggcagttttcgtatttgtcttcttcccctcaccttttgtttttaaaagtttatggatagaaaggatttttaaccttaaaaagttttagaactataacatgtacatataagatggaaagataatacaatgtgagtgaagagttaaatcttgtatacctaactccatcccttacttctccacaatggttatcatattttgtgctctattccagatgcttatttttgtttgcctgtaatcagatatacctagttttttggccagagtggcagcattcagaatccttatggttttgtacttttttttttttttgagacagagtctcgctctgtcgccaaggctggagtgcagtggcacgatcttggctcactgcaacctctgcctcccggtttcaagtgattctcctgcctcagcctcctgagtagctgggattacaggcgtgtgccaccacgccaggctaatttttgtatttttagtaaagggggggtttcaccatgttggccaggctggtctcgaattcccgacctcaggtgatccacctgcctcggcctcccaaagcgctgggattacaggtgtgggccactgcacacattatattttagaaatcctttctcatcagtacattgattttaactgctgcatagtattccatggtatgaatgtatattatgcatgatgtttagttataaataaggtctcaataagctctttgtacatgtttttgtgcacacatgcaagtattacagtaggaacattcttagatgtggaattgcttagtcaaaaggtaaaaatatttaaaatttttgataggatttgtaaaatgtcccttgagataagctgtaccaacatacgatatcacaaaaaggtttgagcaaaataagagaggctttgtaaatcttgtatttttgatagagaaataggcaatgataccattacttggtgaattattaaactttgaacatatttgaggcacaaaaatattcaaaaatttttacaaacacaaaattaaaacaagaagacacttatactctgaaagaattaggcttagaaagtcctcaaatctagactaatataaggtcttaaacatctcatgggaccaaaacaaaaataccaccaaatgatctgtttcagaaggatgaatagatagttgctcacacaactaaaacctgtgctggggtgataatggtaaggttgtgcccactgcataagtatttttatttttttggagacacagttttgccaagtgtattaacacttgccaagtatattaacatcatgtttgaattttgtggatcaggtagaaaatgatagctcagtgaagtctgatttgcaaaatggaaggccatagcaatgtattttcaccaaaatattgtctatacagattttatctttaattcctgttaatggagccttctaatcacttttactgtgtcaactaataagttttggatcaaagcaggtgtgcggatgtgaaattacagcccaaggggaattatttagctcaaaggccagtatgagaaagacttataatgctttctaatggttgagcctttaaatatatgtatatatatataggcacctaattcacgcaggcatttgttagtctcctcctgattagcacttttcagaacctgtgggaaggaagccttcccaagtctagcacctgcggccacgcaacgggcattaatccggatcagaacagcccaggcattattacctggcaaagctttcgtcctctgttcacctcatctgtaaatggagggtattccattagagaaaattgctatagtccctcagtgtttttaattctacactccttatttagatgccggattggagacgaggctaccgctgcagacagggctgtgggaagacgacggaacttgccacagcgacagacttctcccaaacaggaaataaaagtgggaagcattttaaaacctaaacgagatgtctcgctacagctctgtagtccctacttacccagcaatttagggcatctgttcttaaagcctaatacataggaatgaattgtttagctagccagaaaggcagtgcgtgatctaataatcctaaattaatttgttctccgtgtgtcctgaaaacaacaccagaaacacacttgggccgtggcaggtgaaatgtgcgccgccagtccttgagctggcgcgcgccttaacgttcagcagcactccccgcgggggtgcgggggtgccggagccgctcaggaccctctgtcctggccctcaggaaggaaagcgtaggcccgggtggcggggggtctctcccttgccgcggccttttaacttcagtccctggccagcatccgggagaggaatctccaccctgcaggcggtccccgcgctactgggcaagaacgtgcggtgacatcgcgacttgggggtatagaagcagaaagcgggatatgactgctcggtgcccagtcagggactattaagttcacccagcaagtgaagccagaagagaactgggacaagccgggcggggccagggaaccccaggccgcgcctggctagggaccgcggagagggcgggcggggtctcactctggtcgcctcgcgcagctctgccgtgctcgccgcggccattcagggaaggtggcttaggctcgccctcgcccgcaccgtcctgtgccgagcctggaagcggggcttcgaaccgcgagtgaagaaagcgcagtgagagcaaactgaagggcggaatggcagcgcagggccaggggccaggggccagggctgcagccggctgctctgctgcagcggagcctccccgccccggcgccgccctcggcacccgcccaccgctccccgctgccctcacttccgttcctcagagccccccagcctggcatagggcgacgggcgactacccgggtgggagggaggggctgatgcgtagggggaaggtggcggcggagggcgccgagtcccaaccgcgtgccacacccacgcccagccgagtcccgctcagcctaccactcagacacccggcctaccagccccaggcggccccgcctcttttgtgcgactggcgctgttgcctgggcaacgaccaggccacgccctgtccacgccccgcggtgccccgcccaggtctctgcgcggcgccgttcccagccgcagtccgcaggagccgctgctgcagccggcagctgggcgggattcccggggtagtcgctgggagcaaagctcgcttctcccgcgcctgtgcttttgcctgccccggcttacttctccccgcgtcggtccgctggccacgtacagctgaccagctcatcttccagcttcggaccgaggctccacggccgccgcagggacccgcccaccagaccctgcgctcggtagccggtgtgagtggaacgtgccgctgatgacacctggcagaaggcagccatggagggcgatggctcagattcgccggtgagtgcggaggggaccgccgcccccacctcgagggcggtgtgccgaccgcggctctttctctttcctccgccgggagcccggagggagcctcctcccgggagagcaaaggcaggcgtgtggggatcccgcttcctcttcgccttctcccgcccggggctaggttccgcaatccggggcgtcccctttctatccccgagagccggacgtggggtcccctgggccggagaagagcgcaaatccgatggttgcccacctgagcacctcgggggaatcatggagggtctctctaatggagctcaggctgtagaattaattagcgtttgggagtcgggtgcgggcagaaagctggggcgcgtccctcgcgcttgcggggccgccctttgtctaggcgtcttgacccccgcgggcccggccggctgccgccgcctgggccagaggctcctccccggcttcgcctgcccgcggggggcgggccggggccccggcagctgtcagcctacaagtgtttttgtttaaaggtgtcgaatgtgcaattcttccgaagtttctcgaggaactgcttaattgagggagccgccacatcacacttaatcagtttgtttctccctcaatgacagatgaactaaattttctcttgggtaagaaatactttatgtccattgtgattaaaaagtcagattcaagacactgctttatgtacaagaaaatggaaatgattttagatcctcccccagtgacaagtaaacctgaactgaccatatttatacataaaatggaatgtaagaacctattttggatatcccggacaagattttcttttgaattaggtgccaaaccctttgtgaaatgagataggatgtgaatattctgtattctttgatgtgaattgtgaggtttagttatcttatttccaaatctgtgaacagttgggaggtgatatggctcttcatcacatatttgagtgatgcagcaagagactgcatcgaaacacccactgacaatgataaaaccagttggctctaatgcagttaaattgtcagagattattgaagcacttggtgtcactttagggagaataggttagcatacattttaaaatttcattacatttagttaagtcaattttaattttctgtgtatttctagtagctgaaatgattgtacaaggttataagtactttgaagttgggctgtctttaaaattgcagggatgctgactataggattcatagatatgaagtctgggatacatggaaaaaactacgtagagaaatgatggggaaactggtatgaggtcatcaaacttttttagttgtgatgagtctaaaatgcttctcacttaaaataatgaaaggctgtagtattgagagcagttgtagtggtgcttatacacctttttaaagggtcccctacattcttttaatattctgttatggttaggctttgtgtccacacccaaatctcatcttgaattgtaatccccaggtgttgagggagagacctggtgggaggtgattggatcgtgggagtggtttcccccatgctgttttcgtgatagtgaattctcccaatatctgatggttttataaggcagtattctctgttcttactccctctcgcctgctgccatgtaaaacgtgcttgcttcccttcctgccatatttgtaagtttcctgaggcctctccagccatgcagaactgtgagtcaattaaatctcttttctttataaattagccactcttgggtatttctttataacactgtgaaaagggactaacacagagaattggtaccaaggtagtgggcactgctgtaaagatacccaacaatgtggaagtgactttggaactgaataacaggcagagattggaacagtttggagggctcagaagaagacaggaagatgtgggaaagtttggaacttcctagagacttgttgaatggttttgaccaaaattctgctagtggtatggacaaagaagtgcaggccaaggtggtctcagatggagatgaggaacttgtcggaaactggagtgaaggtgactcttgctatgctttagcaaagagactggcagtgttttgcccctgtcctagagatttgtgaagctttgaacttgagagagatgaagcggagcgtaaaagtttggaaaatttgcagccttaccatggagtagaaaggaaaaacctattttctggggagggattcaagctagctgcagaaatttgcttaagtaaaaaagactcaaatgttaattgccaagactatgggtaaaatgtctccaggacatgtcagagatcttggcagcagtccctccgtttggcagggccaaacaggtgcattaatgaagagagccccatcacaggcctggaggcctaggagagaaaaatgttttagtggagtgggcccagggccctgctgctgtgtgcagcctcggtatcacaggatccttagggtgtcgcttcaccagccagaaacctctgtggcaagtgttgcctttgcccaagttttgctcaggcccactgggcttgttctgcccacttgacccagcaggctgtgcttggttttcactactggcccagatcccacggctgccaacggcaagccaggtgcagagcagcaaggggtgcatgagtgagcgagcgcggggtacagtgtgcacagccaggcatggtggctgtggcggggcaggcaggtccaggtgccagtatgggcgccggctccttgctgtggctggaacaggtgtaccacaagtggctcccactacaagcactgtggaacatggtggcacccagaaacttggagatgccggcaactgcagagccacaaagaggatgtcacagccctggcttggggagctcctaagtccaggctccctgaagggctgcagctcttctctcctctcttgtctcctcatcgtcacccacaacatggcgagcagcagggtgtatttgacacagtttgtgttacagcttgtttggtcctgccatttggcaggtccagagttcctgtactgtgtccaggaagaatgagctacatggacaactggagggtgaacaaggtgctttattgagcaaaagagtagctctcaggagacctgtcatgggtagctgctttctgcaggcagttcctcccgacaactgcagctctcagcagagaagagacccggagtgggtacctcctctctgcaggcaggtcattttgtcgagtgtgcagtcctcagtggagaggagacccaagtgggtagctcttacctgcaggcaggtcgtcctatcatctgccagagtctggctgagtttgcggtttttatgggcttcagaggggaggaagtgtgtgctgattggcccatgggtggccatgggtgggcctggaaaattcactgtaagttttcactccagtcagtggaactggcagcctggaccctaggcttcaggctatccctggcttgaaggtggggtttcagcagggacctgtccctttcctcccaggagcctgtctccctcccactgctgttcatggtgcccagactgttttagctgagggacgcctgcagtaccacgttgagtcaccctcagccctgcccttggcctccctcccacgttcatcagcgcccaaagtccagagggagctgaggtggcagggggctggtgtgtcagcatctcctcaagcacacacacacctggccaggtcatgtcagtgcccgggcttggccacagcttttctccaaagtcagagtgggcactgggaatggggagaggccaagcagtaggagcaggcacttctgagcatgtgggggaagagaggcatcctgggcccccgagagcataggaatgccctagtccacagctgggtggctgcaattgcacccaggagcatggggctccctccgcaccaactcggaagggagaagggctcctgcctgttcctgggtcccgctggctctgcagagcaagcaggtccggctgtgccttcccaactgcagccagcatctttgcagcagctgctccagatgggctgcagctgccatcactgggacttggtgccctgtgtcccagctgttccagtaccagttgtggctaaaaggggccaaggtacagttcagaccattgcctcagagggtgcaagccttggtggcttacacatggtgttgggcctaccagtgcacaaaagtcaagagttgaggtttggaaacctctgcctagatttcagaggatgtacagaaacacctggatatccaggcagaagtctgctgcaggggcgaagctctcatggagaacctctgctagggcagtgcaaaggggaaatgtgagatataagccgccacacagagtccccactggggcactccctaggggagctctgagaagaggaccatggtcctccagaccccagaatggtagatccaccaacagctttcatcatgcgcctgggaaacctgcagatactcaatgccagccatgaaagcaggtggtgtgtgggctgtaccctgcaaagccacaggggtggaactgcccaaggccatggcagtccaccctttggatcagcgtaccctgaatgagagacattgagtcaaaggagatctcacttgtgagctttatgacttaataactgtccttttgggtttcagactttcatgggacctgtagcccctttgttttggccaatttttcccatttggaatgggagcatttgtccaatgcctgtacacccattgtatcctggaagtaactaacttgcttttgattctccaggcccctaggcagaagggacttgctttgtctcagatgagactttggacttggacttttgagctaatgctgaaatgagttaagactttgggggactgtttggaagcatgattggttttgaaatgtgaggacatgagatttgggaggggccagggccacaatgatatggttaggttcaaatcttatcttgaattgtaatcccaaggtgttgagggagagacctggtgggaggccattgaatcacaggggtagattttccccatgctgttcttgtgatagcgaattctcataagatctgatggttttgtaaggcagtatccctgctcttgctctctctcacctgccaccacgtaacacagatctgcttccccttctgccatgattgtaagtttcttgaggactccctagccatgtggaactgtgagtcacttaaatctcttttctttataaattacccagcctcaggtaattttctttatagcagtgtgaaaatggactaatacatactcataaagtgcttttaagataattgctttgatatacagcatgagaacctcaggcattaatgaagaatggtcgcatttaatgtagaaaattgctgataattcagcttgtaaatagataccaactaggtttccatgaacatactgactcagctagtgtttaatagctcctgttatttgtcagtcacagtgttaattcactaaataagaatatagtcttactcttagtgctgtattcaaaatttttattgacatgatctacttttaggatttcaccgaagtcctaaatcagtgcactggtgatggagattcgaatgatggctttataatttttgataaaatatcatggtcccctaatattttacataatttttctcttcatttttgccttttactatctcatgttccttcagttctgggttatgggtgttgagggcagttgatggtatcaaattttattggggaaaagaaatttaaaatttagaaaatcattttcttaattctttttggaaaaataaacacatgtacttattcaggaggtataagaatgttaatatatttacccactaagagcctttaacttggactattttactctcaaggttaccattaagaatatcgaaagggagctcatttgcccagcatgcaaggagctgtttacccacccattgattctcccttgccaacatagtatctgtcataaatgtgtaaaagaactcctgctgactctcgatgattcattcaacgatgtgggatcagacaactccaatcaaagcagtcctcgacttcggctcccctcccctagtatggataaaattgaccgaattaacagaccaggtatgtgttagaactgtgggctgggatggtagtgggggtaagcttatagatatatattcagtggtaactggaaggaaaattatttttgtcatcttgagagttaatttttccaggtgaataaattaaaactgtagttataaaggggcctcccccactgttaaaatgtcaaaatgaactctcgtcttttgatacatacttgaagtagatattggatattgaacatgaactttgtgttaaactccttattaactgtgtttgtaagtctgggcacagtggctcacacctgtaatcccagcactttgggaggccatgtcgggtggatcacctgaggtcatgagttcaagaccagcctgaccaacatggagaaactccatctctactaaaaatacaaaatgagctaggtgtggtgacgcgtgcctgtaaccccagctacctgggagtctgagtcaggagaattgcttgaacctgggaggcggaggttgcagtgagccgagatcgcgccattgcactccagcctgggcaacaagagtgaaactctgtctcaaaaaaaaaaaaaaagctatgtttgtctttaggaattattctgactgtgcaatgtacttgatacatagaataatggactactgaaatactaactaggaaaacattcatatatggtaataggaaaataaatactgcagagttaaggagtgggactacctaatggctagtcatcacctttatgtttcctcccttgctgccaatctggcgcactgaggagggaaagacagcatcccttgaaatcagtcctactagataaaacttgatattctgctggtagaacttcattggctaattgggaacccatgcttgattgaccaaagaaaactttttgtatgttaatatttagcaaaaacaaataaaattttagttatgtactagatatttctacttataattagattgcacttatatacatatttcacaaaattctgtaggcttttaatgttaagatttggctagttttttatgtgattcatatgaagaacaagatgaatgattttctgttttcaggaatttacctgacatggtactctgtagatgcttaataaatatttgttgaatggatgttgaatgagaaacctctgccacaggatttgtacagagagtgccacaatggcttatattcagtaataatggcatttgtcttttggaatatgagctccattacaccatacatttcactgtctagatccgaaatagcattactgggatgtttctccctcttctttaggaagaaccctacgaagttagattatgtcctgagaggggaaacttagaatggtggagtttgaaaacttttctctgtaaagaacagttacaggagatgagaaggggtgactgcagaatatgatagttttcttatggatagaatgagtatgctggatatctctagcagaggttccaggtcaatgagtagatggaataggaaggcagatttaacttagcatgaaagaagacacacgcgcacacacaccccactaaggctgtccagaaatgaaatgggctaagtatatcagacttctgccactaaatgtgtttacatcaggtgtcaaatttagatgctgcagggccaaacgggtgcattaatgaagagagccccaggcataataaatataggactctccttcattttagtttttcgctgtaaatatggagacaataaatatttgattttccctttagctcaactactgtaagaaaaccatcagcccaaagtgacagcagccaactgattttacgactccttattggagaagtagagtgtggtttgggactgtggagactgaaacggatgccttgttaaagggggcagtaaccacttggcagtgtcagggttgaagatgccagattgtcagatttattggtttttcacaaaaacttgatagtggtttccatgtgaaatctgttttttaaatattttcaattcagattatttaacaataccacaccagctcaatagggcaggacagccaaaacatgtctttggctgtgacccatgcagcatttgggccatcagtatctgaagactttgtttaaaacaatgggtgggtggccactgtctgcaatattgtggagggtgtttctgctgtgggtggtaggttgggccagttgttctgtcacatgccatatctccagcactgaagttctatgccttattaaataccagtggcattcattcattcattcaacaaatatttgagcacctgctggttaccagatatggctaaatggttaagaacaatgagcgagatagacccactttcttttctttttttttttaaagacacataccccttagcattgtgcaaagctttataacagctgtaattactagagcatagtcctttatcacgaacacacacagatcaagttaacaaagagagagcacccaaagggtgcgaatgctgtaagtatggaaatcattcctggaggttttaatgcaaattttaggattgtccttcaccagttttaaactagtagaagtcattgcagtgcaaatgtgatgttacttgccatctatttattgggcatttgcatataattctttttttggtagattcatgagtaatattcctttttttctgacagctttcttcttaagtttttatcctttagacatttatttgagacagggtctcactctgtttgttacctgggctggagtgcaatggcttgatcatagctcactgtaacctctaactctgaggctcaagtgatcctcctgcctcagcctcctacataccggagactagaggtgcatgctactcactcgcaccctgctaattaaaaaattttttttgtggagaagaaggtctcactttgttgcctaggctggtttcagactcctggcttcaagcagtctttgtgccttggccttccaaagtgctgggattacaggcgttattcactatacccagtctagttttgccactggtctaataaagggattaattaaacccggattgtccagtatggtagccactagccacatgtggctattaagtggttgaaatgtggctagtctgaattgagatatgctgtgagttaaaatacacagaataaaaaagactgtgaaatgatctttaataattgttatattgtttatattttgaaatcatagtattttggatatagtgggttaaataacattaaaattaatttcaatttttttaatatggctactggaaaatttaaacttacgtatattgtagttttggctcatacatttcttttggattattttgcattagatttttgacagttttttttaaagggtaccttgaaaggagagtaagatttgtgtgcataacacagtagcatattaaattatgtacaaataaaagccatattactgtatacttttgatcataaagtatacagtaagctttccccccagtttgtattttctggttgtctaaactgaatatgttcattttagttttttttttttcttttttttaacagttattaggtcagtaaaaagtcaaacaaaagatgtttgatttcactttgtatttgcaacatttaccttaagtatgattgtttaaaaatacaaatctatatagaacaaagtattgtctcttaagtgctatacccacaatgattgtaataagattgcttgatgtatgttttatgctcctggcttcataaatactatgtgtaccaggaaaaacacatttttactgttaattcaataattgtattattttcaggacacagttaccgctttctcttttgttaacaagttgtgaatcttctctttgaaattaaattctaaatccagctttctgttcattgttcacagcatcacaacggagatctgtggggtggagaggtagaaaatgttttattgcttttgtggccgcaggcaatatagtgttagatttaaattaaataatcttgtgtaagattcttaaacatcagtggtcaagtcttcaaaattgtgtagagagtgaacaaattgggctgaaacgacttaaaggtcaacaggactaaatttccaagcaagttctgatgtttttaaaagaaaacactgattattggtgcttgcattttgtcaatatacatgacaagatatttttgaagaaaatgatttataccgcttttgttttttgtatatgatatcttaaaacatcctttacatttacttagtgaacaaagcttgatattgctacatttaaaggttaaataagctaatgctttcttatgtattgaaaaatttgattaaaggtattgattatttttctatttaatgatatctttgctcgttttatacatatagagtcttttctttgttgatgttttaaagtacttggcatcagagttttagcattgaggtcttacccacttgtgggtaaatgtacactcctttattagactttctgaaatatttgattctatgtaaaagatggggcaacctatcttattaaaatttatttttactccagttgacctttaaaaataacattgactgctttttaatggaatgctggtgataccaccatctatttcatgggagaatacttaacacctgaaatttatcccctttctgtctttctctctttcttctgcatttcttgatttaaaaatcttaaagccacgattagaagccacgtgtaattctttttcttacaggtttttgagaatataaattttaagtgttgaaatttagtaattagaaggaaagataggagcagtttgctttaaaaaagctactacccatttttggttcagagggtagttgagagaaataaattttacagggtgaagaatgctgatataatacccaaaaggtaaatataactcataggcatcaaatagtcagaatgtaccaaaagaagcattaaggtggcagcataagatatcaggccactgccaaacagcaaaagcccaacagtagtgtccaccattgggagaggtagttcatgaactgtccagggatagcgatggggaagtcgcagccagaatacgggagaggatgcaaccggcagaggtttggaacctgttagttatgaactgactctcttctctttgttttgaaatactttattttctctttgatatttaaatggttaaacaaatgactgaaagctgacttttttaggggatttgctataaaccaatttgaaattttttagagtctttattttaaaattatgctgactttttaatctaccttcaaaggaaagatttgtgggaaaaagaagagattctgtaaggtgctagtatataatttgcaaatattattgtccccacagattcagtttgatgtataaaattgcatttcttggtctacattacttccttacctttccaagccatcattacttttctttctttcatttttaaaattttttttatttccatagtttattggggtacagatggtgtttggttacatgagtaagttcttcagtggtgatttgtgagattttggtgcacccataacccgagcagtatccactgcaccctatttgtagtcttttgtccctcacccgcttcccaccctttctgcctgagtccccagagtccattgtgttattcttatgcctttgcatcctcatagcttagctcccacttatgagtgagaccatatgatgtttggttttccattcctgagttacttcactaagaataatagtctccagtctcatcgaggtcactgtgaatgccattaattcattccattttatggctgagtagtattccgtcgtgtatatataccacagtttcttctcaattcataggcatttgggttttttccacgtttttgcaactgctacttgtgctgccataaacatatgtgtgcaagtatctttttttgtataatgactgcttttcctctgggtagatacccgctagtgggactgctggatcaaatggtagttccacttttagtacttttttttttgagatagagtttcgctgttgtcgctcaggctggagtgcaatggcgtgatcttggctcactggaacctccgcccaccaggttcaagcaattctcctgcctcagccccctaagtagctgggattacaagtgagcaccaccacatctggctaatttttctatttttactagagacgggggtttcaccatgtcagtcaggctggtctcgaactgttgacctcaggtgatccacccaccccagcctcccaaaatgttgggattacaggtgtgagccactgtgcctggcctctacttttagttctttaaggaatctccacactcttttctgtagtggctgtactagtttacattcccaccagcagagtggaagtgttccttgttcactgcatccacgccaacatctactgttttttttttttttattatggccattcttgcaggagtaaggtggtatcacattgtggttttgatttgcatctccttgatcatatagtaatactgagcattttgaaatatgtttgttgaccacttgtatgtcttcttttgagaattgtctattcatgtccttagcccactttttgatgggattgttttttcttattgatttatttgagttcattgtagattctggatgttagtcctttgtcagatgtatagattttgaagattttttcccactctgtgggttgtctgtttactctgctgactattccttttgccatggaaaagctctttagtttaattaagtcccagcaatttgtctttgtttttattgcatttgcttttggcttcttggtcatgaactccttgcctaagccaaagtccacaatggttttttcagtgttatcttctagaatttttatagtttcaggtcttaggtttaagtctttaatccatcttgagttgatttttgtataaggtgagagatgacgatccagtttcattctcctacatgtggctagccaattatcccagcaccatttcttgaaaaggatgtcctttacccacttttctgtttttgtttgctttgctgaagatcagttggctgtaagtatttgggttatttctgggttctctattctgttccattggtctatgtgcctatttttataccagtaccatactgtttcagtgactatggccttacagtatagtttgaaattaggcaatgtgatgccttcagatttgttctttttgcttattagtcttgctttggctatgcgggctcttttttggttccatatgaattttagaattttttttttttaatttgtgatgaatgatggtggtattttgatggggactgcatggaatttgtagattgctcatggcagtatggtcattttcacaatattgattctacctatccgtgagcatgggatgtgtttccattttttcatgtcttctatgatttctttcagcagtgttttgtagttttctttgtagaagtccttcacttccttggttgagtatattcctaagttttttggttttggggttttttttgcagctattgtaaaagtggttgagttattgatttgattctcagcttggtcgctgttggtgtacagaagagctactgatttgtgtacattagtattgtatcctgaaactttgctgaatttttttatctgttttaggagctttctggaggaggctttagggttttcgaggtaaaaaatcatgtcatcagcaaacagtgatagtttgacttcctttttaccgatttggttgccatttatgtctgattgctctggctaggacttccagtactatattgaagaagggtggtaagagtgggcatccttgtcttgttccagttatcagaagaaatgctttcaactcttccccattcactattatgttggctgtgggtttgtcatagatgggttttattatattgaggtatgttccttgtatgctgattttgctgagagttttaatcataaagggatgctagattttgtcaaatgcttttttagcatctattgagatgagcatgtgatttttgtttttaattctgtttatgtggtgtatcacatttattgacttgcatatgttaaaccatccctgcatccctggtatgaaacccacttgatcatggtggattatctttttgatatgttgttggatttagttagctagtattttgttaaggattttagcttctgtgttcatcagggatattggtccgtagtttatttttatttttatttttgagacggagtttcgctctttgttgcccaggctgaagtgcagtggtgcgatctcggctcactgcaacctgtgcctccctggttcaagcgattctcctgtctcagcctcctgagtagctgagattacaggttcacgccaccacacctggctaattatttttttaaacagtgttttgctcttgttgcccaggctgaagtgcaacagcacgatcttggctcaccacaacctccgcctcccaggttcaggcgattcttctgcctcagcctcccgagtagctgggattacaagcatgcaccaccatgcccggctaatttttttttttttgtatttttagtagagacgaggtttcttccttgttggtcaggctggtgtccaactcctgacctcaggggatctgcctgcctcagccttccaaagtgctgggattacaatcgtgagccaccacgcccagcctggtctgtagttttcttttgttatgtcctttcctggttttggtattagggtgatactggcttcacagaatgagttagggagggttcctctttctctatctcatggaatagtgtcaatatgattagtaccaattgttctttgaatgtctggtcgaattctgctgtgaatccatctggtcctggactttttttgttgataatttttaaattaccatttcaatcttggtgcttgttactagtctgttcagagtatctaattcttcctaatttaagctatgaaggttgtatctttccaataatttatctgtctcttctaggttttctggtttatgcatgtaaaggtagtcacagcagccttgaatgatcttttgtatttctgtggtgtcagttgtagtatctcctgattcatttcttattgagcttatttggattttctctcttcttagttaattttgctaatggtgtatcaattttattaatcttcgaagaatcagctttttgtttgatttatcttttgtgggttttttttttcatttgtttcaatttcatttagttctgctctgatcttgcttatttcctttcttctgctaggtttgggtttggtttgttcttgcttttctggtttctagaggggtatccttagattgtctcttggtgctctttcagactttttcatgtaggcgtttagggctgtgaactttcgtcttagcactgcctttgctgtgttccagaggttttgataggttgtgtcactattgtcatgcagcttgaagaatttttaaatttcatcttaatttcattttttttttgaccctgtgctcattcaggagcaggttatttaatttccatgtatttgcatggttttgaagtttccttgtggagttgatttccagttttattccactgtggtctgagagagtgcttgatataatttcaatatttttaaatttattgaggctcattttgtggcctatcatatggtctgtcttggagaaagttccatgtgctgttgaatagaatgtatattctgtggttgttggatggaatgttgtgcatgtaactgttaggtccatttgttccaaggaatagtttaaatccattgtttctggccgggtatggtggcccggcactttgggaggccaaggtgggaggatcacctgaggtcaggagttcgagaccagcctggacaacatggtgaaaccctgtctctgctaaaagtacaaaaattagctgggcctggtggcacccacctgtaatcccagctactcgggaggctgaggcaggagaatctcttgaacccacgaggtagagattgcagtgagctgagatcatgccactgcactccagcctgggtgacagagcatgactccatctcaaagaaaaaaaaattcattgtttctttgttggctttctctcttgatgacctgtgtagggctgtcagtggtgtattgatacctcccagtattactgtgttgctgtctatctcatttcttaggtctgttagtaattgttttataaatttgggagcccctgtgttaggtatatatatgtttaggattgtgatattttcctgttggacaaggccttttatcattatttaatgtccttctttgtctttttaaattggtttgctttaaagtttgttttgtctgatataagaatacctactcctgctggcttttggtgtccattcacatgaaatgtctttttccacccctttaccttaagtttttgtgaatccttatgtgttaggtgagtctcttgaaggcagcagatagttggttggtgaagtcttacttattctgcaattctttgtctttttttaagtggagcatttaagccatttacattcagttggtattgagatatgaggtaccatttcattcactgtgctatttttttgcctgtgtaccttgttttttgttgttgttgttgttttttaaatcttatttttgttttataggtcctgtgtgttttatgctttaaagaggttctgttttgatgcgtttccaggatttgtttcaagatttagagctccttttagcagttcttttagaggaggcttggtagtggtgacttctctcagcatttgtttgtctgaaaaagactcttacctttccttcacaagtgaagcttagttttgctgcgtataaaattcttggctgataatttttttttaggaggctgaagatagggccccaatcccttctagcctgtagggtttctgctgagaaatctgctgttaatctgataggttttccctaggttacctggtacttttgtgtcacagctcttaagattctttcctttgtcttaactggtaacctgacgacagtgttcctgggcagtgatctttttgcgatgaatttcccaggtgttctttgtgctttttgtatttcgatatctaggtctctagcaaggctggggtagttttcctcgattattcccccaaatatgttttccaaacttttagatttctcttcttcctcaggaacactgattattcttagggtgggtcatttaacgtaatcccaggcttcttggaggctttgttcatattttcttattctttcttctttgtctttgttggattgggttagttcgaagactttgtcttcgagctctgaatttctttcttctacttgttcaattctgttactaagactttccagagcattttgcatttctattagtgtgtccagtatttcctgaagttttcattgttttttatttatgctatctatttccttgaacatttcttccttcacttcttgtatcattttttggattgccttacatcggtctttgcctttttctggtgtctcctcgattagcttagtaaccttctggattctttttcaggtaaatcaaggatttcttcttgtttgggtcccttgctggtgagctagtgtgatttttgctggtgttaaccttgttttgtcatattaccagaggtggtttcctagttccttcccatttcggtaggctctgtcagaggaaatgttagggctcaaggttgctgttcagttccttttgtcccacgggttgtttttgatgtggtactcttccccatttcctatggatgtgccttcctgggagtcgagttgtagtgattgttctctcttctggatctatccacccagcaagtataccaggctctgggctggtattgggtgttgtctgcccacagtcctgtgatgtgaaccatctttgggtctttcagccatggataccaccagcacctgttctgatggaggtggcaggcagtgaaatggactctttgaggcttcttagctttggtggtttaatgcactatttttgtgctggttggcttcctgccaggaggtggcactttccaaagagcatcaactgtggtggtagggggaggaacaggcagtgggcagggccctagaactcccaagattatatgccctttgtcttcagttaccagggtaggtagggaaagacccctgggtgggggcagggcgaggcgtgtctgagctcagactctccttgagcagctcttgctgcagctgctgcggggattgggggatgaggtttccaggtcaatggagttatgttcctaggaggattatggccacctctgctgtgtcatgcaggttgtcagcgaagtgaaggaaagccggcagtcacaggcctcacccagctcccacacagtccaaagggccagtcccacttccactgtacccccaacaacagtaccaagtttgtttccaggcagtgggtgagcagggctgagaacttgccccagtctacccgcctcccagctgcaaaagcaagtatggctttccttctcccacctgtggagtctgcacactggatttacaccctcccccaagttgtggccaggaggcttctccatcagttcaaattgttacaaactttagctggaggtttccttctccctgtggccttttcccagagcctctggccgttctccggaaggacccctgtgaggccaggcaaaaacgacttgatgggggcccagtgagcttccaggggttttcccactgcttcctctacccttgtatttcactcagctctctaaattgactcagctccaggtaaggtcaaaatctcccgttatccaggtcttcagtttccccagtggaggtgtgttcaggggcagacaatctccctttcccagttccacagtttgggccctcgcagtatttagcgtgtctcccaggtcctgtaggagcagtctgcttccttcagggggcctgtgggtcctctcagctttcctatttctgtagtcgttctggagcaaaatttcacagtgctagcatccacatgctgctctgtcagagctgcaatctagtccttcctctagttatagtccttcaatctagtttgtgatgatccctctgtttttctttttcattgtctaatgcaattgagcaatactatgcaatagaactttctactataatggaaatgttcaaccctgtgtcatataatatggtagccattagctacatgtgtctcttgagaatttgaaatatggctatggtaaccaaataagtgaatattaaattttacttaattttaattaaattttaaaagtcacatgtggctaatggctactgtatcagatgacacagccatggaaagtagaaagttgactcttccattttgttcttaattccattgccttgattttttcattaaggatattacttcccagaatatcctaagattctcattttctttattgctctgaacatctactgtttgtttttatgaaaacaatgaaagaaatataagacagatgaaataaaagttctttagcatttgtaagaaatatttaagcacattgggccaggcacggtggctgaagcctgtaatcccagcactttgggaggccgaggcaggtggatcacgaggtcaggagatcgagaccatcctggctaacatggtgaaaccccatctctactaaaaaatacaaaaaattagccgggcgtggtggcaggcacctgtagtcccagctactcgggaggctgaggcaggagaatggcgtgaacccgggaggcggagcttgcagtgagccgagatcgcgccactgcactccagcctggacgacagagcgagactccatctcaaaaaaaaagagctttcaagatctgtttagaaagatagccaagatatctatttggacgagttgtgaaaaattacatgtcttaatttaatgtctgatttaagtttagtgtttcacacctttttttttttttttttacactgtaaaaacacagtagcagaggtaaacagaaaagggatgaactttttttttttttttttttttttttttcaaatttctgaggacccaattctgggtgtcaccagcatacatgttaaagcttgattttgttgtcattatttacttttcattatcccgttactttaattggtcataatcttcataaaaccaaaaataactcatttttttaacacttttgagattagttttctatttatctaaattttcatcacctatttcatgtgtggaaacctgcgattatatatgaatttctatttgtttaaacttgaccactgcaccataccatctccagaattgtttggcttgttttctttcctaaatgaaattttcattggcatgtgatttaaaagtagctttgctgcttatttcatgatatgcctgctgtggtgtgaaagagtttggattgtattgcatgcttttagaattattatctgaatatattttaggattttcaaatttttatggggcaacttttttgtatgcattaatgtttaaaaatgtaaacgttaaaatatctttaaatgaagatattaaaaatattctgcatgtttgttgtataagtagattttggggcccaatgccatatagcatgctattaacatcacttccaataagtattattatgggctgattgctaaattttacctgaactgatatcatgtcagacatcttttaagatattcttttgagtgatgacagttatatgcaaagggtatattgatgtagctgtttaaagaccttttgtaatgtggtataccaaattcagccattcatttttggtattggatacatgatagtatgaaagaaggtgtaggttaagaagtttgtgtttaagttaagggagttatttttggggcaactaagactgcatactcttaagaacagatttacggccgggcgcggtggctcacgcctgtaatcccagcactttgggaagccaagacaggtggatcacgaggtcaggagttcaagaccagcctggccaagatggtgaaaccccatctctactaaaaatataaaaattagctaggtgtggtggtgggcgcctgtaatcccagctacttggcaggctgaagcagagaattgcttgaacctgggaggcagaggttgcagtgagccgagatcacactccagcctaggtgacagagtgagactccatctaaaaaaaaaaaaaaaaaaaaaaagaacagatttacaaatgagggaatgtgatatgcatgcacctgtcgtaaatggacaaccctggattcctgtgaaccaatgggtaaggactgtcatgcattggtttcttgatttattaaaattgggataatactgaacaaaaatgtgatgtttaaggtcattcattgttttatatatgttgtaaaattatttgtagtgtttttggggtaacttttggcttactgagttaagtaatcttaatgattctttgtttcaggtcataagaagttattaaatggttggtccctcttaaaaatcactaaattataggtctatgaatgaatttttcactcttctatagattgcactcaattaactaatgatcttccctactgaatttttccagataaaacaatactacgtgggaaagcttctattgtagtgttgttaaaaattttgtggtcacatcacatattcttttgaaaatctgataaaagctgtgggtttttaccagtaaatatgtatatgtatataggtggaatattttgtgcacaatttcaaatagttcatggatctgcctgggcctcttcatgggctttgtgctagggacccctgctcttttatgtatcgattcatttcctgtcagtcagcaaagactgttcttttaaatgtctttggatatggtgtataaaagtaactataaatgctaattatataattttaaaagatcttaacgccatgtagtattgtattacgtgttttatctttatatctatgtttgatttaatatggattctatgtgggtttactgtagaatattttcctttttgatttgctgtttgatttgataacttgggcttgtcttttgtatactaaggaaaaatttttaaaaacattttcacaatacaaatttcacgtggagccacttcggatactgtttttgtgatacatttgtagatatgtctctaagacatgactcctcttttcttcattctaatcattttcctactgctataactaaacaaagacttactaattacacaggctggaagcgcaattcattgaccccgaggacaactgttttcccttgccctggctgtgagcatgatgtggatcttggagaacgaggaatcaatggtctgtttcgaaacttcactttggaaactattgtggaaagatatcgtcaagcagctagggcagccacagccattatgtgtgacctttgtaaaccaccacctcaagaatccacaaaaagctgcatggactgtagtgcaagttactgcaatgaatgcttcaaaattcatcacccttggggtactataaaagctcaacatgagtatgttggtccaactactaacttcagacccaaggtaagtgaagtttttattaagttagaatgttattttaacttaatgttatgaaacttttatgtacttaatgttacgaaataaattattaagtctagaacttgacagaaaggaaataactttaaaagcaggtataagaacttaaggcctagttggctggagttacttactatggggctaaacatccccaccaaaggagggcaatattgtggtttattctattacaatccagtgtgatataatacaataaatgcatgtttgtaatgataactctgattaaagaaaggttatctcagatatactctttaagattgaaatggttaaagttaaaaagcttttttgtgctttagtgtcataaatccataattgcttaaaaggtttgactgcgaaacatatttttgttgcatttggctaaaattgtacaatgaataaaagtaattacagcctaatactttgtagtttgtgatataatggttatatgttatctggagtagaatttgcatttcttaaacattctgagtaatttctttaacattctgagtaatttctttaatattgctcaaaagaagtttatgtattgtttgccctgctgtgtgcctggaaagaaactgatcttttgatatcttcccttctttctgatgtatatagattttaaaaacctatggttgagtttttcaaagttcttactccttataacttagtgacttgtgtatgaaaatctacttgcatttttaagtgtaaaacctttaatttgtaataaaaaatggggaaaaaaatctcaaaagtgtttttgaaactgtgagctatttcttatattaaatagtaaaggattggtagattaaggcaaaaacaatctgtgctatcacattttgaatgacctttctcaaactgtgtcagtctggtagtagattcatcagatagcttttaatcctgtattatgttcctcattttaaatgctcaagaccatcaatttttaaaaatttgtgacttcaacctgatgtttctatttacaaatataataaaagattgataagagaacaccaaagaaacatggataggttatactgagaaacatttcatttttcaagtagttagtgctactcaatatagtaaaattctaaaacggtgtccaaaatggtataggcaaatgctatggaatatttgcctataacgttgagttcttttgatcatttcttgcagatggacaaactttgtattttattttaaatgtaatggctttggggatgtagaaacttggacatgctgaaaaacttgaaaccttttccagttgtttttctcctgaacctatatattggtattaggactttctgtattgtactttttgttcgttccttttaaatgtctataagttacaaaattagctgggcatggtggcacatgcctgtgatcccagcttcttgggaggctgaggcaggaaaattgcttgaacccaggaggtggaggttgcagtgagccaagattgcaccactgcactctagcctgggcgacagagcgagactctgtctcaaaaataaataaataaataaataaataaatgtctgtaagttatcagacaagttacaattgcttaaaatctaatctgttggaatctttaacaacttttgattttattaacatactaacttaaaggaatctcccctttctttcaaatgaaaacagttattttacataaaattttatgttatttgatagcttttaatcctctatgataatagtttacaaagtaaataaaaaggtagacaatgaaatcagaaaaacagttccaaatttggtcagtgcatttgtaattaatttgtaaaaggaaacacatctagaagcttataaagttttctgagactcttttagcaacagatttctgttactgaggccatgagtctcataaattgttatggtacttcattaaaaatattgactttgatcattaagaattgcttcatcagtgtggtcagatggcctttctaacttggttaagtgttcattccatttgaatctgataggaatgaaactctaacttaacaagttttggagaaataacatctatatattatgacgagatcaggcatgttcagaggggtatggccgtagacaacatctacgtattaatcatttgaaccctcaaattgaaaaatagtaattccgatatagagaattttcatgtgatgtatcaaccatttttctttttacattcatattcacttaaatggctttatttagtgattttataaggcaaatctttgtattttggtaatttgttagattacttgaaacctagatccttaatcacacttttattctttactcaatagattttaatgtgcccagaacatgaaacagagagaataaacatgtactgtgaattatgtaggaggccagtttgccatctgtgtaagttgggtggtaatcatgccaaccaccgtgtaaccactatgagcagtgcctacaaaaccttaaaggtaggacttatttttggaacagaattttgattcttcgtaactttactttatgcctttaacttttcatttataaaatcatggtgtgttatatggtctcttttgtactaaaatgagttaaagtgttacttagcgatctactaatattaggttgttagtatttctgatcaacaattatttgtggtactgataaggcccggcatatattgacacctatgttgtattagctctgaattctgagggaagagaaggatgaaggacacttcatcatgatacccaaatgagcccaatgtctatgataatggatgtatacataggattgacatactttaaagggttgtggctgttttaagacacttgattcttatttcttgcctgtagaattactattttgttcattctggtggcacacttaccatttaaaactgaattacttccgtggctcacacctgtaatcccagctctttgggaggccgaggcgggcggatcacgaggtcaggagatcgagaccatcctggctaacacggtgaaaccccatctctactaaaaatacaaaaaaaaaattagctgggcatggtggcgggcacctgtagtcccagctactcaagaggctgaggcaggagaatgctgtgaacccaggaggcggagcttgcagtgagctgagatcgcgccactgcactccagcctgggtgacagagtgagactctgtctcaaaaacaaacaaaaaaaaacctgaattacttcctttgtgttagttttattgatgatgtttaaaactttcaaatttcataatcaacaacaaaggcagcagtacactactatcttttcgttttattctttttccctttaaacaatatttttaaaagaaatcatctatgtacctactacccattttgtttctttcctctgtttaacagtatgtgtatgcatttttttgcctctgtctaattgcatatatgcaaacttttgtgttttgcattttatatttatgttgtgctctaccttctctgcacatacgaaatacaggtataattgtataattgttcttgcctactaattctctcatctgtttcactactaggtcagttttgatttttttttttaattaaagtttatatttctctgctaccttgcatgcctggtaatttttgattggctgccagctattggatagttttgtatttctacaaatgctattttctttgagtatgtgattaggttgcttggaaacgtttgggtcttttgtgaggcaggacagaacagcatttaattttaagggctaattttatctgactattgaagtaaaagcctttgattactcttttcaatgccctgtgaatttagagatttgtttttttttttttttttttttttttttgtctggctggtggggaacaggcactctttccagccttgtgtaagctcctgggattgtttccttgaacctgtagggtgattctttgcctgggcttggacagtttcctcacacacaagagttgatgaggactgctgaatatgtatgggagactgtttgtgtctctggagttctttctctttacaacagtctcttcttagatacataccttacaacctatggtacatgccttataacctatggcctccttggactcagctgcatctccctagggttcttggtttgccctcaggagactctgatatacactagtgtttgagaaccactgatccagaggaaagcttctgagcagttttgaagtccctgagaaattaacctctgattagttcctaaagaactggggtcctgatttatctaaaggagttaagaggtagccttgtctttttacattttaatcttcaatgcctattttcagtgtgtggtacatatactttttagagacctgtgaataaatggacatcctgattcttgcttaaaactgatctagtcttttaaaacaaactggctagatttgaggggactattatgactggagctgtctcagataaaagctattctcagataaacgtatagttggccagatactttgagcattaaaactcagagagtgtggtgcttttacatcatgtgtccgaattctgccatctattcttctctggtccttacctctttgagtcaactaacttatcttttcctatcttgtagttctaatgtaagctgctatcatacaactaagccttacttcaatttaaatggccaaatgtatcttattgctaccctagttaaaaaagagtaccaccactttgcacctagtacttctgatctccacataggcctgttagggatggtattattagaattgccattttactttcagcttggtgctgagacgtacctctcagcctgtggaatagtgtttagtgtttaatagtgccctcttgttgagcacccttttcgtttcaagtcatcggtggtaattgagcctgaaatgctcagattggcctttaagagctacagcttgaaaggtgttttctggatgttcttattcttatttagactctcaatacatttttctgttacaactttttaccccatggtgtttcggggcttttgtgttttggtttttgtgtatttcagagtaggttttctgggcaagatcagggatctcaccaaaacttaggatggtatttctgtgggaaagaaactatacttatttaaaaaggtcttccttacagacagattattcaaagagctctggaaattgcctatttttataaaactatattttcattattgtgtaattatttaataggctgggatgaactgtcaatattattttggaagtctctttgttgctactcctattgtgtataggtgtgtgtgtgtgtgcacgtgggtgtttgtgagagtaaattataaaatctgaagacaaaactatttgaattgctgttcttccatttacttagaagccttaggagcaggagctctaggaatgataatgaaacaataaaaatgtactgtttttatattcagaagttttgactaatttaaccattattaccttgttcttttttccaactgattttaatctttcatacatcctttggccctctgtgcctaaggccattaactgtttactccgggttaataatgataattgccatagttgattttattatgtttatcagaggctgtagaagaggatgagtcctgtgtaattaaaaaaaaattctgcaaagtctttgctaaactcccgttttgtctatttgtgttacgaatatgtttcaacaggaaaagctttcaaaggatattgattaccttattggtaaggaaagccaggtgaagagtcaaatatctgaactaaacttgttaatgaaagaaacagaggtaagtgataaactagcttgcatattttaaattattgttattttatctagacattcattcatttgttcataaaatcctgagagtattatatgagctgggaatacaaagttgtgttagatttcacccctgcttttctggggctatggaaacaaatgtaaaaaatgaattataatgttgtgtggtcacttctgtggtagagctagtgattaaatgatattggaacacagagggaaaaaatgactatttgtgtggcaactaacaagatctcaaaagtatttaatagtaacataagggaaatgataggttttacttatttttattatattttaaaaaattaatagatcacttttggaaaatgtgctgtatgcagattgggccaggtttattttaaattcccggtattcctgagtgtataccctatatatgttccccaaaagacatatattagaatgttggtggctgccttgtttgtaattgtcacaaagtgggatctacccacatgcccattaacagtagaataaaaatagcaataagaatgaatgatctgcagctgcacacagcaggtagattaatcttgcagtaatgtcgacaggaaggcgccagatacaaaggaatacatactatgtgattacatttctaaaaagtaccaaaaaaggtgaaactagatgatgatgttagagttgaggaggggggtaggttagtgtctggaaaggttatatggaggcttctgggatactggtaatgttcttttatctaatctggattttctgttggatgctggttatattgagtgtgtgggtaaagattcattagtctttatacttacatgtacatttttccatttgtgtattatgtttcaataaaaaattagaaaagataacagcattttaaaaataatagtaaaaggggattggattgggttgttttaaaagtccagatattcttcactgactttgttgtacacttgtttttcttctccatttgaaacaaagttgagccattactcctgatttttagtaattaaatataaaaatatcccagctagtatgacactgttacttgaagaagtttttttccaatataggttgaaattattgagaaatcacgaaaattaacaccactaccagcagtgcttttgtttttaatattattttcctgatctttactgattcaccaccctaagtcagtcatttttccatgcagtttggggttttctttttcatatttttgttggattaagtgacagactgtctcaacacaaagcagatgatcaccttagtaggttgcttcaaatgttgcatctttggtcattttattaatagccttgtttgttggtcctctcagtcctgctgctcttcacttctgaaatgaagacccagagtctgttttggggtttgtcatcaataggttaaaaattgaggaacttaggtgtcaagtattcatgtagacactgattccttgggatagtggggacattactgagttgttttgtatcatttgcctaagttgtatctgtagccttatcaataagaattttttttacgctagataacttgcctccattctcgacatttacttagtgatgatggtgacactgtcttttttatctgtaattttacttggctgaaaaaaatctatctataatgatatttctgagttggatgttgtgatttgtcagtgaaatactatcaaaatgtcactaccttctgctccttctcttttaaaaatatgtggctgtcggggttaggaaacaggagatctggaaaaaatttcctttcattataggtgttggctgaaagccaatggataatgcacagtacgcttctgccatatattgtcagcttttaagaatgttcttagccaggcttaatggctcacgcctgtaatctcagcactttgggaggccgaggcgggcggatcacaaggtcaggagttcgagaccagcctggccaacatggtaaaacccggtctgtactaaagatacaaaaaaattagcctggcctggtggtgcacacctgtaatcccagctactcgggaggctgaggcaggagaattgcttgaacccgggaggcagaggttgcagtgagccaagatcactccattgcactctagcctaggtgatagggcaagactccgtttcaaaaaaaaagaaaaaaaaaaagctgggtgcagtggctcacacctgtaatcccagcactttgagaggccgaggcaggcagatcatgaggtcaggagatcaagaccatcctggctaacacggtgaaaccccatctctactaaaaatacaaaaaaaaatttagtagggtgtggtggcgggcgcccgtagtcccagctactcgggaggctgaggcaggagaatggcgtgaaccttggaggcggagcttgcagtgagccgagatcgcgccactgcactacagcctgggcgacagagcgagactctgtctcaaaaaaaaagaatgttcttgaagactttttttctgttggctgctgtctgtgagtctgttataataagtgcttaggagtgtttgccagtcttctcaaaatcatgagctctgattttataggaattcagaatgtttaacaaacactagggtcattttatgacagtttgtatgaatgtttatttacagtatgtgacactgtggtatatactttatgtaaataaccttttaaaatctcttcacaaaaacctaaatggtttttcttatcccctattttcagaagagaaaaaacagaaagagaagtgaaatgattagcatatggtcacacagctaagtcaggatttaattataattatattaaagtgaagaggatacttttatttttatatcttagtaaagaatgtcatattttagagttttgtggctaaaaacttttttaggccaggcgcggtggctcatgcttgtaatcccaacactttgggaggccgaggcgggttgatcatgatgtcaggagatcaagaccatcctagctaacactgcgaaaccccatctctactaaaaatattgaaaaaaagctgggcgtggtggcatgtgcctgtagtcccagctacttgggaggctgaggcaggagaatcacctgaacccagaaggcggaggttacagtgagccaagatcgcaccactgcactccagtctgtgcgacagagcgagactctgtctcaaaaaaacaaaaacaactttttaaaaagttggagtagcgtagaaagggtgaaaacatttctgaatttgaaatgaattcaaagttctggaattgtgttttcctgtttttgtttaaatcagttcatttctccttcatattcctttatataccactgaaagattattctcttatttaattgactaaattgtttattgccagactttggagatgaaaagcttaaggaagtacaatattataaaattacaaagtaaatctgaataaaagttgtcagttgttctttgctaagtgtatttgatgccaaaatattgttctgaaaatttcagagttagataaaacttttttctttataatatctaggttggttttatcaaattttgataatgctgtcatcacatagatgaaatgtaattatgtagaactttgtggaaagccatttgggtttagcagaagaggctattctttgttttatcttagtgtaatggagatactgttttttcttagtgtaatggagagagggctaaagaagaagcaattacacattttgaaaagctctttgaagttctggaagagaggaaatcatctgttttgaaagcaattgactcctctaagaaactaagattagacaaatttcagactcaaatggaagagtaccagggacttctagagaacaatggacttgtgggatatgctcaagaagtgctaaaggagacagatcagtcttgctttgtgcagacagcaaagcagctccacctcaggtattctcttttacttctaactttagaacctattgagcaatgttattaaatgctgctgtgtattctcactttagctctgattggtccataatgctgtgttaatgtgaggtacatcttgcctcattcttaactttaattttgagtgaagtgtgggttttattttgttaatcatgttgcagatatttagtctgatttgacttcttaaagaaacatttttatataaaatatctgtctgcagaatacagaaagccacagaatctttgaagagctttagacctgcagctcagacttcttttgaagactatgttgttaatacctctaaacaaacagaacttcttggagaattatcctttttctctagtggtaagtcttaatgaaggcaaaaacctcattctttttgtctgaatttgtattgtgtggaagaaaacacaagttctcttaaatttgacattataaagcagcatctcacttgcccaggactatcacagcatcctgaaatcatatcctatttatgtttttaaaactatatttttatgcacaaaaactatgttccattagtttgtgtgtttttaaacattgcataaatagcattatgttgtatgtatttttgtaaattgctttttagaaaattaacataaatacttgtaaatatatgaaattttggtgtaaagcaatattttaactgtttacagtatttcataagtaaatcattttcctactaagagactttttttttccatttttttcctcttttatgagcaacgctgtgtcgcacatccttgtcagagttttttgggcaagtgtatgtgagtttcttggacagaagcctaggaatggaatctgcaggctgtttacattgctgtattagtttgcttgagctgcagtgacaaaagtaccatagactgagtgactcaaaacagattcattttgttacatttctggagcctacaagtcagagatcaaggtgttggcagggttggtttcttctgaacctctcttcttggttgataaatgataaatggctatcttctccttgtgtcttcacatggtcctctgtgtgtgtgtgagagagatctaatctcctctttttataaggacaccagtcatattggagtagggcccattctaatgacctgattttaatttaatttcctctttaaagaccctattttaaaatacagtcacattctgaggtacgtactgggggttaggacttcaacatgtgaatttccagtggcgaggggtggggtctgggggactggggaaggatgcaattcagtccataacacttgcttacgtttgtattttgctactccctagcagggaggtcttccttgcctttttttcttcttctcacctcattcctctccctaagatttctcttctagtgatggtgaacactacaaagatatatttatagtataattactttataggtgcagatttgtagatttgtacattaatacaaggaaatttgtcttgttaaaagtttaaaactctgaaggattactgtgacctccttttcaaatctatacctgaatctgatacttacttactatgaccgtcttattttttcaaatagatatttgtcatcacttaaaatgctgattgtatttcatacactatactgtgtttccaaaatgtatgcttgaatagtatatatacaaatagatatttgcttacttgtgagtcctaggtcctccctccctgtggatcccaaaatggttgctggaaaggtaaggttgagggtgggttatcctgggttataccactgtatagcaaggaaccaataaaacaggtggatgagaatgggatagtagtcacctagcttctggctgatggatcttcccctcattttttgctacatgcatttttttttttttagtaagctatgtttcaaaaaaagaaagaaaaagagtatggggtaggcgacatactatttgttaatctgtaactttttttttaaattttaaaatgtattttgaataactttccagatctcattatggctgcataacattcagttgtataaatgcagcatacacagaaatgcttatacattggggaataaggagaggaaagagacttctgcttcttattcatgtccttctctgtgatttgtcataaatgtgtgtgtgtagcttttatagcgtattgttcttagcatatgattccagcagttaagcttgggaattggctctatagaaaggactttgcatatgaataaagatttagaatcattttatttttagtgaaaaaccagaaacctgtttccaaaactaaacagttaaatgttgatatatccatgtaggtagtataccattgagggggaaaatactggcgagatctatacaaaaaggttatagtaattacctttgagttagttaaaatcttttaatgtgtatttttcagtttctgatttccttataaaaatatgtaccatgattttatttagaaaaattaatttgctttgcaactctacagaataaactatgcaaagaaatgataaaatattcattgagaggccgggcacagtggctcatgcctgtaatcccagcactttgggagaccaaggcaggcagatcatgaggtcaggagatcgagaacatcctggctaacacggtgaaaccctgtttctactaaaaatacaaaaaattagccaggtgtggtagcacgcacctgtaatcccagctacttgggaggctgaggcgggagaatcacttgaacctgggagacagaggttggagtgagctgagatcatgccagtgcactccagccttggcaacagagcaacactccatcttaaaaaaaaaaaattcattgagagtttgatattcttaccagacttagattttaaaatattaaaataatagtttgtttaggggaggacataggtaaaaaaatttcaagtcctgggctgttattcagtaggtagaaggcatgtggttaaaaaaaatttacttgtggctttgagtcagtttttgtcttttttactcttctttctcctttcagttacaaatatagatataccttttaaatataaaaaatatttaatatatttaatttttgtgctttctatatatagtattataaatttagaaaagtattagtatagaaatcattaaatactgtttatatgtcattttattgaggaaaaacactggttttcaaatgtcaatattttaatgttgttttctatttcataattctttcaggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccaggtatggtgaatatcaggaataaaaaaagcatagagttagttgcaagagaccttgataaaataaactagtcagtatctccatgtagacctgcactgaaaccagctcttgtttttaaaagactccagaaaagtagcttctatcccagctgggctttagaaatgaactgagtacttgaatttttaccttgtaggctgagaacaggattgggttttaactgatgtcagatagagaaaaacatggaaggaagaaatttgggtgagcagagctagtaagttgggatttaaatagcataaatgctattttaaaagttttaaatatataattctgtatttttggtttatggaaatctctaaaacataatttttaaaatttattggtctaatatcctaaaatataattttgatttaacctaattctgatttgtctggatttttttatctaactaggcacttctcagataatagggatggaagccatatattagaaccacatgaatagcttttcctcccacgctaaaagctccttatgcccagtcatcgccccctcccttcccaagttaaaaaccactgatactacatatagagcgcctaaagatttttatagaatgtgaatgactttaaaggttcgttgatgttcactatgatgtctccatgaacaagggatatttagaaccaaaattgtgctcagcctggttagcaggaaaacgttttcccctttcagtcactgcctcagagatgcctttaattggattttaggtccactgtcccttgcctctttttagtgtcttatgtacccatattttcttcactctcccctttcttccttttttgttcaaaatagaaaagcacaatttgtttttcatgcacattgtagcttttaaaaaattggaatacaaacatggaagattggctaaaattatatttcttaaattttaatcaaatccaatagagagttttgggatgaatttgcaggtattaagtaactattttatggtttatgctatttctgcttccttttctagtctttctgcctgaaagtggaagaaaaacctggacataactgctgttttcagtcacatagtggaggggaagggaggagaggaagtgttaacagttgtcttcctttttatgagagaagatacgtgactagggtgaccctttaaatttattttgcaaactgggagacttttgagattgagagcaagcacaaataatcatgccaggaaaagaggcattagcaggaagaatggtcagctcacacgtgggtaatggctgtagtttgctagcagtctttttttttttttttttttctttttggaggtggagtctggctctgtcacccaggctggagtacagtggcaccatctcagctcactagctcactgcaacctctgtctcctgggttcaagcaatttttctgcctcagcttcctgagtagtagctgggattacagatgcagaccagcatgcctggctaatttttgtatttttagtagagccaggtttcaccatgttggccaggctggtgtcacactcctgacctcaagtgatccacccacctcggcctcccaaagtgctggaattatagacgtgagccaccaggcccagctgctagcagcctgtttaaaatatatatatatatgtatatatatatatacacacacacacacacacacatagagagagagagagagatggggtctcactatgttgcctttgctggcctcaaactcctgaactcaagtaatcctcctatctcccatgtagctaggactaaaggtgtgcactatgatgcctgggggtcattttttaaattgtggtgtaataaagataaaatgtattatcttaacagtttttaagtatacagctcattggcattaagtacatttacagtattgtttaaatatcaccacttttacctccttaactttcattattctaaactgaaaccctgtacccattaaacagttactcctatttcccctctccccagaggctggtaactttgattctaatttctgtctctatgaatgtgcctattctaggtatctcatataactggaataatgcaatatttgtccttttacatctggcttatttatccatgttgtagcatgtatcgaaatttatccatacatgtagcatgtatcatacatgttgtagcatgtatccaaatgtatgtatccaaatttatccatgttgtagcatgtatccaaatctttcctttttaaggctgaataatattccattgtatgtatataccacattttctttactcatctgttgatggactttctgttgtttccccattggctagcagccaatgttatgcttaatatatttgagttgatacagacttatgggagtggtatcatcattctgcagatgaataaattaaagtttagatgaaactctagttgaatgcttgagtaggattcaaacccaggtctctctcaacccaaaagctgtgtttttgtttttgtttttttacagtgtcccatgtttcttatgtctgccatgttggttgatacagaaaaagctttattaaaatagctaaaatgacccaaattaacaaaactttcaataagaaaatgtagaactatttatgaaaatttacaactctttattattttttatctttaataaagataaaagaacaaattcaatagtgtgaaatacctgtgatagatttgctatctgtattccaaagagctgtttttataaattttcacatatatttaaaatatttacatctgctttatgagatttctgaagatttttaggtagacaatatactggataagatatattgctaagttgggttttggtttgtcatagttgtccggggtagtgtgacacctccttcccgcttcctgtctctcttcagtaatttctgtaagaaaacctatcagatttaacaaactagagcaatgataatttttagcctgatattaattttaagctccatttagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaaggtaggtttttgtattgatctagaacttgataattttttaaaagtaagcctgaaaatagatttggctttgttacatttggagtatacatttcttatttcttagattctagtattttggctgtggcttgattgagaaaaggagccgggtattcttgtaatcacacattgaataaggagagttagcagttactttttaatatcatgaggaaatccattttggatatctcttaattgtgatatagcttcacagttttaaattttgaaagtctttaacatgttacctatgtcataaaaattacccacgtatataatacaatgcgtctgattgtcatacttcacagttaagttgttcttttcttatgggacacagtttctttaaactttcccataagtccttttcaaaattgggtcatggtagacatatttccgcagcaaagacttccagtttcttaagagattgactaatgaagattgtacagttcagttcttttagatggaataaggtcaactagctttgaaaaataatttttgaccactcatgtgaacagtatcccagcttaacaatctgaatgataggaaaagctttcttcagaaagataaaaaatttatataatgctgaaaattttaacagtaaaacatagtgacatgtccacttgatagaaaattagtattaatgtttaaaaagttcataacatgagaaatactagaagtggagaaacctagtaaacgttgttgatgcagtattatccaaaatatataaaaagcaacataggcatattgaaaaaaatggggaacatgtttcaaaattttatataagttttttattgttttatgataaaggtgaaaaagcttcataatctttgtttgcttcatacatccatgatgaaatcccaaccaggaaatagagttcttaggatgagaatgaaacatgcttttttctcttgcattattttacagtgctcatatatttcacttagcctggtaatccttggtttagggcatacatcttatctttgtattttcttttcttttttgagacggagttttgctcttgttgaccaggctggagtgcaatggcgcgatcttggctcaccgcaacctctgcctcccgggttcaagcgattcttctgcctcagcctcccaaatagctgggattataggcatgcaccaccacacccggctaattttttttagtagagatggggtttctccatgttggtcaggctggtctcgaattcccgacctcaggtgatccacctgcctcagcctcccaaagtgctgggattacaggcgtgagccaccgcacctggcctgtagtttcttatacatttatgtattagcttagcaacaggaatatgttctgagaaatatattgcaaggcaatttcattgttgcgagaacatcatagagtgttcttacacaaacttagatggaatagtctcctacacccttagggtatgtggaacagtctttggtcctagaatacaaacctgtacagcatgtactgtaatactgtaggcaattttaatgcaacagtaagtatttgtgtatctaaacatagaaaaggtacaataaaaataagttataaaagataaaaaattgtatacttctatagggtacttaccatgaatggagcttgcaggactggaagttctctgggtgcatccatgagtgaatttgaaggcctaggacattgctgcacactactgtaaactttacaaacacactatacacttaggctgcactaaatttatttaaatgtattcttctttaagaaattaaccttagttttataaactttcaattttttttttttttttttttttttttttttgagacggagtctcgctctgtcgcccaggccggactgcggactgcagtggcgcaatctcagctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggcctaaactttcaatttttaaaaaaactttttaactctcttgtaggaacacttagcttaaaacacaaacacattgtacatctatatacatttttttttttttttgagatggagtttcgcttttgttgcccaggctggagtacaatggcatgaactcggctcaccacaacctccacctcctgggttcaagcaattctcctgcctcagcctcccgactagctgggattacaggcatgcgccaccacacccagctaattttgtatttttagtagagatgaaatttccccatgttggtcaggctggtcccgacctcaggtgatccgccctcctcagcctcccaaagtgctgggattacagacgtgagctaccactcctggccccccccaattttttttatagccttgttctacaagtttttttttttaattttttaaatttttaacattttaagcatttttgttaaaaatgaagacacaaacataatagcctatccagggtcaacatcatcaatatcatcgtcttccacttccacgtcttgtcccactggaaggtcttctggggcagtaacatacatggagctgtcatttcctaggataacagtgctgccttctggaaaacctccttaaagggcctgcctgaggctgttttacagttaacatttttttaaataagtagaaggagtaagtctacaataacaataaaagcattgcataataaatacatgagccagtaacagtcacttattaaatattacataatgtacataattgtatgtgttacacttttatgtaacaactttaagcactgtttacaccagtatcaccacaaacatgtaatgggttacactacagccttacagtggctaccacgtcactaagctataggaatgaatgaatgaatgaatttatttatttaagacagggtctcgctctgttgccaggactgcagtgcagtggtgctatctcggtccactgcaacttctgcttcctgggttcaagtgattcttatgcctcagcctcccaagtagctgagactacaagcgtacaccaccatgcctggctaatttttggatttttagtagagatatggttttgtcatgttggccaggttggtctggaactcctggcctcaagtggtcctcctgccttggcctcccagagtgctgggattacaggcatgagccactgcacccaactgaaatattttagtttcattatagtcttacgggaccactgtggtatatgaggtctgttgttcactgaaatgttctgtggtacatgattgtacatgattgtgtgctataaaaatttaacatttgaccagttatcactgcccgctccctcactttttggaaggctaaaattatcaatgattttctagggtttcacttctgtatataactaaagcagtgtttaatgacagggaatttggggctgagtctgtggtataattctaaattgtaatgtgtcatttttatgtttttgattttgttttaatagaaagcttttgatgtaaaaactattttaactttacatcaatgtatattatcctgtgaaaatgttttgaagatacttagatctattgttgaagatacagatgctttgtattatgtttcagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtagatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatgatgtagacatttttaaatgtgaagctttaacaggaataggatagctgtttcaaaccttgtgcaattgtaaataaattgtttagctgtgtttctttcatttttaataaaaaattaaaaag

SEQ ID NO: 38558 - DNA, 36788 bp, Homo sapiens
gtgcgactagcggcggccggcgaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggtaagtggggagaggaaagcaatgccccagagacccgacgccttagcccgccaccctgagacctagcacaaggagcgttcacgcccgaagggtcatccgagatgggggctcgaggcacgcgcccccaaatcttcaaggcccaagaagcttctcaagggcgccctatccgtaggagctgagggcatgaggggcaggagcaggtttccctcgtttttttttttttattgttgttgttgtttgtttgtttgtttgtttttaatttagctgctttcgaagctgggcggcccggagagatgtgaggaggtggacagacagcgcaagggcggggaagacctgggacccgggagctcggggtgcagtggggtctggggagccgcggagcctttatcccggacttagcctggacacttactttgcccgcctgccaagagggctgttgcctccctttccaggttcatgccctccgcccgccgctagggaaagtctgcgggactggggttttgcagagggcgtctgcgtgtagggcgaaaagctagaggtccaggcagcgcacgagttcttggtgggcgtctgggagctgcgcagccggggccgggagttcggttggcccgacccccaaccgctctggctcctcatttgtcctctgcgtggtaggcgagcatcgttatagaaacttccttgggctgagcgaggtggcctgggaccggctcatactttcttccggagagcagagcggccaccgaggtgacgccccctacggccccagccaggagactcggcttcgtgccctcgtcctgtctgtgcgtgagttggggttcgctctcacccgcgctacctttctaactgagcggagtcgccgcggccccgataacctaggagtccgaacgagtgattgcaggtcccagctgttttcttggaggcactttgcaaactgctgaatttggagtgcggtttcgttgcattgtgcgctctcggttcacctttctgcccgcaccctatcccaggcccaggcgtgagagctcccggcagttccccggacccgccccgcatcagctcctcggagtttgccgcgggcacctctacgctgtctctgagctgtccctccggccaagttgcggttcccctcctggcccccttcggggcgctgtccatttcttgctcttgggtacgggtggctccctaaaaccaagaccttgagcgggaaatgaacctgagtgtatgtctgggttttgttgttgttgttatgttttttccttcttttctttaaatttatttacagagttctttttagcaactttgttgggttgataaatttgcttctcatctgtcgatcccgctaaatcacaaagaagagtttattttttcatttagttgctgctttccccaaacacactaccctctctttcccccctccacccctcctcctgctgcctcgcttcctgaaccctttttcttttctgacggagggaatctccgcacctcctcctctcctcctcccacccggtccctgagcgcctgtgagaaccaggggagtcatcaatggaaataaataggactccgctccattctccgcccccttcaaacaagtaaaatcctccctgggttcggagaagtagagataaaacatccctcccaagggagcggttgcaggggatttgatgggattgaattgttttattatcttgaaagaagtgatggatggatccgagagggaatatgtatataaagcagagtgtagtgagggcgatcggtatgattattcattattgtttgttaagagtgataataaggccgcaaccttcgctcagactgtgtttatactggggtttgagtttatgtcagtctcttattacagtggtttcagaaagtgaaaacaccaaaaccgtattaattcttcagtcattctgcatatgggattaatcaaatgtcaaaaaagatactgtcgttttaccacagttttaatctatgatcttttagaaggttgcactcttataaaatgtcatttgcctccatctgtcttcttaaagtttaaaaaacttggcaacataattaattatggtcccaattcccattttcaatctaaacctatattcaggattatattaaaataccccatcatttattcctcagaagtgactcttatgagtttaaactcttggaggggagagagggacaactgggaatgaggggcctaggagttagataaattagtactatttcagatttctctaaaaattcctttacttcttcctttagagaaagaaattacaaggtccttctctgcacagttcatcacttcagtgaatgcccttaatctttaccacacacttgaaacataacagcttgcagccttgtctgcattattgctttcatttttgtgtcaggacattttattcattaaacctgtatgtcaaagacttaggcttagtgtggcagtaacactctgttttaattagtaactatcataaaaaagaagctagaactctgtaataggcctaaattgctatgaattatgtttggtttaaattacgcatttatttcagcagaaatgaaaccatgaatataaaacatcttttaatcacttgcagatacagcttttatctcttaggatgtaacaaaatatgtaattgaaaaatatccttctaaggacaagagaagcccccaccctcagcttatttgtcctgggtctgtttaacattcatatggtgaagtatgaatgttaaagagtaaagactattgtcacaacattgccaataccaggtcgatggaatgctaccttggaaatagccacagtaggtcagtcgtcagcttaatgtagagacttttctagttggctgcgtgaaccttgttgtttcagattttagttttctcacttggatttatcgaccagactctgttgtggaagggagaaaaatgtattttaaaactctaacaaattatttgacatgaaggggagaaaagtagaaataaagtgtatctcttctcttcctatatttatttctatagcaattctcttcagcctatctagaggtcagaatttttactttaaaactgaatgtgtttttgttgtcgtcgttaggacttatcattttggtatgatggatgagcagatattggaaatggaataatgatgactgaatcaaccgagagcataggaacagagtgtgaattacacatcatatgtgctaattaagattattttaatctcctttccttagtttctccatgataaggtggtcgatagtgaccaagtagtgctctctctctctctctctgtctcacttttttgctacctgccttcttgtcaggtcttgctttggggacctatacacctatagtagcagctgaaccttgccagtcagtggccatcagctaatcacttggaagaaaatatgtctcatagtcatctgtattgggtcaaaggcagggatacccaatataaccaacaaaatagttcaactaattcatttgaccctgaaataatatctagaacctctaaatgtttattttagaatgattattctaaagaacacaatttattcttcccctgtgggctcataatcatttaatagaagccacagcgtggttgatagtaaatagtaaaccccacaaaatctttgctttgaaagctgattttaaaatcaaatcctccaggatttaaatactctattttaaaatactttgcattttattccctgaagttaggataaattctgctgtatttttccactgtattacaaatgtaacattacgtgacactcagcatgcatgcagtcaagcttccatgttaatttcctcctagaaaaaaaaagtaaatactttgctgctgttgttaaaaaataatcatgtagtatgagacagaaaaacaagaatgctaatactttattgtatcacatggtggtatgttgaccataaactcagttatatttttgttgaaaatcacaccatttcagtgtaagtctgtttgcttggctgtgtgtatttcacgtatttcttgcctcttctgagatgacacctggcatttgctgtaccagtgcctaagccagtgccaaaagcaggtgtatccttggctgcttccttcctaaacacacaacccaaagaagcaatatccacacctttccccttccttctggtactttactaaaaactgcaaaccaacaaacacatgaattttagtcttttgaaatatttggaaaacatgtaatatataatgttaattcccccaataaaaaaagttgtggcttgttttgattttaaaaattaagggtaacaaatttgatcaatgtggtataaaagcaaactagcaaaatggtctgtagatttttcactttgggataaagagacaaatttggccacagaacagctgggtatttggccctattacaatgccaatttttttcaaggaactcattgagttaactttgatttaaacttcactttaaagtccacaaacctcaagtttatgagaaaagtatagaaactttcaagatatatgtcatcattctttcaataacttccatatcctttggaaactgatttattttagtaagttagttaataggtcttggttttcgcttgttaattttttctgtaacaaatttgaacatgacacatttaatattttatatatttctctgaagtatttatttttagcttcacttatgaaaactctaaaatgaatcttttctttaaaaaaatgtggctagaggtagtagtataaatgtataatttatcaaatgtctcttttaattcttcttttaaaataatttgccgtcttttttatagttaaaagaaaaacttttttaggaataatggtaaggttatataaagtttggagagtactcaataaaaatatgattacgcgtgattgggaatcaactcatttgagtggaactcttagacactgcctccacagcgtggagacttttaaatataaaaaccaaattataaaaacaattcacaacatgcatgcacgtttgctttctaattggaatgatttcagctaatatcacaaatagtggtgaccagctgaagtaaatggagactgtacaagtttctgtcagtgtttcttctctctaagcggaaatcaaggtaaacaccctcttcttccagctgtgtgctctgagaacatatattccacaatctaaaaacatagccaaaaatatggactatattcaaatatgtgttttatcaacaactgaaaatcaccatatcttgtcttctgaggcaatgctgttatatacacagatgtagatagaatatgagcctgaaatttaacattttctaaaataagcagtaaaatctgaactcataattagacctctaaaatatgacatcttgtttttgaaatcaccatgactgtttttaaaatttataatgtaggaactatgaacaaattggtatatacaagacagacaatgccctatcctggcagttggcaaacaaactgttggcagacagttaggggtagtgttgtggtacttacttgaaaatactatatttaagagagaaaaaccagtataatagggcctgattgatttatttaggattactttgtccaatttagctgttacaagtgtatggtgacttctggagtgtagatggttataatttatatattagaaatatatactgctggatcctgtaattgaagagagatttgttgccaacagtgggacagatcagaaacaccagcgctagctaagacacgtagtaaactggggaaaaacatcagtcgtttaactctgtgcctccctgagtctctgatattgttagttcttcgggtgctatgaaaatatgttactttttatggaaaaagaaaactgcctcttaaatgagagataaacatttaacactctaatgatagcaatagcaggattcaccatactaatagaactaacagatgggttacatgagagatggccttagaggtaccagggaagccaccctgctcccagggcctctcagggtaccaaaacactacctgaaaaaatatgcttttttttaacttttaaattaattttatttttaacttttacattaattaatttatatttaacttttaaattaattttatttttcagtgtcctctataaatatgaaaatatctctgcaatgggaaatgggtaaactgataccagctaacattttacaaagatattttaataactagataaagccagatcacttaagacaacattttagaaggggttattttatacatatatatgtataaaacatatgtaaaatatatgtgtgtgtgtgtgtgtgtgtgtatttcattctttacacataaaagtgaatataaatagatcttttggtatttccttcttacaccataatgggcaatttgtgccccacaatgaagcaaagaggacacccccttttagagacctctgctttacaaggttgacactatcagaagctgtccaggaattagaaaaggacatttgaaattatctttgcaaggttagacccagtgaatatttgcatttaaaagcttgtcttttaattacagtaaagtggaggatacaagatactcttttaaacaatcgaaggttgcccattgcctctaaaatcgtactgaacagatattcagcttctgttagtgtcaaccttgtaaagcagaggtctttaaaagggggtgccctccttgcctcattgtggggcaaagattgcctcattatggtgtaagaaggaaataccagaagatctatttatagtcacttttatctgtaaagaatgaaatcaagttttgtgaatattacttaatactatatcaattaacgaaagcactcttactcaggatatcagatggtcatggaacaacaaagaacggcagaggtgacagcatgtatgaagcaaaattaatgcaagataaaaataatgacattctgctaggtgcagtggcacagttataatcccagctgctaaggaggctgaggctggaggaccacttgagcccaagagtttgaggctgtagtacacaatgatctcccttgtgaatagcccctgcggtccagcctgggcaacatactgagaccccatctctaaaaatataataataataatgacattataatcagccctgtttataaaacacccctgaaattaaccagaaaaagatttgaaatgtacaattatatctactgtaattgtctatgatactcatcccagtgtagagagcttttaagtattttttaatgtattataagtatgtatgtgtgtattcagacacacccacacaaacccacgcacacgcatacacacttttttaaatcacaattctaagaggtttggagacctcagacctcagaccacacattactgagtgagagacgttgaaaagaattgagcaagaagctgaaaaagctctcaaattagtcactattttcaatattattctgttatttgtagaggtatttcataattcctcttttatgtataaatgcatattgtgccccattatgttttgaaaatatcagtaatctgagagtttaaaaagttccatccaacattttttatgtatattgtgttatattttgaagtttttctttgaaattatattttttcttagtaatgttgtcagttgttaactaatgttaaagttgtttccatgctttgaatttcacaatggaagcagaaatgattctatttattaataataataatatatctttgtataacccttgattgtttacaaggtacttccacatccatcactttccttaaccctcacagcaacccagtgaggaagatattctatccttctactcctgataaatctgacttacctaaactcacataaactttttaaataaagttgtaactctttggttttagaagcaaaattgatgaaaatgtttaaaagcttaagctgagattagttgccacattaatttgtctggacaatttgcttagaagttttttacaatttaattattcagaataccacttatttagcctaaatccacaagaccataattgtagactgtctatgcactcactgtttgtttttggtaatagttaacttcttagggaatttttaaaggggaaactgattaaactctttcacttgtagataattatttcaggtaaaacagaaacaaaacttacctttgagagtaaaaagcaccagttctaaatggcacaaagggctaacagtgataaataatccccatatctctccttctagaaggttagtcttttttaacaggggaaatcactgaaagtgaagtggaacatcagtctctgaacacgcgcaggttctgatgtaaacctcccatggcccccccgacacccccaatcaccatttgcatagattctcctctaatcataaaaggtaaactaggttatcagtttactttattaagtctacttatagcctgaaatcatctgttgaagtcaaattttctctcttcagccctccttttaattagtcctactaacccagtcattcaaatccgggtattacaatgttctaagatatgctatttgttgagtttgatttctcctctctcactctgtgtgtgtgtgtgtgtgtttatgtgcacatatgtgtaatagacaaagcctttcacataccttagagacaagttatcggaaaaaggaaataataaaacatattttcttcagtaaatagagcccaataagaaaatttgggattagaaaaataactcaaaagtttattagagacacataacccatgatattgaaacatattccaattattatggtagctgcaatcactgaaaaatcaagaagctgcagaatcctctgtgaaattagtagcaattagtaatttacctatcaagttgttccattataatgttaattatgtggcattcttgagaggcaagagttgaggttagatcagttctaagatttttaaaattatttttaaattagtttttaaaaattggatgaaactgtacatttcagcaaaacaagagcgcctataaacatatataaaaaagatactccaaaaattccaaagtttaaaaccctttaaaatttaataagaaaaataagttcagataatgaaagtatttatacactcaacacttcagccaaactcagtctataattttttaaaacattttccacatttaaagtttattcacacgtacaaagcaatgacaaccaccaggcattttcgagatctctttttctcttggcaggctctatcttgtgtaatgatcactgaacgttgttgaccgcgacactcaccagctgcagccttttccttagtgcttcccttaaaaaaataaaaaagagaaaagaaaaaaaataggagaagaaaaaccacacctaactgtgtatcttacttccttgggggggaaaggattacataattgtgggtctgaattcccatattgtatcagtacttgtggtttgtcatctctctaattgttgtaagtttacatgcttgtattatttcatcacaatttgctataaactattgaaaatgactgtgggatctgtctgtgttgtttgccttttgaaagtgtacttttctttaatcatctcttaatccagaaataataatgcagaacatcccaggaactgatcctgatcctcagtgctctgatctcaacacgtgcatcttaaatcctttgctagatatagtgcctaaaaagcccaagcacgctcggctttgaaccagtgttgatcagttttgtttattaaacaatgttgatgtcctcagatatggtgtatgaaggataacaaaaagcatattaagaatttacaattatttttgagattattttttaaaatcgacatcttggcctttaactctgtgcttctaatcagtctctaattgaataaggtcctaatcttttacctgataggtaaataaagatggaataatctgatgctgaaactccttcacatatctctgttttaagagcaagtcaagacgtgttttttgctgccgaataaaatgttgcaaccagtctgagaaactggcttacactatttgaagataaatagaacctttttaattttaaaagaacattcatatcaattatttcatttaatctcataacaatcctgggaataattgtctccattttgtagatgaggtaattgagcttgaaggggattaagaggctcactcaaagtaccaaagccgatcatggtttaatcaggaccttttcaacttagatctttgactcagatcttactctaagttgagtgatctttttctattttgctttggcagcctttaaactgtttcaaaacttgaataaatgaataaatgcatgaataaatgaataaatacacgaataaataataaaaattacataatcgttggtggggggatggtgggggagtaaagaacagaccaaaaaataaattcaggtgtttgcaagaagactcaatcctgaattgaagaggaactcagacatgagaagaggtcacctgagacattgagctatgagctaggagagaagagacagagaaggaaaaggaaatgatatgtttattctttctccaaatcgtgagattgtggacgtgagggcgatctggctgcgacatttgtcaaccctttgatcgccagggttgattcagctgatctggctggctaggcgggtgtccccttccttcctccctgctccatgtgcatcgctcccgaagctgtgcacttggccaaagagaatgaccatccccgatgaaggaggaccggtctttggtcaacggtatatgagtagctgcgctcccctgccagaacctccaaacaagctctcaaattactaaattatcaggaaccactgtctttggagaatattttctaacctttccggaggtgtttttgtgtgttttggggggccttggattttacaagagggctggtagaataaatacatacttgaagactgttccttttaagttactttcttttacaaaaacaagttaactgcatacttgtgtgccctccccttttttctggaaataatatttccagggcgtggaaagagtttaacccttttaactctttaaggtccctggtacatctactcactcatctatctatggattatgttagctttattacagtttttaaaaattactattttggttttgtcttgtactttggcactggaggccaccacacattctttaatagtataaacacttaggctttagtgctgacccatcaaaagaactgctggggaccttgggggtaaagatgagggagagttgaagcttccagaccatcagatatttgggtaaatgtgggattaggcccacagaatgaagcatcactttttttactctattcaatttattattctgtagtagtaataaatggtttcttcttgatctcattttatttattggtagtgtttttgcaaactctgttaagtatatgaacaaactagaaactttggtgtaattttgaatcttgtcaccgtctcctaaatagtccactggtccattagtgggctttgtgttaaacacaaactgcttgggggaataaacttttttttttaatgtaaaaaaggtaagctgggcacggtggctcacacctgtaatcccaacactctggaaggccaaggcaggaggatctcttgaagccaggagttcaaaaccagcctgggcaaccaatggaaacctcatctctaccaaaactaaaaaaattagctagacatggtgacacgtgcctgtagtcacagctacttaggcggctgaggtgggaggattgctggagcctgggaggtcaaggctgcagtgagccatacttgcaccactgcactccagcctgggtgacagagcaagactctgtctcaaaactaaaaaaataaaaaaactaaagaaggtagagaaaagagaaaactgaaatagtatggatataataatagttcttagaaaaagaaaggatatgggcaatgtctttcattcatacctctccctaaatagaggtttaaaatattaaaacttggtagtcagtgaaaattaaagattagaaagttctaacaaaatcctagagatgaaaatcctactgctgctattaccagattataggtcttcatagtttgggagtttcaaaataaaaatacaggagaatcacgagattggaagagacagacccacccatcacctggctattcaagtgcagtccatgaactgtcagcatcaacgtctcctgggagcccgttagaaaggaccattctcaggacttacccctgacctgttgaacctgaatcttcattttaacgggaaaagagcgatttctgtgcgcataaagatttgagaagcacccgtctatgccattcctgtgctcagatcagaatagatcctaaccaaaccaaaatttacatgatttcagaggaaagaggccctcctgagtaatacgctatttttcttatcaggacatttttgtgttcttaaagacagaaaaattataccaggctcccggaccatccagcacatgccatcactgtatggcagccatgccagtggatatccgtgatgtccccttcatcagattagagatatgcttccagactacttaggtttcacacaatagcctattatatataagtttagcacccataaaattgtcaaaagcattcatattttatttgctattaagcctatattctcttgaaacaaattctacacatcagcaacaatagttaacttgaatgttctttttcatttattcgttgtgcacccacaaaatgtcatgagtatctacttaatgttgggctctgtggtcaatactatctatcagttatagtacttgtagatatatgtaggattccttttctacccttaggaaactccagaatatgtacaaacaatttaagatggtcttcaatagaaatatgagcataaaaaagtgcacagccaaatttttctgtcattgttgaggactgagtcttaaagaatgagtagacgtttgccacccagagaggcagtaaaggcatcctagcaaaagaagtagcctgtgcccaggctagaggcacttgctgggaatatgaagcagagggtgaggagcttgtaggaaatgagtgtggtagagtgcagggcttgagagtgaaggacctcatgggccgtagacttcatcctctcggtaatgggaagccatcttacttttaattttttcgaagagtgaaacagatttttgtttgtaaagatgccagtgtcagtactgtagaaaatgaatgagagatattggaaatgggtatgagagcagttaggtgagatgcaataagtggataatttgaggctttggcaatttggatagaaaagagaacaaatttgggagaatacgcagcaagtagagtggcaggatttgaggattaataggacatggggattgaaaagtcagatagtgtggaagtccctagtttcataattggaaagattgcgctgctgcactggcatgtcctgattttcatgcagcatcttcgtttatgcttcagccgcctcgtcaggacctactgttcacttcagtcaacaaacatggaaaccgaggctcggagcagttgcatcatctgcccacagtcacagtggcatggaagcattctggcagaggaaggagtggagcccagattcaaattcaagcctgactctcaagtctggcttgcagaggtgtccgctgagttattttacactcttgagggttaggtgcctgggcttcagaaggagaacgaatttgaagctaagaattagccttgagggtttggtaaacagccgcccctaacttctttgcacaatacagaaatcttaggaatttttctgatgggagtatttcagattgctttgctgtctgctgttagcttcttgaaaacagtataattcagcaaatatttatctaatgcctactttatacaagaaaactaaaaacagctatgtagggaatataaaggggagtaaaaagtaatttttgttcataaacttgtgttatataagccccatgaagagcttttttataaggacaagaaaaataaaaaaataactataattcaagtgagacgagaaagtaacataagaaacaaagtctttggtttcaccagaggactgtaattccaccttattggcctctaaggttcccaggggacttgcagtaggcacttaataaacactggttgacttattgacagtgtacagggagagctcagatagcaaaccatctaagtaaacaccacactgtcgcaatcctattaagaatttccccggagattttatagcgctctgttttgggtatctcactccggaaagtcaggaagcatcctccctctgtaggaacacttcctacttttcaaactgcttccttcagtggaatggctttgtcagatatgcctttatgttgctgagctccaagctcctttccctaaaaccatgctgacaatggggactggctgggcgagccggagagcctctaatccgtttcatctgataatggacgtcagagcatctggtgtcctccctggatttaacactggccagttattcctcacctgacctgactgccgggtcttggtgagccagtgcctgtcttccagtccctgtggcttggcagcgtgtccctcttagtgggtgatggttgcagttaactcagatgaggcaggttcccaggtgcaaagactgggagaccagtgtttgtctttctgctgtctcttcctcagtgttctcatctgttaaaagtcccttctggttccaaaatcccatgactctgtatggcttactcttcacgtgagcccttgctgaaatgttccttcttcagagggggtttcttgactacttagcctagaagggccccttcttccccagtcttcacctctctacaggtcctctctagtcccttagcctgtatcattttctttagagtgccctctgggatcattatattaattatactttgttctttacttgtttttcatccctcttatccactgagtataagctctacgagctcaagatcttcacacatcttgttcgctgcctcattcgcagcacgtcaggcagtgcctagtacacagtaaatgccctacttgtatttgtggaattacccactccataatcccaccacacttgctcttttctgttgtcactgccttattggtgggtatcgcttactacatcactggaagctgggttataaaagatttctttgatggaaactttagggaggatgcaacccatgtgtttaacagacattgccagtagaatcaccaaggcagtttttaaaaccaggtttgttataagaacagaaacatctttgaacttgaatcatgttaagtaccttgtcttgttaatatggtaagtagaactagaaacaccttttgaatgttgaagatcctttaagaagatagtacatatggcctgagatagatggaaaatatgcagaaattcaaggtcgtgcctgaatgaaatgattgatagttttttagaatctttttttcttgctgtagtattctgttttagtctttcagttttatccttgctgttactagcaaacaaaaccagtagttatctcaattcagaagagatagtgatggttcgatttgatccatcagtatttagtgagcatttaacatgtgtattgcaaaatgtatgaaaagattgctgacctgccctgtagagtattatacatcaaagcttggtgtccatcctaaagacgctgccagtcacttccttactctctctagcctggttttctcaactgtctcagtgactgcagtcaattccctcctggtcttttcttcactgagctcaccatctgccacttccctgctggtgcctgtgtagttcgctacattccggattattccattgcctttagaattcctccagggatggtgcttctttccaaataagtgcccagtagcataagttatatggtatttggcaggtgtgagtttgtaggaaggctcacaggttttatttagcctatctgtttggatacagtttatgaagaggtctggtcacatataccaaatagtaatattttcttgtcagattttcttcataccttctgtatctgtctttcttaattctgtttcctgctcatttaccataacaaccactttccaggacgaaaatatgcctttggacttctttcttctctgggtactttcaacaaatgggttggcctcaaataatatgcatcccttcacttaaaatttaagttcaaagaagcaacttctggggtgcgtgtgtgtgtgtgtatgtgtgtatgtattgcctttctctaatatgtctcttcaaccatccatgtatctggcggatcccatttcccaccatgataattgaaatcagtctttttatttttttagccacacttcctactaatttccactgtagcctctcctcatttatgtttctcatcatttaaagagaatgccttcctctttttctcctttcttctaataccttcttaaatataataaccagtttttaaaactgcatctaagatagacagctattcaggctatttgatgccacctgaaaattctgcttaactaatttatttctctcatttcttccacctttgcagtactttctgtttgtcattttatcatatgcacgttcctataatcaatgtgttattttttattcctcttttttcctcacttccttcctccaacttaccagcacattctggcaatccaactgcaaagcatatccccagtttttccattattcctcatctcctctacaaagctgaaaaaaccaccatctctaccatggacaactgcagtagccttcatctgatctttttgtttcagaaagatgaagttgttttctgcttttaaaactaccacttcactgaaatccattttctgcacaatagacagggttattcctaaaaaagcttggatcacttcatggcctttctgtgcttaaagagctttccactcatgcctgtaatcccagcactttgggaggccaagacggaaggatcacccgagcccaggggtttgagaccaacctgggcaacgtggcaagatcccttctatacaaaaataaaaaaaaaaacctagctgagtaaggtggcacacacctgtagtcccagctactcagaaggctgaggcggaaggatctgttgagctcaggaggtagaggttgcagtgagccatgattgcaccactgcactccagccttggcaacagagcaagaccctgtctcaaaaaagttggcaatgggggccttcccaacacgcttagaacagaatccaaaccccttaatatggatgtgaatctctatgtgattggcacttggtcttccattcttccctcacccactgtgttccacagtgatgtcctttccttttgtcaatacctcaagcttagtgcaaccttggtgcctttgcaccagctatttctctgcccagaatgctttttctcctgacatttatttgcttcattggcttcctcttgtcattcagatgacagcataaatgtcatctcctcaaggaaaacttctctaaatactcaatctaaaatgcccatcaccacactgtctttcacagaagcctattttaatttttagcatagctagcagcaatagtattttcttgtgtatctgtttatgtgttgcctgtcactcccactagaacactcacttcctgaggtcaccactgttcctagaagagtacctggcatgtagcaaaaatgtattatatagatattgaattaaaaaaataatgaatgagtagaaatgctgacattggactctgttggctgggcaggtacattttgccccataaatagattctaagttcctaagatacatattttttcagacctcacattacccagttgagtttggagtatgacatcgatatttgacaaaactcttattctcttcattttttgctcttttggccatatttaggttttggtatcctaagaaatccatggagtgacttactgaagagttaacttcttggataaatggctataaaaaatcaaatttttatggtgctacacactgcagtgactcaatatttttttattgaccacaacaattcatgcctcaccttccaggctgatacgtgctgttgctgaatgctactggcgcgctgccatgctccatcttagctaaatttcagtagagaatgaggtatgcagtttgtaaactgctttggggaatgttgcacaggaagtcattttcatttggttgcagatcaacaggaaataaggcttagttgccaaacaaaagcaagaaaagcaaccaagcatattattccttcctttggggctttcattattctaagaatcattagcatcacctaagacagtggaagttatcccagctatctcagtttcacatatagaggacattttgataggaagaaggtatttagtattctgttccagtttttctttgcattctcccatacactgcttttgaactttgtcatatcttctaaccatccatctgatacattttaagagttctactcctttctttactaaaatgggtctggcttcctgaattacagactactcctatctatgagacatttatttcggccagttctgttattcattattcttctcattggcattaatattgatgggaatacaagattacttactttaaaatctgatcctctttgaagtaattctgattgtgtaggcttggccatcttttaaattagaatgccctaacgttatccctgttaggaactctgcatcatgagactcagagggagcgcatgacagaatggaaactttattcgaatccttggcatgttttaatttcacattgcttttttatattaatttaatttccttccagaaggaaagttggcagtcatttagagaagtgctaagggaggttggaatcattgcagttgaaatgcatgtgcaggtccctaatctgtagattattgacataatgaactctaaaactcttaataatcatgtcactgtgtactgacagcctgcatttagagagctttagtgcacgagttctgtacataatgtcggctctacttcattgggttgggtagaagttggcatgttatcgcagagtgagagctcacctagcatgtgccagagaccactcgtcagggcagaccaggaatcctttacttccatctgctttatttctcccttttcaggtatggaaatgtcagcccataatatgctgtatttccttcaaatttttaacagatttggatttttaagaacaactaacttcagacattttcattgtttgcaaaagaaaacaaaataaaacaccttttgggaattcaacttttgattgctgcatttttgcctcgaaggaatccgtacatccacgctggcacatgttggacattcagtattaaagtgtgcagtcctcttcgcttgctgcccagcaagtcatggcagacacacggctcttcccctaactaaagctatatatttttttcttacacctggaccaaatgcttcagatttattatcaaatgtgacatggatgattcaaacaaaaacaaatgctcttgagtttgaaaatagaaatttaaaagactaaatatttgcatttagaaaggaaaagaaaataacagaaatctctgtggcagaccattccttgaaattattctcgccaaattataatcatgcactttccactctctttaattaaacattagatttcatttattctctatacatttgcttcaagtaaatcagaatgcccatccttttttgtcattgtaaatgtatttcaacttcgtggcctgcacatgatcaggcacattagataatttttaagcgaatctcagtgatactatatattttttcaaattttatactttatgttatatttatagtgatgaatctgatcttaaattttataatatgtaaagtgtgtaagagcttgatgacatttttcacaactacatttatacatttctgcaaagaacttgttggtgatagagggatggaggaatttgttttgatcatattatcacaggtaggtaaagctgttggctgctgttctgaggaagctacagtgatgagaaaggtcacagtgcattaatttatatcacgtcttctattttgagagccttggacctttacatgaaagcccaaaagaactttctatctaccagatttgcaattgtttgaattgctcagataatatagccaaatagcagtctataactattaaagacaagctttctagtggttgaaataagagtctgctcttaaaagtcttaattgttttatgtggtaaaaccatttagtggatttttaaggaaaaaaaattagccagatttatttcttatcactgttcatacaatttcaaagaataaatgttaactaactgaaccagtggtttaacccagatgggtaaattgactagttgatcttatgtaattgcagataaattttgcaaaatgacagcagtagaactgctatagacattctggggcaagttgaatttttgtagggtatgttgtgcttttttgtgatgatagaggtaattctgggtatttaattgatacaatgaattactcaaactccctttaaatttttactttgcttaccattgaccattttataatttacaagcatttccacaggtttgtgggaaaaagatatgccaggtcagttggacagtttattttatctaaaagttccatagaatatgaagtttaaattaatgctaaagaaaggcttagaattgtctgtacatgttcaattatccatcatgtgctccactccctactccttgcagaacaataaaaacgctttaaatctattcactgacattttctttaaaactggaggaaatgaaggggagaagcaagttcccatcaccatagtcctaaaacattagaaagaatcccttctccatatctcttgggttgtatagtatttacctgctcgcaagaaagtgggcagcagatgttccatttttatatttaaaagtttcctctttggggactactacttatttgccttaactccaatatcagctgattgaactcataatgtttccacatttttgatctaaaaatatgtgtgtgtatatattcatacaccatataaactagttatttactttggattatccaaacccatctctacctttgtaagtatagactatatggttaacctttggacaattttatttcccctgtaggatattggcattccaaagaaaaatctcatatcaccaataatctattttctaaagattgagttgtatcaaatcattaggtcatttttattttctcacctcagttttagcaggatctgaggacttgtgccaaatgtgaagaaggcctttgacaacacaaaaatagcagaattatagattgcatctatatcttttattcattagaacttttcaattgaaacaaagtcaattttttcagtatcagagtaacactaccaagttcttttgggttgtggatactgtgcaaccaagttgatctgccaagcaaaataaaaatatttggaattatcctagcaactttcagcttatgtttgaactaaagcctcaattgtagaaagatagcaagatttgttgctgtgcaaacacatttcctacatcatccaccagatggccatgaaaaaagaaagtgcttaaagtgaaactctgattgatgttatttaatgtaaagtttaaatctagataagctctgcctacctagaagtaacaaaaagaaatgagaggaaaagttatgccattagagggcacttttgtaatcttagaaaaaaagtctgttcttataaagcaatttaaggcttatgcttaacaagaatgaattttcatttgtttattctcaatgactaattcttaaattgtatatctgagacagaacattttattgttagggaaaaatgtgtaaaatcttaaaaccaccatttaaataatatttatgtaaagcttcaattttttatcagtcaatataagttgtaaaaatatatacaatgtatctacacagtcattttttgattagctatattcaatgctccttgtaaatacattttaacttctgcctgtaacctgaccaaattgaacaagccatcagtgctccctaatatttaagtttttccccaacagtagttgcatgttattagataatatttgtagaaccagaatctgacagagtataaattcctgtgtttggggtccatacaaatttttaaaacttttttgaaaagtatgttttgcccataattggcatagcaattgagatggttaaaactgtttcagaaacaaaaaatgtggcctgatggaattttagtttgggaaatatgatgtttttgataaagcaaaagataaagtttcagtccattatctattggtgattgtctaaataaaaatatctacctgagccaataaagtaggtaaaccagtaaaatagtttaataaatagaagcttagtgtcaaagactatgaaagacttgagattttagcccacttgcaagctaataaattagtctgtcatagtttcatggatgctagaagaaggcaagatactcctgggtcagagacaaaggactttattactcagagtgacgtattactcaggcagagtatcattattttcttccactggctccctgacccccacttcccacaggatgatgcaaagagggccagcgggcactgggccatgtttggattttattacaagagaggatccctgaatttagggacctaaaatcttctataatcggtggtagccatgcctgctctttgctccagaggctttatctgccaagactgctcactatacaaatatccttgaaaagataatgtggaacaaaagcagtcagtacttctgctcccaagtacttgcaaaagcaaacacagagacccatggagaattgcctcccaacacttactctgcataatcctataacttgaatttgtttactaatattaatttgttaagtagctgaactggagaatatataataatcagatttaccatattttaagccacctataataaatagttcatattttttacatcagatagtatttactgtatgaccttacttatctaagtctcactttgatcatttttaaaatgagaaaaaagaatagtgcctacattatagtgttgttgctagcattagatgaaataatatatataaagaacttagaagaatgcctggcatgtggcatgtatacaacaaaatttattaatattgtttttatctcagatttttttttctttttttgagacggaggctctgtcgcccatgctggagtgcagtggcgtgatcttggctcactacaacctccgctgcctgggttcaagcgattctcctgcatcagcctcccaagtagctgggattacaggcgcccaccaccacacgcagctaatttttgtatttttagtagagacggggttttgccatgttggccaggctggtctcaaactcctgacctcgtgatccacctgccttggcctcccaaagtgctgggattacgggcgtgagccactgcgcccagccagaattcattttttataagtatctgatttaatagagagttctttcctagggcagttgaggatgcagggaaagttcctatcaatcgacactatttttccaactcgggctgacctaaatatcccagataccctgggtccttaggcagcttgtcctgctaagtcatactgtggcaccgtggttggcagctttgtgggcaaacatggggcctaaggaggtaagccttgagtggctctgaggcaaatatgcctgtgtatctcgctttcaagtgctctgatagcatgtttgctaaatttctaacaagtacagaaagcgaaattctagctatttctaaagagattttcttctttatttggcctcgtctgttctcacaaggcaagttttggggatggtactacaaagagaaataaacttgtagaattgcatgtggcatgtctatggtatttctaaacagaggcagcatagcaaatgccatttggattttcagtttctgttagctccaaacaaaagaggagcagaggggagggacagacagcagtgagggaggtcccattcaggtcagtccaccatgtccttgcttggttagattatatcaacctagtcttgattttgatccatccagccatcttttgcagacatagcccttgtctactgttagcaactctcatgagctcccactgacatccccaagttcttttggatttctccttgacaatcatctggatatctgagggagagattacttcaggcaacttaagaaggcctggtcttattcttaaactgccagctttttaggaagaaaagtttattcagtctcagaagcattgctgattatagatcacccatccaaactcttcaaaaaactgaggtccggagtggctaggtgaattgcctaagatcacacatctagtaaggaactgaagctaaacatcaagtttcttagctctcagttgaattttcttacacttgcaatacaattaagaaataagagtgggaaagaaaagcctcataataagttattatggctttctggagagatattacagaggatgaacactgggctctgcagtcagatccacctgtatttgtatcctttctctgcttacctaatggagttttgtttttgcataggatagcagctacttcacaggcttattgtgaggactaaaagtagtaatgcaactcgtgaacttagaacagtgctttgcacatagtagctctagatcactgcagatattttgtatggaaaaccgcagaacacagaacagcaaagaatatttggagaaaagtaaaatgcattttgcacaagctcgttgtgaaaaatccaactctcatgtccacattgtaaaaaagagaatgttatttctttcaaactatatatttttgcaatctgaatctatttttgatagcattcaaagaaagataaaattaaaatcaaatgatgttttaagtagaggttgattatagtaatgtccatttaaaaataaaactggcattcacttcatcttgaattatcacaaatatttgctatttaaagtacctcaatgtaaaaacactatatttctctaatgctttaattccctgatgtatgttaagtcaaagaggtaaaggaaaacaattctttacatatttctttctgtgaggaaaaaaaaataccaaatggtcagaggaagcaaagttttttcatgagacctgtcatgtcaaggaacttgcctacctggggcttcctgttgggaacaccaagacatgtggaagacagtgtctttgacaacacccctacagcaatgtgcagtagagaatgatccatcattacttagaggatctttgatgaaagtcagtgacaaatgccaaaatgtaactcagtgaaagtactctctgctggaggttaagacaaatgttctaaatatacacctttctggcttgatgtgtgagtgaaggttcaagcccattttctaaaatgatagaggtgtatatgtcaacgttgtgttgaagactctggtacctgataacaactaaacatcaactaataactcatcttgtgattctggacaaattgcttaatctgtgaaggagatgaagtttatgatttataaaaatccttgacttatgaaaatttgatcttggaaaaagcataatactacgtagagagttatatatgtataacccctagtcagattttagggaagaataaaaataattgagcagtgataattttctggttctcaatgagtctctgtgatttatgttgaatgtaatagttcaaccatatcagcaattagcaacttgactgctgagcaatgataccaaccaaccattggtataacttttataatagttcaaaaaactgaccttaagagattattttcgtgcaagctttgagacattgatatagcgttatctacaatgtccatataggcttctgctgtaatgaagtgaggattttctctctgaatacccagagaagttaatgcagcaagagtcttttcatttcaaaatctttttaatgtctgaaattctagtgaatttatttttaacatcatgaaaatgtttgaagaaaaaatatagtaaagttgccttgaagatcatgtgtatgtatccaaaatacatgatgcgtccctaaatttccatcaaagctaaaatagtgttaaccctttagaaagtctgtgacttgcctgagtgtctgcctgcagaactaataaagtagtcatttctgttgcctcaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaagaggtattctccctgcagtattttctttattaaaaagctcacaaaggatgcctccaaaaaagagagtaacctttagacttagtttaggtaatttacaaatcaacctatgaatggcattaccgattttctgtaagtaagggggaacatggcagtgcaacttctaattatgaaatagaggctgtttgattcttgctgattgtcatctccttttgcgtgtaggaggcaatgcttgcatttcttacattttggaatgattattttcttcttttcagtacaggaggatttttttttttttttccctgagacggagtctcgctctgttgcccaggctggagtgcagtggcacaatctcggctgactgcaagctccgcctcctgggttcacgccattctcctgcctcagcctcccgagtagctgggactacaggcgtcctccaccacgcctggctaattttttgtatttttaatagagacggggtttcaccatgttagccgggatagtctcgatctcctgacctcgtgatccgccctctttggccgcccaaaatgctgggattacaggcgtaagccactgcgcccggcctcagtacagtaggatatttctaagaaggattctgtaggattaaagtgaaatcaattttcatgaatatgtatgattcttcaagagtttgcattaagttttgtttctgagacaaggtctcactgtgttgctcaggttggagtgcagtagcacggtcatggctcattgtagcctcaacatcccgggatgaatcaatcctcccacctcagcctcatgaatagctgggactataggtgtgtgccacctttcccctcaaatttttaaaatttgtagtagagatggtgtctcactatgttgcccaggctggtctctaactcctgagctcaagtgatcctcctgcctcagcatcccaaagtgttgggattacaggcatgagacaccacacttaatgcattatgttttatgagtataatatttcttcaacaaatattatcatattctgagagaatcaaactaaacagtcataaaaactgacacggtttatttacctttactccaacatcaacaaattgggctcacataaagtttctaaatattttgacctttaaaatatatatatatataaaataaaaataatatgttataaattaattacatttaaagttacctattttgtagtgctcaaactcttctccctttgtaagtttagcacacacagttaatctttggataattatatttcaaaaccagttgctccttctaacctgggatacagtgaaattccaaaggattaaactgtttcagaacatcaataacccattttctagagattgagatatatcagatcattagtcatcttttcagttttgattaacagtaatcatggaagatggtggtctgaaccccttccactcaatggcccagtcttatctccatctggttagtcaaaatgatgataggtgatcagttttcctacattaactagagtgaactattgttcggattatcattttggcactgctcgagtaaaattatttgtttgcatgaacacactagactagtaactgacttgtcaataacatataaaataattttgaatctttaaatgacattcatgggagtgaaggcagaaaaggaaaggatgattacattgaaggaacttgctctcttggtcctgactaaaattgagtctgtgaaaacagtaaaaggcatacaaagcagtcataatacttcaagttaatcttaactattaactgagttcttgctgggcacatttggcttttcatattattttgtcctttgaaatttacgtgtgagtgaaatcaaatcaaaatttttctgtagaaattactttcatttcccaaatgcacttgggcactgccttctttgcaatatactttaaatacagcattccacattatgtaatccaatcacttaattaaatgattcatctttctttagtcttccagtttcttaaaaattaaataagttttgcctgtaagagctgttttagaaattacacttttaaagtaaagcgccatgtttttattaagagacattataaaacaacattttctctttttatttctctcatttattcattctttatatttatcttttttccgccaatgattattgaggcccttggtatccacaataggaaaaaatgttaacatacactagtaaaagcagacttatgctagtaaaggattataaccacaagtagaaacttcatttctaggggtgaaatatgtaatgataagcacacaaacatgttgttgatattccaactaaaaaaagaaattccagataaagttgcacagcagtaaatttaaaaagacagcaaatgcattaattattcttacgtttatacataaattccaaaggctaaatggctcatggtgtgcttatccctcagctttggcactataatttgggccatgtttccttagttattaattatgtttctgtgtccctcactagccagtaaatatctcgaacatgtagattatgtcccgtcatctctgattgtcactctcttctacagttgctttgtgcatggtagacaataaatatctgtcaaattgttaagtatattcaaattatcatttatccctaatcataagtgcttccatatgaaaatgttaacttagagggtctccctgctgctttatatgcataatcattatcttgtggaatgaaagcattgttttatttgtaactggtcacctatgacctacgtttaagttactaagacacagttttggaaataaactacttccttgtgtgaaatgagaacagaaggtaatagacaaacttgtacattgttttcttctgtgccgttgcttagctctgttattcacataaaacctaaaatcaaacacgaagttttgaacactcttttacttatatgatgccaaactagttatattgttgtacctattcctttgtaatatagataggttcaattatgtttatgtggttaataactcccatgcaatctggccaaagggacaaaattctactcacaaaaagtagactgtattaaaaattaagccttctgacactgttcaggaatgcttatggtacattaaacttcacatacagtaaacaattcaatcatctattttgtctagatgattgtttaactttactgttatatgaataagttgcttttgcatttatagggtcttcactttatttgtctgcccacagccccactcccattctccatctccaaaagcatctttgaatggtggtggctgggggaagtacttgtatttcaattcagattctatatcttcagatagaaggagactctaggtgtatgaaccaggctagaacaagaagtgtggtgttaggattcttaggttttatttacttatttagtaattcaattattttaaaatgttgatcaagtacatacatgcagaaacctgtgctaattgctgggaatacaaaggcgtgataaatgaaccctaacagggcccttgtgaggaaaatgacattaatcaaatgataatacaattatatagtcacaagtaacaataagtgcccgaaagtaaaaagtataggacgttctgagaatgcatcagaggacctgatccagagtgagttggaaaaagcatccctgaagaaatgactctaaatgtgagtatgagtcacaaacctctgtagtgacagggcctctgcctacctcacctgtttcttgtcctgtcactacccacttaactctgtgctcaaaccacaaagtacttctctagtttctgaaccctactcaccctaccgtctatgggatgtggttttctctgcctgaaaagaactcctttgccccaactcacatgtaaagtcatttcttcggggatgctttttctttagtctcaaagactaaaataaatctcaaggaatgtttgttggatgaattaatgagtagtttcccatacctccactttcaccacctccgaatcattccttaaaactgcagcaagaggaatctcctaaaaaagcaaatgtactatgtgatttccagctgagagtcctatcggagctttaggttttagccttagggaaaaattccttaattgtatgagcctggatgaggtcacacagggagtgagcataggtagaaaagagacgttcaagcacagtcctgtggttcactcccaacattagagttcagggaggtgagaaggaaccagcagaagagactgctggggtcggaggctctggtggtcagtgttggtcagggttatggagagaataggaaggcaagagatatccaggaggttcaatccacaggaggcaaagcctgcttttctctgcatggaatcaatgagcaactctgggcttgctggaactgaaaccactctttcctcattggcaagattataggttttgaaagataattaaatgaaaccatctaagtcatttggagtaagagtatatggtatttctatagttaagcaatatttttattctttttaaggcattacaataaaggctcaggggaaagcacagagtagaacatttgattttttaaattttgttttaaaatcattaagttatttaattcaacagaaaacctgtgttagagaaatgtgtctttctactgactgacacagtgctctttactttttaaagtatttctcaaatggtgattagataatgcgattccaaaagatatgaaatgggctaggcatggtgcctcacacttgtaatcccagtgctttggaaggctgaggcaggaggatcactggaggccaagaatttgagaccagtcagagcaccacagtgagacccccatctgtacaaaaaaatttaaaaattagccagatatggtggcacacgcctgcagtcccagctactcaggaaactgaggtgggaggatcgtttgagcccaggagtttgaggctgcagggagctatgaccacgccactgcactcctgcctgggagacagcacaagactgtctcaaaacaaacaaataaaaagatatgaaatagtaaagctgtgaataaaagtcactaatgtaaaaatgtgaatacagcgttatattgccagagacaaacacacagtttagaactaggttgctgtgaaaatgttcttttgaaatagttgcaactatgtcagagtgccctcaagttaatgtacaaatttatcaccaaatgtatggaaagcatggcacctatagggcaacaaacctggaaattttcttggttgtgatttattttgcagtggcggggcctgtgttaaataataccaggcaacaggtcagtgttgatttttaactcaaaatactttgggttcaatgtgttttatttcacgctgtatttgttgatgataaatctggttgcagatccttggggctgttggacttccacagttaatgctgtatcatgttttgtgtcaaatagccaattttattaaactgtgttaagggaaaatacaatgacattttatgaaaattttataaaatttataaaatgaaaaaaaaattaaaaccaaatgatttttctggtaagtcttgattgtaaatgttagaaagaattaccacggtctaaagtggtccactttcccacaggtatttctttgtggttgaagaagacaatactccattatcagtcacagtgacgccctgtgatgcgcctttggagtggaagctgagcctccaggagctgccagaggacaggagcggggaaggctcaggtaagcagcaggatagatctgcccctggacctttgaatggatggttttaatgcttgtgaaacatacaaccttctatgtgttagtaagaaaaggcagcatgggtgcacaagtgaatctggaggtatgagacggagataagggaagtgggagggtggcatcagatgacactgatcctgataaaataaaaggttaggagagacaggtacagggattgacggcttgaggagaaggggagaggtttggactagcctctatggctgtggtttgcaatcttgcctaaacatcctaatcacgtacgtataaggctttaaaaactgctgatgcctagatcttgcaaaggtctgatttgattggaatggggtgaggtccaaactttgggatttttagccacactccccaggtgattctaatatacagccaaggttaagaacctctgatctccagggaataacagatggaaacagagaagcagagaggcatttagtagcagttaaaggccaagatgaaaacaaagttagtaggatgagtgggctaagcatttaaagaagacagatgatagagagcaaataaaataaaagagaaatgagaagagtttgtatggcaccctgaaagctctttaagggcatcataggttaaaggtgaaggcttgacaatgggtgccctacaaatgactatatatatatacatagtctttatatatatatatatatatatatatatatatatatatatatatacacacacacacacatagtctttatatatatatatacatatatatatacacatatatatataactatgtatacgtatctacaaaggctagctatagtagtttcaaagaggggcaaacatcgcaattaggaaaattatggaagtgtgtatggggagtaaagagaccaagatacagaaaacaaatcttgatgggctttttttttttttttttcaggacagggtcttgctctgtcgcttaggagtgcaatggtgtaatcttggctcactgcaacctccacctcctgggcttaagcaattctcctgcctcagcctcccaagtagctgggaccagaggtgcatgccactacgcccagctaattttttgtatttttgtaaagatagggtttcactattttgcctaggccggtctcaaactcctgagctcaagcaattcgcccacctcggcctccgaaagtgctgtgattactggtgtgagccaccgcacctggccaaatcttgatgttaatatatctgtttgatgattgtgtttatcccatagtttaggaataggaaattctgtatagctcactttcaacctgcaatgataagctggaaaaggtttcttctcactgtagctacccagtcattcaccaagccctggagactaagctatacactgatatctgtgtgatatctgatacttacggtaacaaaatatggaaaaaattagtttagctttaccactattcctgtgttattcctgggtgcacgttctatactttgaaccttaagcattctttttttattttgttttgttttgttttattttattttattttattttattttattttatcttattttgagacagggtcttgctttgttgcccaggctagagcacagtggtgcaatcatagctcactgcagccttgaactccagggcttaagcaatcctgcctcagcctcccaagtacctgggactacaagcatgtgccactatgcccagctaatttttttatctttatttcttacagagacagggtctctctttgttgtccaggttcagcttcaagtaatcttacagcctcagcatcccaaagtgctaggataacaggcatgagccatgacacccagccaaatattcttactggtactttatattgtgtattttaatcagattgtctagtccttctaacagccgtgaaattagcaaaatggctggccatccaaatgcaaactgatacaattcttttggtaagcagattgacagttaggattaataatgtctcaaaagtttacagtctctgacctaaaatttttactaattggattctgctctgaagaaataatttatattcagagaagccttacacatatataagaacattatgtataatggtcaaaataaatattatcttgaatacatttataaatatttttacttatgaacatgtactattttcataacggagaaaaaataagataaaaggataacttaaggttggcaagccacagtgtatgccctgacagtagcctgtgcttctcctgtattttctaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgatgtatttgtggtcaacatcaacagcaacatgagcaccgcttatgtaggtacctttgccaggaccaaggaagaagccaaacagaagacagtcgagctaaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcagccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctgtagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgtt

SEQ ID NO: 38559 - DNA, 1371 bp, Homo sapiens
ccttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcggggtgagtgcgggtgccgcgcggaggttgtcgggggtttcttggagggcggagggcatggcttgggcaaaggctctcgacctgaaagaacgcgcgttcgggcgcagaactaaggggggcttgaatggaagagatggggtgggggagtgggacttcctgcctggtgctcgaaggcgggcacccatctgggtttttcccaaccgtgcaatccacgctggggcagagggagcaccttgagagcggcgcggggcagcgggtttggggttctgacgcaggagtaggagttcgctcatggagctggcccgaggttgcggtgtgtgaggttgagggatttcaggtgtgtcagtgtattgggcgcctttattaagcgggcagcgggtttggggttctgacgcaggagtaaggagttcgctcatggagctggcccgaggttgcggtgtgtgaggttgagggatttcaggtgtgtcagtgtattgggcgcctttattcagcaggcagcccagactccaggtgcgtcctgccagtgttgcggagactgggacttagggaggatgggagctgctccgggcgcggcgaaaagcgctaggcgttaataccttggttctcacagctacccacagaggggaggaagtagccagggaaatcgcggcagcgcgagagaagctgcttaactagaatgcagggatccccctaccctgacggccgcccctttcccccctagcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtaggtgggcgctgccggccgaggggcggggtgggatgggagtcagggccgggctgacggcggcctcgtccctggcaggtggggacgcacatccgcgccaagaggaagcgggaggagctgagcaacgtactggccgccatgaggaaagctgctgccaagaaagactgagcccctcccctgccctctccctgaaataaagaacagcttgacag

SEQ ID NO: 38560 - DNA, 3281 bp, Homo sapiens
cgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgct

SEQ ID NO: 38561 - DNA, 386709 bp, Homo sapiens
gacaaggaggaggaggaggaggaggtgagtaggctccgggctggggagccgcgcgggccagcggggaggcggggagcgcggcccctcccctcccctccccggcgcccgcctcgcggggccgcgctgcgcggagatcccagaggggcagcagcggcggctgcggcgcggggagccgggggcggggggtgtgggggaggcggagctgagagccgcgcgcttcccgggcgcacgcgctgcgctccctgcgccgccgtccgcaccgcgctcggaatggggcgtcacgccgtggcattttgtgccttctgcaaactggtcgtgttcgaattgcgtttttttggtgcctacatgtcgtgcgtgctggttttctgcggcccggcgctccgcttcttcctcgcgcaggctgagaggacgggtgggggcacgtcgccctcgcgcgggagaagggaggccgggcgtccgggttggcctgagttggctggggtgcttcgccgaccaccaggctgcccggcgcttggccccttgcagtgcgagccccaggccttcctgacggaaagcttcgcttctggctcctagtcgccctcagttaccagacctccccagcgccccactcctctctgccagccgagtgtgaagaccctcactgtgccccccaccccggaatccctcgtctgaggattaagcacataacttcccattttcatcgggatccagacaatcccattctgtccaggtggaaagattctctgaatttaagtcttgggaatgcagcagcgaaatttaacctttagtcccgaagtagtttttttgccttctctcgcacatacaacttttagagtcttctgacaactgtgctgctttaggttatcttgagattcttaagttaatgccttgaggccgtgtgatgggagtttcaaagagaaggcttttacagcttttcttccacctgtatcgcagtttgaaatggaaaacgtgagttgatgatgattttccatacgagatggatttcagtttgcagccccggctgccgtggctcacttggttatttggtgcctacccctgaagttgattttaaagcttaaaatagtggttaggtaaaggagctgctgaaaaagaagttcagtacaattcaatagagccattctattggcttctattaacgtgtttaaccttaagctttaaccatgacaggagtttcatgtaggaacccacataccaagtgaaatattgaattttaattagtgcgttccaggtctgacttggattagattcttctcggctcccactcccttttggtatacattttccttagggtcctgtactgtatttaatgaaacagttttagtattgaggattagaggagtacctcttgaatcacgaaactttctttgacatgcttgaaaacaatgaataggtaaaatctgaagcatgatacttgcaataaggtaggaaatagtaaattttttaacatcaccagtttgcaaaggttaagatggcttctttagtcttgatttgaaaattgtgttggcattttaatcttatgcatcacagaaatacagaattttcgatgtttaaggaacattaacagtataatccaatcccattattttatagagaaattaagaatcgaagacagtttcttgatgagatttagcaggagctgaatagaactagtagtcttcattaactaaacacttaactaggtaattcagacctcttgtactaaagtttgtttgattatggtactaaagtttgtttgattatggtatcttaaaaagccaagtaattaaatgaaatttttttccttaatttatgatttggacccattagattaaaatgccatgaattgtacatagttaggaagtatttacattctgtgagtttaaacattactttccagtgtttttgaattagcaattatcttgcgcttcaagaatcgattcatatttttgattcggatagcctacgtcacttccagcagattggtattttaagagtcttagagttatggtgtatataaaccgtggtttagtcatgtgtcatttaatgacaggtatgttctgagaaatgtgtacttgtgggagcatcatagaatgtactcacacaaacctacatggtatagcctacttcacacctaggctatatggtatatagcttattagtcctgggctacatccctgttcagcatgttaccgtactgaatactgtgcctaaacacacctaaacttagaaagggtacagtaaaaatacggtattataatcttatgggaccacagttgtatattcgatgttttgttgactgaaatgtcatgtgatgcatgactatcacttaggaagggaaatcctatcacatgtaataatctaattccagcacgcccaatctcgcatttcaaagtggacctcaagtgcatgagtcctgaagttcttgctgtggtgcgatgaattttttacatcccagagtacagtgtttagtgtagacatttagtaaatacttgttggcctgtgcgcactttcctggtaggcgcttcgtgaaagttcggctatgtcctactcatctgtgtatacctgttatcatgtgtagtgggtactctttaaatgcttatgatcttgttgggcttaatctaatttttgaaggtagcagagtgcctggaagtcctgaatcatgatatagtaaacttgaactaactcagttccttttttgtgttgaaccaggtacgctgttaggttgaattccaatattgaaagaggtagcaggtgtcagatactttagaaaaattgggagaagaaacttcacactgctaattttgttctgtaacttatgttagtcactctgatattgggaaagaacattattttagtaatagaacaccttaggtgagctaaaataatacaatgtttccatgagagcaaagtgtgacaacctgaattgagtgaccctctgactgttaccataggccacgttttacaattttggttttattttataaggatatgtttttcagcatatagacctttataaggaacgtaactttacttcagagtttggactaccttggcaaattgtcccaaatgatattttaaatagttttaggttgtatttgatatgttatgcttcttgttggtattacatgaagaacactgtgtattcttttacttatattcttacctcttcttttttttttaatatcagaataatagcatgttttttatttttatttttttttgaggcagagtcacactctgtcacccgggctggattgcaatggtgtgatagcagctcactgcagcctccgcctctctggttcaagtggtttcctgcctcagcctcctgagtagctgggattacaggaatgcgccaccatgcctaggtaatattttttgtgtttttagtactgatggggtttcaccatgttggccaagctggtctcgatcgcccgccttggcttcccaaagtgttgggattataaacgtgagcctctgtgccctgcctggttattttttaaaaaaaaactgaggaaaattttcaagtatttctcttggaagtacaaaccaacactccattctttgaatctccggagtaaaatttgggctgagcagatgcagagccaattccataggctgattcctagttgaacatgtagagtcatagaggtaatagctttcatagggacgtctttgaactactttctttttttttctttctactaatattactgaaagcagttgtacggtagagtaggatggtgtttaatttataggaagcaaatcagctcacatctgtaattgctggttctgatgtcagtcctagtctgcctggcctactcactgccagatcagtttcttctattcagaccgaagatattttaagacctctgtcacctacaacgggaaggatctggaattattctggtgccctgagcatccattgctcacaaaggtatgctgtctcactatatcctttggatgtactcagtttgcctgcaagattttcatttttaaagcacttttctcataaggagttttgaaataatgacaaacaccttaactaagtgtgtgtgaggcatctagaatatttcaaaatagttatagatggagttaggatatagaatcagacaattagtaagaatatctagtgcttttcccctatgctgtgtaggatcacacaagtcatttaaacagacgataattttttttgagtgtttaaaaaataaccagagccagatgtggtggctcatgcttgtaatctcagcactttgggaggccaagactggtggatcacctgaggtaaggagttcgagaccaacatggccaacatggtgaaaccccatctctactaaaaatacaaaaattaaccgggcatggtggcacgtgcctgcattcccagctactcggaggctgaggcaggagaatggcttgaacctgggcggtggaggttgcagtgagccgagatggcaccactgcacgccggcctgggtgacagagtgggactccatctccaaaataaataaataaataaataaccagagaagcaattccacagtcttttcttagtaacttataaatagtccatagaatttatgtttcttgggtggtttatttttgtattccaggtcctttgtggaactggaaccttgtcttaagcatgtttaggcatcctaacagcttgatctccctctccttgctatctcccctacctttagggggctgggacctattcttatccataggtaggtggttggggtcttgcagagccaagatcctgtgatactgttttctggactcacatcaccagattgaccctttagatactgagatctaggctccatggctgctataatttgaacttttttgagggtcagcttttcatttgcatgagggactctaggacaccctggattcatccagtcatgagttagaacgcctttcctgactagccagctgttggattctttgctttcttagtggagacacttaaggatgtctcccataaatcggtgatttttatgcagttcaatggtagctcgttatttttcaagtgtttaattttctgcctttttcttctcttagttttgagctttcatttgttcaggtattggggttctcaccaccccgtgtttaggttctattaatttgctggagtgacagaactcagggaaacacatttacttgtttattataatggatattgcaaaggcaaacagatgaagagacgtgtggggtggggtatgggggaaggggtgcagaccttccatgtgatctctgagtgcatctctctccaggaacctccatgtgttcagttacctggaagctctctgaactcagttcttttgggtttttgtgaaaactttatgacagcattccttcctccagggtatagaatgggatcctctgtgggttgggggcagggcgtgtctgtcttggggcaggagaaggtcagaggctttccctgaggcctaacacacccacgtcgtagcaaaagactggatcaagggctgtggtagttatgagccaggaaccatgcatggaatcttcctctctctctcatcttgctctctctctgtgtggtatatataaaataacatcacaggtatctattacacattcctcaagcaaggtcattatctgtctttacatctagatcatgtgtaccccagggttggaactgaatctgtccagttccctggaggtgtccttagcactcagtacatatagcaggtgatacatatagattagatataaatttctcccaacaataagttctgttatcagtgtgggaagccagtgttcatatagaagtttaaaattaattcaagaagcttagacgtttcattgccatcgttagtactggagagtctgtgtttttttttttttttttttttgagatggagtctcactctgttgcccaggctggagtgcagtggcgcaatctcggctcactgcaagctccacctcccgggttcacgccattctcctgcctcagcctcccgagtagctgggactacaggcacccaccaccatgcccggcttattttttgtagttttagtagagacggggtttcaccgtgttagccaggatggtctcaatctactgacctcatgatccgcccgcctcaccctcccaaagtgctgggattacaggcgtgagccaccgttcctggctgagtctgtgtattttaaattgtaggcatatccatgtaaaaaatggcatcagtcacctgacaggacatttaattaagaagaaaagttatataattttcactatgttgccttgtaaggcattggagatttcagtttttcatgaatttgattaatatgtatatatttcttacaattagttttattatgaagaagtgagtttaatggccctatttttgttcattagtaattgtatactaaagagtaaattctcattaaaaggcctttaaatgcctgctcataaagaagacagacctctgattttgttctctatacaatcccagttattgttttgaggcaagtcatcaaactctttagtagtctaaacctttaatttggtttcagaacagtagtcatgtattgaacacccaaattaccatgtctgtaacaagtaatgcaaacactccgtattaaaaatgcaatgactgcaactgtttttgtaaaatttcttgtgctaattttttaaagaggacttttgaattaagtttctcatgaaggccaaaatcttatacttttaatggtagtggagtgtgtgtatatgtgtagaggcgagggggtggtaatttttgcagtggtatttttaagtggacagtttactaattatgttgaggtaaacactttacaactctaaaaggaaaacttcaattatctgaatgaaatgaggtacatgaaattaattcagataagtgggggaatctttggtgtaaatgatgcatgtcaaggtacatgacctcaatcttgattttttttttttccttttttctttttctatatatctgttagctgcttacgagattgtgattcttttaggtcatgttaggaatcattgatgggggaggcaaagttgctctatagttttgttttttctttgctacacaggaatccagagtgtggtattctgtgacgagtataattgctcatctctcccctgcactgcctgctgttttaggtggtacaccacagccttccattttgtcaccttcctgtcaaaagtgtgtgtgactccttaagaatacaagttgtttgaaattaaagccacactcctctgtccaatctcaagatgtttataattcctaaaagttgagttacagcaggttataaaagatatgggattgaggtagatgaaccgtgattccttctctgtcctcctttgggtttaaatattaagcagctatcttgtagtgtaggcccttaaaatagaaacaaagggttggggcatgatgcctagcctttatagatcctaacttgaaatgaaaattttatggattgattagagttttaggagaatgattatctgctgcaaattactaaggtttgcagcattcctgggctcctggcatctgaaagctattgtataatctgtggagagcctgttaggtgtgatgacgtttgtcttctaggctttttttttttttttaaatggaagcaagcatgtctcagccacagagatgtgtactgacaccttataagtgaatttacttttttctttactcaaagcacctgaaaacatggctctttattttcagtgtgcaccagcttccttttcacctcttggtctttaagatacaaggtgattcatatcttgattaccttgggtaggtgggtatgatatcagcaagctctgtgtccggaccttgtgagcaattcctaggtcattgcctgaggccttcttaaatatatgcaggtaatgtgactgcagattttgggtttcacagtcagtccagattgattttgactctgggccatttatgagcagcaagcctttgcggggagttagtaactgctccgagtttcagttttctcctatctgatgggggggattagtcttttttagtgttatcttttttttagtaacttagttgtattaatctgttgtcgtattcaaatggtgtgaattaatgaactatctagagcatatcattttaaaaggaagtaggttttgtactatttaaagacagaggtaatcaaattagtaaaaatctttccaaatagaggtcttactcaattgactttaaaactgtataagactcttgtagttatcagtttatttatatacaaataatacactcctgcgtggtatagcaaggcagagtatgtattgtattctgtagtcagacagacttgtattggatgattcatcactttccacttcggtaaccttgggcaggatactttacctatttgattcaaagttttagtctgtaaaactactaatgaagatttaaagaatagagatgtaaagaacaataaagggtaataaggacaataaaaaggtggttgtgaagacttaagaggaaggtatgcaaaatgcttggttatgcctgaacccaataaatactgatagttgctgttgtgaccttggacaagtaacttcacctttcttcatcacaggtttccttatctgtagcataagtatacagctaactaataggtttagggtgaggattaaatgagataatacatgtaagtgctcactaaatattaattgctgttgttatataaacaaattagaccaatttttgagttcaagaattcatacacatatttagtatatttattatatgggggatattcactgtggatttggggatggtgacttattcatagcttttagtgtttccttaagataacagttcacaaattgtggcgtacaaatccctagggatcactgagaccctttcaggagtgtccatgaggtaaaaaccattatcatagtaacgctaactttttgccttttctactgctttgacatttgccctgctgttgtaaaagcaatgatcgatgaaactaagcattctagaaattaaatggcagtaagacccaactgtacctagtaatcatggtattcttcacagctgtgcattcacagaaaaaaagaaaaagccactttcacttaagaatgtccttgaagaagtgataacaattgctaattgattaaattttgacccttaagcatactttgttttaatatttgctgtgatgagatacgaaatgtgcaaaaagcatttctgctgcatatccagagtacattgcctgtctagaggaaaaatccatatgtgatttttctttttgagttgctagtgaaactagccaaattttgcatgaagcatcatttttacttgaaagaatgaataccaaactgtgactatttagacttagaaatttggcagtcattttcttgaaaatgaacaaagtgagcctgtcacttcaaggaaaacaactgacagtttgttgccaatgataaaattcaaactttcaagtgaaaattaaaattttagaaagcttgtgttacctgctgtgctattgtcagcttcccagtacttaaaagattttcctgatgagatgatgggtggtgatttttatgaatgtgagtttttgctattatatgatgaattgtgtcaagatttgtaatatctgtataactcagtgagccaatattttcaaagggaccagtgttacaaaattatgggtgaaagatcttttcaaaaagcaagtaacagaatacaaagagttcatatatatgagattccatatttcgactaacccttaagaaactcctacttgtcaagttttggtgtagtatcaaaaaagaacatctacaattatctgaatgggctattaatacatgtgcttccgtttcactacatatttgtgtgaggccattttttttttcatgttgctcaatcaaaacaacatagcacaacagattgaatgtagacaccaatatgagaatccagctgttttctattaagctaggcatgaaagaaatttgcaaagcttttataacaacataattttcacacaaagcttttttgtttttgaaagcttttttctgttttgaaaacattttgttttcctaaaatgtattgtcttattacatatgttatcttactaagtttttaaaataaattgataaatacttaaactttttctcatttaatttctaatacggtgaatgttgatcattacaagccacataaacaaaagctcttgggagtattcactaatttttaagaacacaaagtggtcctgactaaagagattgaaaactctttctttaaggaaagaaggccagattcatcaaatgaacaaagttctgaagttttaatcatttgggtattcctttggaatatggacttaacatgcctctagtttctttttctggttataagaatgtatcagtggactactgtgacattttccaaatattcagagggtaagaaggtttttgtttttaaaatggatgctacctatgtggttgccataccaaattgagatacagttaatggtcattcttgtcagcctgttcacacttgataccactctattggttgtgaggtatacctgtggttttggagctgttcaccatggcagattacttcagggttgtagtgactctcactttacagaagaggcaggaggattgcttaagcccaggaattcgagtccagcctggtcaacatagccagaccccatctctacaaaaaatttaaaaaaaaaattagcccggtgtggtagtgtacacctgtagtcccagctacttgggaggttgaagtgggaggatttcttgagcccaggaatttgaggctgcagtgagctatgattgtgctgctgtattcagcctgggtgacagagtgagactctgtctcttaatcaaataaacaaataataaaccaattttctttgaagtccatacgctaatccgtcctgacatttttaaagctattttctagtaccgtcaatctacaatttatgactgcgtttgtgaattaactatctgcaacaatgtaatatgaattacagatgggttctgtagtgccattaatagtatgagtgtttcagcctcattatggactaattaacatctttttgtgtggaattatacttttgacttctagaaatctagccaaacacattcctccattgcagtccagcagtggcaggaaactcttctttttccctcacaacagaaacagggttgttaaagctttagtgacagcaagagaggcgttttgaagcaatgctcaagagacacagatatcttgggcatcccacgtgggtggtgggtgataggtaacgctttcagatgaagcaagtatagaaactttgggccaactagcagtgttggagggaaaaaacggatattctggatactacttggttgtggggggtgatatattctcttttggagcagatgctaaaacataagagatgttttaagttgggtgtttctaagttgggaaatccatctatatagataaaattttcttggtctcttgttatatgaactgaactcaaataacaaaaagacaggccagttgggaatgttgaacaagtctttggccagaagtttcaatgtaaaatgaaagtgatgaacttcaggggcaatcataaccaggaggaacagtggaagccaagaggagtgttggaatatgcagactgttcacaaggtgcccaaaacaaatccaccatgcaggatggctgttagagcaggcatagaactgatgatcagctggcatagttcaaagaatgccgtgactcagccccttgcccacatgtctttggcaggaaatactgccagactagactgatgtctagtacaggaagtccattacagagaatggttgatataaagcagaaattcagaaccaggagagtttggggacatggagcaggccaaagttggagaactggaatttgacctgaaggtgagctccttgtcctcttcctgcccaaagtcaatattaaccccttggattgaggcaaaactgagccaaaagggagaccaaagtgactagagctgtctgcattgtagtaacaggtctggccaaacaaatacttgttagttgaatggatagaagtaagacagggaaacattatagtctttccacttaggttcttcatgtgacatacactaggtatcatgttacctactcaccaaaaaaataatttaggccaggggtttgcaaacttctccttggaaggaccaggcagtaactattttagtctttatggaccctatggactctgttgcacctactcaagttggccactatagcctgaaagtagctgtagaagcatacctaaatgaaagaatatagccatgttccaataaagccttatttatggaagtggaaatttagcttcatataatcttcacatgtcacaaaatattagtcttcttaaaaaatctggtttttcaaccatttacaaatataaacccattcttagatcatagatatacaagaacaggttgcatgccggattttagtgcccaggcaatagtttgttgacccttttcaggcaaataaattactatcagtcatgatgctgaaagcttagcagtgctgaaatagatgttttataggacgatgctgttggtgacactgtcttattttataggtgacactgatgataaaaatccatccaagaatttatatgtgacatctgcagcaggttcaaatctctcagctatgagacaaactggatacttcctaaggattgccatctattatgcacagagagccaaaatccgttactgaaattgtctgggtgagccgcctgctgggtccagtgatgcactggtagacaaaggagttgaaaaagaagtgtggcatattctttggatgactggcagagtgtgacaccagtatggcaccaagccctactatgattccaaggacttcaggactaaaaatatatatatatataaatgaaaaaaaattttggtggtattggttggtgtggttgaagtaaatttgagctttacttggggaatgtgtattatattatcattccataatgtaattcctttggtaatcaagctttaaagatcttatatctatgaaactcatatagttatcaccttttagtattgggttatctcactgtaagggaaatacagtaaagaaaaacatctgttgactaaaagggttaatttcaggactatgattttcatgtggaagtgtttgcctggaggattcttgaaattttgccttcatctagagtatttaaaatgtttctatttgcaaaaagctattatactcagaattttctaggaaaacatccttttcagtggactcttcaatagtaaagagtcacactgtatggtgttagtgtccatagaacagttgaattcataaattaatatttttagacctatcaactaaattaaattcacttaaaatgatttggcaagcaggtatgaactgaaaataaacctatgtatttttgttttttagaagtattgaatcagaagaaattggaacatcaaagtattctctgaaccaaattgatgttttatttggttgagagtccttacttttggtatactatttataccagtaatagagtatttgaaagcagtgctgggaaatgaggtgcatggattctctcaatgttgaatcccatttttttccctcagtgaatcttcaacatttttaaatcttagcattcaacaaaaactctacagcctagatataaaccatagattactttttatatagcatatacagttcatcaacaaacagtaaagtttccttcatgacttaccttgaaatctttattcaaaggatatactattcaatttttcagtgtgccactgccaccactgcatgtttttggtcagagtgcagtgcaactaacatcgccatcctgctaggaaaaagatctgcaggttgctggatagtggaagttgcacacatctaatttacaagtcagattagagatcagaatcttacaatagctttatgtggaattgatttcatttcatggtttttaagctgttttttcattgaagcaatgcctgtaactgaaagacaggtgtgttgtagcatttgaataccttaaactcttttgaatctggaatgaaagggatgttctggattctaaaactcagagattttgaattaaatgccatcattcatttattgtgccataattgaactaccttgagaactgaatttggaattactgtgattaatatttggaaagctttgccattttcaaatacaagtcactttaggaaggaccacaatttgtgtgtgtgtgtgtgtgtgtgtgtgtgtgtgtgtgtgtttatttaaatagagcagcaggcacctttttaccttatagataaggtaaatttaataagaaatacgtggtttttaacattgatatcccattctatttaagaagtccattgtggcctttctggaggccttcaataaggggaaagggacgatgaatagaacactgtagattgcagtttatgtttttccttttaaggcaaaccattttcaaaatataataatgccaatgaatacataaatatagattgatagtttgaagttattttaagtttacctgtctatattaaaattgagagccatctcataagagtgagtataaaaaagttgttcattttagagtgcatagtgccatttaattgaattagagaacacagttgcaaaaaaaaagcatcttttagatggttcttgagccattaattgatttattgaatataatcaagaagaaaaatccagatgtttaaaactagttttgtatcaggtcagaagagtatttagctttattctcctccactcccttgtctgatgagttctcataaattgctttctgaaatgacaaaacattgggatttggaaagccttgagaattcatcagttttatctttttctccagtgttttttacaaaggacccatttagtcgtgatatttataggatatgaggaaggcagtgatcctggcattcgtggactccagaaaacattttggagaaaaattaatgtaaggtaagggtgtagtaggtatacattgctgtattcattttattgtcccttccttccttccttccttccttccttccttccttccttccttccttccatccttccttccttccttccccttgaagatcttgttgcataccaatttattcattttagtatagcagtgactatttaaatgggtccctttctaaccacctttccctccaacctcaaaatccctggttaaaatgcttttctttaaagagagtcagaggtaattttttgaatggagaaagtgaggctattccagacattgggaaatgagtggagtataaaagggagaatgagatctaaatgtgttgtgatagatagtaagatcatagatgaacactctatttttggattgaaaagggtgctagagtaagtatatcaatggaatacagtggcttgttatcattatgaactgtttagtaagtctccagtatgccagacattgagtaagacattttgcataaattctgtctttccaaaatcttgaaacaggtgcaactatcccaatttccttatgaggaaacaagttaaatggtgtatacaaagtcttagagtaagaattgaaatagagaatcatacagctagtggctcattttgtgcagagaccttttctttctggtgattgtctgataagttattagtgaatagaaaagaaatctgaaaggccagcatacatgtagggagattttaagattaacagcttttaacacgaatgacttcatgttagtgttgtagaatgacattggagccttcttgagaagcagtgacatatttgcgaatattgtatctggacactagaactcaaccatctaatgggttgcctttattattagtaaagtattgtatagctgcactttcaggtgtaagtgatgccatggtacaaaactcatatacggagggcaggtgatcatgagctaccaaagaaactgctatatatcataagctgaattggatcacctccaaatagaatctgtagaaaagtacttgaaagaggactggttcaagcagtcatctgatacaaagctgactaccaaacattttgggatgcagggatgataactggataatggtatcatgaagctcattaaaataagaactgtaaatgtttacaggctttacaagcagatatatgcagctctgtaacaaaatatcatcttcttggaaaggacccatttggttaggaacaaggccttagcagcagcgttttttttttttgagatagggtttcactctgcccaggctggagtgcagtgatgtgaacatggcttactgcagcctcaacctctgagctcaagcagtcctctcgtcccagcctcatgagaagctgggaccacaggcatgtgataatacccagctaatttttttagtttctgtagagattaggtctcgccatgttgcctaggctagcatttttaaatacaaaaggcaactgtgcagtagggtgttggagtcagatgatctggttatgttttttgagatatagagcaaaatgatgtgggatatttggctttgctatttgtcccccagggggagtgaagtaaagcacagccaaggtgatagtgtcatggcagagcttaaatgtgagtactgtggcaccttggtgtgggatgtggtaatgaagacaggacaggtaaaaatgaatgaaatcatgaactcaaaatgttagagtgaaaaatacttttctaattgtttgaaaatacagaaaagtaaaaaggcaaacagatcataggcaaacaaataagacagttggacagaggtgagaagtaggagggctattcaagagtacaatagtcctagaaagtttttctcaaagagggagacgacttggaaagagagagcagaaaagtgatttagaaatagatgttactgaaatatgtgagtgagctgctcaaagactgccaggagacagagaaaatactggataagaaggaacaagtgacctttaatatgaagttgtatttctatcttatggtggtcaaaggtgaccagctagttcaggtaatggcttcccaagaaaagacatgctgattgttcccatttgttctgggaacatttatggatatttctataggctggacttatccttgtatcttatgatactgggtgacttggatttctgatttagaatctgacttaggctataagtttgttatgattattatccatattattttcagcttttgggcaagagattacactttaactggctatccttgccatcctcgagaagtaaggtatcagatgtgactttaaaaattaactttatgggccggatgcgatggctcatgcctgtaatctcagccctttgggaggctgaagcgggtggattacctgaggtcggagtttgagaccagcctggccaaaatggtgaaactccatctctattaaaaataccaaaattagccggggatggtggtgcgtgcctgtaattccagctacttgggaagctgaggcacaaggatcgcttgaaccctggaggtggaggttgcagtgagccgagatcactccactgcactccagcctaggcgacagagcaagaccctgtctcaaaataaataaatacataaaaattaaaattaactttatggagtataatttatgtccaataaagtgaaccaatttttaagtgaattttgacatgtgtgtacacccatgttaactatcccactttcaaaaaatagaacagtttatcatccctaaaagttccgttacgcactgtttctatttatttatttatttgagacggagtcttactctgtcacccaggctggagtgcggtggcactatctccactcactgcaagctttgcctcccgggttcacgccattctcctgcctcagcctcctgagtagctgggattacaggtgcccaccaccatgcccggctaattttttgtattttttagtagagacggagtttcactgtgttagccaggatggtctcgatctcctgacctcatgatccgccagccttggcctcccaaagtgctaggattacaggcttcagccactgcgtctggcccccttaatgcactgtttctatcaggccttccctttcctcatctccccacagacagctagtgttctgatttctatttccatagattaggttagcctgttcttgagcttcatatatatgagatgatagagtatatacccttttgtatctgacttcttttcctcaacataatgtttttgagattaatccatgttgttgcatgtattagtggttcattctgttttgttgctgagcagtgttttattttatgtaatttgtttaccattcttcagttaatgagcatttgactgtttttctatttattggctcttgcaaatcatatcactataaacagaatttttgtataagtcattttatgaacatgtattccattttctctgtgttaaatacctgagtgaaattattctttgataggattgctatgttttaattttataattatatatataactttatatgtataacttttcctaaatggttatacccatttctaccatgcattgttagttcaagtttgtagatgtctgtattttgtaccaagaatattggtttgtactaaatgatttttacaaagccagagagcctgtaggagtattcttcatgtaatagctgaaatctagtatattttaaagatatatctatttaaaaaaaaaaaactctaatgataataagattgattaagtatatatgaaattattgataagtagatatgcagttattgacctggttggttgcacagaatttttcattttcattttgcaggtagcatgttttaatctaaattctaatgtggacattttccattgtaaacagttggctcttcatgaaatgtatatataattaaatatgaataatactaatctttaaggtaaaatttgtatgaccagatgaagaatctccttttttctttttccttgatatgtttagtcagtagctttccccctcatttttttgtaaatctgtatttcacattgagttgcttaaaatgagaggtctcataataggtaagtggtaaatgtaggggaattatacacttttgataatagaatgatgactaggaattgtttgtttcagtatttttgctaaagctccaaagctgaaaccaaagggtaataagtaaccctgctttctaaagagggatgtggggcttagtaaaagagaatagacttggttcaccctcaacacctgtttcccgcatataggagaaattagaagagagattaaaagtgtcattccgatggagctgttaatctagtggggagttagttttgtgacatttccctgtttctccccaaatggaccttttttttccagcccaggatttggatttgtctgccagaagtgtaaattgatatgtagtttgtctggatgtttaatgagctgcagaatcttgtttccttgtgctgcagtggcaccttccagagagtttttgagaaaacgtgatcatagtcccattttcacactgctataaagaaatacctgagactgggtaatttataaagaaaagaggtttaattgactcacagttctgcatggctggggaggcctcaggaaacttacagttatggtggaaggggaagtaggcacatcttacatggtggctggcgagagagaagggtgagtgaaggaggaacttgccaaacacttgtaaaccatcagatctcaggagaactcactcactatcatgagaatagcatgggggaagccaccccagtgatccagttacctcccactgggttcctcccttgacacctggggattacaattacaatgagatttgggtggggacacaaagcctaaccatatcacgtaacatttctgagagttgggagcacacttgaacatagacttgttcctggaggggaggagaatgactggcgtcagtcgagatggcatgttgagtgagagagcagtaggtagaggagtctgcatgtgtccatcttgtatggttaagaaggcatgactttttttgtcgtgcaagtggtcatggtgggaggtaaccagacttgagttatctggatggatcctgccaaggagggctgcttgccatgtgaagggactgtgggcgggataatgggaggttagcctaagagtgtatttcccagctgggtgtagtggctcatgcctgcatgcctgtaattccagcactttgggaggctgaggcaggaggatcacttgagcccaggagtctatggccagcctgggcaacatagtgagactcttgtctttattcaaaaaaaaaaaaaaaaaaagaatgtaactcccacaataggggactatgaaagatggaagggtcacctttttgcttgctgtaactgatgacccctctgctgtgaagtcacttgagagtgactgagaaataatggaatttatctggggttttgagagatggggaagtgagatccagagaaatatgtttgaaagcatatattccattgagttcagttcacttgaccagttttttagttcaataggatttttgttcagttgaataaacctttagtaagtgcttaaacagaatatgtaaggtactgttctaggcatttcatgaaaggcaaagatggctgtggtgttttctgtcctcagggagcttctgctttagtgtaaatagctgaagttaattcatggcagaatgacataggtactttaaatgtgtaagtggcagtactatgggaatttggaaagaacagtgaataccactggggttcagaggagtctgtggaggaggccaactttgggctggatcttgaaagaacaaaaggatatcaagtaggaagagaggcattctggcatgagggaataaacaaagccatggaaatgggtgactgagaagtaattctcattcacactggaaaatgataattttactttttaaataatgctttcaaccatcaattaagcttgcttgcccatgttataattccagttgaatcttggtatttttatgtcatctttgcagttctctagtgatgcgcaatgtgtcttcctttatgagctatagcgtgcattatcaagttggaaacgttactcactttagtacctggatggttataagcatcaaaaccaaacttctaagtctaatcacaaagcctattactttccctgatttaaaacagtaaaatgtagagaagatgatgatttttacatatcctaagaagcacttggcagagcaattagtttcataacaagtgattgttttttaaagctctctctagaataagaatgagtatcttgatgctagtgtcacttttaaatagctatggctccaggaatgtgtctgttcatgttattatcttaaatacacaccttatctatccatattgctatacttcagatgtgaaagtgaaaataaaggtgtgaagtgcctagcagacttgtatggatttatgtaaatcagaaaacacacaaacaatccattagtctcagtgctgaagccctgatatattaaaatcaaatatggattatttcctaaaaatttcacgtacacacataccatcatatccagtgatttacttgccaaaaaaaaaatctttatttctttgaactctagacacatatccagctgtcttatgacatctccatatggatatttaaaggaatataaatcttcaaatacttaaaactgagctgatctttttacccaaacttgtttcatctttaatcttcgccatctaagtccattggtgttactcaaaccaaaaacgttggagtcatccctgactcttctttttctttcacattcacagtttgtctcagtagttcatgttaactctaccatgaaaatatatttagaatttgaatcttatcacctttcactccctctactactacctggccaaagccactgtcatttcttacttggattattttagtagcctcttgactggtctctcagctttttctcacaacctgaaacccagcacatcagtctggtctcaatgcagtatccagaatatttaggttaaaacaagttaaatcctgtcgttcttcaaagcttcatttgttttctttctcacttaatgtaaaaggtaaagtctttgtagtagcttataaggctgtatatgatattgccccctttgcaacctcttttttggactctctacctaaccttcattcatacctcagtttttgactccatttactaccccccattcctgtttgacaccatattgtttctggaatagctggccttggggcttttgcgcttgctgttccctctgcctgtaatgttcatcccccaggtgactgcttaacttattccctaatctttcttgggtcttgagatgttgcatctctagtgagaccttctttggccatcttatttaaaatgtccctctccctgcaactactttatgtttctcatttgctctttgccagatgaacttacgtatattttgctttactttttatgacctttttctttcagaatgaaagcttgatgagtgcaaagtattttatgttttgtttactcctgtgccatcagacttggagtcgtttctggcacacagttggcacttaatgcataattgattgaatgataaaagacaatgaaagatttattacctaggggttaaacctgtagttaggttgatttgtcttttattgtatctttggggaatgatgctatttccaaatggctgaatgttacttctttttaattaaatcatatttattggtataatttgcatatagtaaaatgtgcttattttaaatgtacaagttaatgttttgacagatttacacattgatgtaactactactacaatcaaggtacagaacatctccatcacttcaaaagtttccttgtgtctgtttgtagtcactcctccctcattctcatctccaggcaactaatgatctgatttttgtcactgtgaattcgttttgcctgctccagagtttcaaataaatagaattatacattatatactctttagagcatgatgtttttgaggcttattatgttattgtatgtgtcattagtttgttcctttcagtaaagaatagtgttctattgtataaatgtgctcacaatttgcttatccatgtatctgttcatgaacatttggggcgtttacaggtttttttgcctatagtgaatgacactaccatgagcattcaaggtgcgagcctttgtggaaataggctttaatttttctgggttgattactcaatagtaaaattactgttttatatggtaagtttatgcttaactttgtaagaaattgctttgaagaactattttcttcagtgattgtatcatactcactagcaatatatgaaaaaattctagttgctccacattctggccagcacttggtataattcttttaaattcagacactctattgggtgtatactggtatctctttgtggttttaatttgcatttttctgattaccagtgatgttgatattttcatttattcattggccatttatataacttcttttgtgaaatagctgatgaaatcttttgtccattaaaaaacgttggattgtttcttgtcattcagttacaatagttctttatatctttgtatatctagatacaagttcttgttagatgttttctcttggtctgtagagtaagtgtagtttatcaacattttctttggtggtctgtgctttctttctttctttttttttggtaatatctaagaaattgttgttgttgtttttttgaaatgaagtctcgctctgttgcccagtcaggactgggattacaggcgtgagccaccgcgtccggcaaatgtctaagaaatctttgattaataccaggttgtaaaagattttctgtgttttctcccaagagttttacagttttggcttttacattaggtctctgatttgttttgagttaatttttatatatagtgtgcggtaaggatcaaggtttgttctcttctatatccacctgttcttttcctttgaattaccttgaaattttgttaaaaatcaactaatcatggccaggcatggtggctcacgcctgtaatcccagcactttgggaggctgaggtgggtggatcacaaggtcaggagttaagaccaacctggctaacatagtgaaaccccgtctgtactaaaaatacaaaaaattagcctgctgtggtggcgggcacctgtaatcccagctactcgggaggctgaggcaggagaatcgcttgaacctgggaggcagaggctgtggtgagctgagattgtgccactgcactccagcccaggtgacagtgcgagactctgtctcaaaaaaaaaaaaaaaaaaaaaacaaccaatcatatatgtgtgggttttttcctgggtgctgttatattgatctatatgtctatcatgccaacataacactgtttgttcagtagtaagtcttgaaatcacatggtttaagttctttttgttcttttttgaaattgttttcactattctaagtcttttctatttccatatcaattagagaatcggcttgtacatttctacaaaatacttctgggaattttaatttccattgtgtgaattcagtggattggttggggagcattaacatctaaatgattgaattattctaaaccatgaatatagtatacctcaatttagttattctttcatttctctgagtaatgttttgtagttttcagtgtgctaatctcttgtgtcttttattaaatttgtcctaggtgaataggacgtgaattatatttctgaatgccattgaaaatgctatttaaaaaatttacagtttgtcattgtttctatacagaactagaattgatttttacatattgaaccttgataatgtaatcattaatgcttttgactttttttgtgtgaattcctcaggatgctctctatatatgatcttgttaatcacaaataaagacagttactcctatccaatattagtgtctgttacttctctttttctacagcacagatgaggacagtgttaaagcacagagtaggacactgtttacattgcacagactagtgcagtgttaaatagaagcggtgagagtgaacatccttgccttgtttctaatcccagggaggaagcattcagactttcactgttacgtgtgatattagctctaagttttttgcagatgtaccatatcaggtagagcaagttcccttttattttaagtatactgaaagcttttattatattgcatgtgaatgttgaatgttttcatatttttttttgccatctatagggtgaatcatttgtattttcttttttttttttttaattgttttttttttttttttttttttttaagacggagtctcgctctgtcaccaggctggagtgcagtggcacgatctcggctcactgcaatctctgccttccgggttcaagtgattcccctgcctcagcctccccagtagctgggactacaggcgtgcaccaccacgcccagctaatttttgtgtttttagtagagacgggggtttcaccatgttggtcaggctggtctcgaactcctgacctggtgatccacccgcctcagcctcccaaagtgctgggattacaggcctgagccaccgcgcccagccatttgtattttcttttaacacttgttaatatggtgaattgaattgattagattttgaatcttaaacctgtctttgcatttttatgataaactccattttttcatggagttttatgttatctatggaggatatattcttttactatgcaaaatttgatttgcttaattgcgttgttgatttgtggatgtgtgtttatgagacctattagctttttttttctggggggctcttatggactgtgtgtgttccctcaaaatttttaggttgacgtgctaactcacaatggtattcagaactgaggcctttgagaagtaattaagtttaggtgaggtcatgagggtggggccctcttagaagaagaaggaaaaactagagttcactctttctctttgatgggagtacagtgagaaggcagccatctacaagtgaggaagaaggccctcaccagctaactgaataggctggcatttcgatcatcccagcctccagaactgtgagaaataaattcctgttatttgagccacccagtctatatcgtattttgttatagaaacctgagctgactaacccgggagtagggttgtaatgtctttgtcagattttggtataaaggtcatgattgtttcagtagatgcagaaaaagcatttgacaaaatctgacactttttttagtgataaaatactctaagaataaaaaggaaatttcctcaacatgggaaagggcatctatgtaaaaaccacagccaacatcttaatggtgaaagaggaacagagcaagaatgttgctttcactattcagttttgtattggacattctagccaagacaatttgtcgagaaaaagaaataaaggcatccagatgggaaagaagtaaaactatctctatttgtagatgacatgatcttctatatagaaaatcctaaggaatcaccaaaatgtattagaattcataaatgagatcaacaagcttgcaaggtataatagcaatatacagaaatcaattgtatttctatacattagcagtgaacaaaaatgaaattaagaattccatttataattgcatctagaaattaagaaaataagcggtaaaaaaatggtactctgaaacctaccaaaaattattgaaagaaattaaagaattagacatcccatgttcatggatctagatgacttaatattgttaagatgtcagtattatcccaaatgatctacagattcaaggcaatctcagctgccatttttcttcttcagaaaaggcaaagctgatcctaaaagttacatggaaattcagggtagtcagaatttttaaaacagctttgaaaaagaacaacaaaagtgaaggagtcacagttcttgatttcaaaacttaatacaaagctacagtacccaaaacagggcgatactggtataatgatagacatataggtcactggaatataattgaaagcccagaattaaaccctgacttttatgttcaattgatttttaaagggtgtcatgacaatttaataaagaaagaatagtcttttcaacagatggtgctgggataactgtgtatccactagcaaaagaataaagttggacccctttcatgtactatatattaaaatattaatgccaaatggattatggacccaaatgaaagaactaaaactataaactcttaaaagaaaacataagagtaagtctacttgttcttgggttagtcaaagcctttttacaagacaccaaaagcacaagtgacagtagaaaaaataaatatgttggacttcatcaaaattaaaaactttatactttaaaagacactatcaaaaataaagtgaaaaaaaccaacacacaacatgcaagaacatatttgtcagttatatttgtgataagggacttgtatccacaatatataaagaactgttacaattcaataatcaagacaattcaaaaatatgaaaagtatctgaatagaaattttccaacagacagtaggcatatgcatagatgctctcagtgtcatttactgttgtgaaatgcaagtcaaatcagaatttctcatctgcgtctttgtattttaaattataaataaagtttatatttacctctggaagttctactttttaaaatagcttttatttattattatgttacatttagaaataaattcttctgtaatcccagcactttgggaggctgaggtgggaggcctacttgaggccaggagtacaagaccagcctggcgaatatagtgagatcctgtttctattaaaataattattaaatacattgtcaagtactgttttagtatattcattgtttagtgtacttgctatcctggtatgtttgttccatcatatctgttatttctggatctattttttattgactgatttttgtcttagttatgagtcacatttttcttctttgtatgtctggtaatttttggtttgctgatggggattgtaaatgttgcattattgaatgtcttgattttactgtcttttaaaaaagagtttcagttttagcaggcagtttacgttctttgtgaatcagcttgatctttttggggctagttttgtttgttaggattgttttgagtatcctttactatagaggaggtaaattaatagaggaggtaaactatacagaggtaaattaatcttatttctaaggtgtgattcttctttatcctctgctgaatgctgtgcatggtcaacgaagtccgtctactcttctattccaaatctgcctgtcttccaggcttctgtgaccttttggaagtgttgttattgttctctcatatttgttcttttaccagtctcatggaatcttagaatattcctcagaagagtacacatggaacccttgtgtagacatgtggtgctttccctcttcttagctccttttacgtatgtactgtacacttataaacttaagctacctcaggcttcctaaaactctgatatctgttcccgcgattcagctgaaccaccatgtacttagtgtctcccaccatgatgcagagagtgcctccaggcagaaagctggtgcaatcatagggtttccctttcttttagggatcatagttcattgctgccattattgtctactgtctgaaaatgattgttttgtatgtttatcaaattttctggttgattatggtatgaagtgggcaagcctggtgctagttaatcaaagccagtattggaaatgccctgttactccctttttagtattgaaatttaagaaaaaaataaaagtttttgcatgtatctaagtgttttatttatacatatctcatcacaaaaaattgttgaacattttccacccttttcttgatgacttctcttttaattattttatgatgcagacttatgtgctttagacttttgaaaatactcctctcctagttttcctaatttatcttttcctcctccagtattttgtccatattgaggccaatttcagttttcagtggctcccttattccctgaaacaacctttttttaaataaatcatcttcattattcacaaaaggaggttttaatatttaaccttggtacttaagggcctgtccagtaagtctcctgtctgcatattctacgtttttatacttaacatagtacttcactgccttggccagcattactttactagcctctgtttctttggtaataccgtttcctttgctgaaagcctatcttcagtgctctctgtgaaaagcttcaccattcttcaaagtctctcatttctttattgtggtgcttttcttttctttttttttggagatgagtttcgctctgtctctgtcacccaggctggaatgcaatggtgcgatctctgctcactgcaacctccgccttccgggttcaagcaattctccttcctcagcctcctgagtagctggcattacaggtgtgcacaaccatgcctggctaatttttgtatttttagtacagacagggtttcaccatggtggccaggctggtctcgaactcctgacctcaagtgatcccccccgcctcggcctcccaaagtgctaggattacaggcctgagccaccatgcccggcactgtgcttttcttactaggatctagttactggttacagatactagttttcttactaggttatagttcttgaatatttgtcaaatactccttactactttgtaagcccatcaaatgctgtactcatctttgattctgccataggccggtgttctgactggcctagaagttggcgcatagttgatgttctgtaaatacctattgaatattgactgaaacagcctttaaaatagaaattatagataaatttggcaggtgtatcctgatcttccgtgtggctttttgaggtaataagtttatggtacgagtgcactgtctaagtatcatgctctcctaagatacacctttctgtatggctgtaattctaagttagggaacagatagaaataaagggtctgttcatttcatctgtgtagtgttcagtaaagacagggagattgctatgggcaatctattggttaccccacttgttctccagtgtaatcgatatctttctttttacttattttatgactcttctagcttaatatcttttagtccacagacatatatgtgtgagtatatatatgtatataattatatatatatataattgaggaaaagcagtatttgtggtggcatggggtaaacacaagtaagccctcaatgactttggtagacagatattttctgtatgccctaagtgtggagatgagtgccattgtaggtagaggaggagcacttggatgtgtggtggccccttaaggttctcagaggcttatagctaggtgtgtaagtcagggagggccaaatgtgctttgcctagcacaactttcactgactgagcagtctattttcagatagtccttcagataatgaaagttgtcattgcttaattttatacactcttccacttatttatacctactgccatttactgaggtcatcccttcaaaaaatatttcttgaggacccatgatgtgcccgtgctggcactgaaaagataaagaagacatgcctcctggaggagtggcagtggccttcagaggtcttgattagtgctttgaggccactgtttgtggaacctggcgtttaatacttgcatttcctccagaaagcatgtgggcattggtagtggatgtgcttttaaaaagagcctcttatggctgtattttgtacatgatcccgtgtttaataagatggatgattcagtttcttctgtgaattcaggttgtgatatttgcatctttggaaatgctatttaggaaataaataccagcatggaaattcatagtttgttaattttcttgaagctacaaggcctggtgcggtggctcatgcctgtaatcccagcactctgggaggccgagatgggtgaatcacctgaggtcaggagtttgagaccagccaggccaactaggcgaaactctgtctctactaaaagtacaaaaagtagctgggcgtggtggtgcgcatctgtagtcccagctactcaagaggctgaggcaggagaatcacttgcatctgggaagcggaggttgcagtaagctgagatcatgctactgcactccagcctgggtaacagagcgagattctgtctcaaaacaaacaaacaaacaaaaaaacaagacaaaacaaaaaaggtacatcttttttactaagttgcatagctgtggtattttgtgtaatggtaattgaaatgtaaaaaatggtttattggaaggatttttggttttaatcagatttttttaaataaagattaaaacattggcattgcaattggctaggaaaaaaacccattttctttctttttttcaatgtactagcctttggtaaacagatggtcagattaaatgctatataattgaaagtgcctcagagtaaaaacttgcagatatttgggaaaggaaatatagttaataccaaaaaattttgggggcttctggttcacaaatttgcattactcatcctccttagctgataacatataatcatcaagaggctggacaagaccattttctcgttttgagttattattttttttcctttaacccctatccctacccctgttttccacccctatcccagcttcccttagtagaccttgacttgcatgtgtttggcatattaccttggattggcacatatctttgaaaaatacagaacagttcgtatattatgtatatcttaaattcagacctcaagctttcttttttcacttttgacactgtttttagtttagacatgttatggtgtatatctctagctaaatacttctaaacatagtttggttcctttgtaagttatccaggtaatggatgaatggattgcttctaaaaccacttagacataatgctgtgataaacatctgtacacaattttaatactagttttatgtgtaagttctttgggctgtgtatttaggagtgggattgttggatataggatagtggcttgcaatagcatttttccccgcttgttcatttatatttttctcatacaatttgtatatcatttggccatttaattatagataattaaaaaaaatagtttttactgtggtaaaatggacctaacataaaatttactatttttaccatttttaagtgtataggtcagtggcattaggtacattcccattgttgtgcagccatctctaccatctttatccaaagcttttcaccttcctcaactgaaactgtacccattaggcagtgggtactcactccccaggcaacctggcagtccgtggcagactttgtctttatgaatgagactactctaggtacctcatataagttgaatcatacggcatttgccattttgattgactagtttattttacttagtataatgtcttcaaggttcattcatgttgtagcatatgtcagaatgtttttcctttttaaggctgaataatattacattgtatatacatataccacattttatttctccattcgtccactgatggactcttctactttttggctgttgtgagcaatgctactatgaatgtaggtatacaaataatctgttcaagtccctgatttcaattcttttgagatgtatacccagaagtggaattgctggatcatagttttattttttgaagaactgctatactcttttccatagtggctgcaccattttgtattcccaccagcagtgtacacggatttcaatttctccatattcttaccaacacttgtttttaaatttttaaaaaattaaaaaagagaactctatattacagtagtagctagcattaagtaagggcttactgtgagcccaagtgctgttctgtaagttttacatgtgagaaacttttagccttcacaacaggtttccaaaatatatatatagagaatacgccattaatagagttcctcggataacagagtgatacactggaactttgaattgaggcaccagtattcaacacatgcttctatatccaaaggaagtgctagaccatatacagaattatagaaagctggttttgtgacatttgaatccctttactcacatagaggctatcaaagtgggggtgttgggggggaagattttgttagatgaatttttctgcaggtcatcagagtgctgtatgttttacccttgtctcccacaagttaggggtctctgaatcttttgtcaagtctagtgagagaagtttcaactaaactttatcttggggtcacaggatattgatgcttgactcatacctgggaaagctgaagtgttctatagcagtagtgctgggtttgagaagtaattgcactcttctctgtcaacagggaaatcaacctgctctcatttttaaggggatcctgctgaaaaaaaagtctcctgccagggcaagaagatcccagcagtaatgggctgtttgtgtaccaccaggggttagaagctaaggaggcattaagagcttttagcagagagagagagcagtgtctctggcaggatatttgcaattggaggagtataccattggaagagtgcacataagctccccaagagaggaagaattagcgttaaacactctgccatatcccctctgccatagccctagatcattttgctacagatagcaatcaagaactgtcttatatgcctgacctctcctccctttcctgaccttgatcctggtgggctcagaaaactcaggaagatggtggaagagaaatttggtgagatgaggaggatcctgttccttccttcactgacagtggctggtgctgggcaggccccagctgagtgaagaacatagatttaatgttacatgtactttggagttttgattgttatttgggtctagtctttttattttgtaaaatttcaagcctattggaatgttgaaacaatacaatacaataaacaccccataccttttaccagttattaacatttagccacggtatatattgtatttatactcttttgggcagtgggatggggctgaaccattcaaaagtgacgttttaccccttcagcttgtttatcttaagaattaaaatattctctctctgggcgcggtggctcacgcctgtaaatccagcactttgggaggccaaggcaggcggatcatgaggtcaggagatcgagaccatcctggctaacacagtgataccccatctctactaaaaatacaaaaaattagctgggtgtggtggcaggcgcctgtagtcccagctactcgggaggctgaggcaggagaatggcgtgaacctgggaggcgcagcttgaagtgagccgagatcgcgccattgcactccagcctgggcgacagagcgagactccatctcaaaaaaaaaaaaaattaaaatattcttctatgtagtcgtaatacttttaccacaccgaggtctttaccattggtataataatgtatactatacagtctatattcaattttccctaatgatctaagactttttttttcttttttaagagatggaatccagcccggcactgtggctcacacctgtaatcccagcactttgggaggccgaggtgggtggatcacgaggtcaggagatggagaccatcctggctaacatggtgaaaccccatctatactaaaaatacaaaaaattagccaggtgtggtggcacgcacctgtagtcccagctacttaggaggctgaggtaggagaatcgtttgaacccgggaggtggagattgcagtgagccaagattgcgccactgcactccagtctgggagacagagagagactctgtctcaaaaaaaaaaaaaaaaaaaaagacggaatcctgctcccaaaggtctgggattacaggcatgagacaccacgcccagccaagactagtaattttgaattactgaaccgagacctaccatttaaattgactatatgattttctcttacttatgagggaccagaaaagtcatgaggattatttgaatttttactataggccaggagttgatttattcttgagtaagtgtaatagaccagaaagagacaaaaagaaagtttttgcgtgaaatccattgtttctccgtggtcaagctggcaggcacacttttaaaacaatgtctgaattcagtatgctcttggcattattcaagaatagatttcttgtaggtaaaattgacagagtaatgataattgttgaagctgggtgatggtggttcactaaacttttctccctactgttgggtataattgaagattttcatgatgaaaagttaaatgatttttttgactctttgtgttttctaatttgtagatttggaatgttagtaaatcacgtaatgcattccttagtatcagaggaaatcaatttataaaactaaaacagtaataataatagttttccatatgtagggcaaactaagctaagtcttttccaaattcacacctctccaatataaattttattatttcattataaagcaatcattctttgaagtttatactcattttgaagacttctcttcatctttttcttggtttgtcatttgtctctgaagtgcaggagagaccgagtccagggttggccctcatagtggtgaggatgacctgggtgaaagtgtagtctgggtgaaagttcatgttgggaccaaaattaaagctaaagtttataagaaataggattgagcctgaggggtttcaacatggtacagtgttggagtgtgtctctgattcagaaatcggggtaatttttccaaaattgaaataaaaatgaagtagtcctgaaacagtgttgtttaactttgttagaatttatttctttggaatttgaaatactttgtgtattagctgtaagtgattgtttttgtgtggatagaatattttttgtactttaatatttttttcagtcataattttatagccaaaggtagaatcttgtaactttgtcctaaatgaacacttttgatggaagtcaataaaatactacactaaatgtccctgtatacattatatacattagtgatttctgagtgttaaaatttttgcctttcttttggtttagtttatcttataaaggttttctaaagtgaataattattaatcacattgcactgataaatgacatgattttagttggtttttgtaagagagacagtttactcatcaaccttagtgtttcttagcaacacaaattattcctatcttgggcattttcgtatcttccttcagacatacatgtggaaatagtttatatgacctgatgcttgtccatctgtcctgagtctctcattacttcttcgttacctaaacatcctcattaaacttcatgtccatacaatatattctttcagcttaataaaccacagtttgacctcagcatcatttggcttgtcacaatcttaaaagtgttctgaaaaataaatttattttgtgtattgtgtagctaaaagttaccgaaaatgttatattttcatgttaaaaaaagtataaaaataatgccttggggccaggctcagtggttcatgcccgtcatcctagcactttgggaggctgaggtgggaggattgtttgagaccagcctgggcaacatagtgagatcccgtctctacaaaaaaatttaaaaattagtcaggaatggtgccacatacctgtagtctcagctactcgagaggctgaggtgggaggattagttgagccatggagattgaggctgcagtgagccacagtcttgccactgcactccagcctgggtgatggagcgagaccctgtctcaaaatacaaaaacaaaaacaaaaaagctgccttgggagctggctaactgttttcttattgttctcatcctctaggatgagagctgaatcacttctggtagagaaataggttgactatcttttggcaagttgacatgttcagtttagattataatttatgaaaatgctggattcatagggagtgttggcgttcatacatccattcaacaaatatttatttagcccttacaacatgccaggctttgtgacaggcactggggatacagtggttagtgaaaatatggcatctgtgctctctatctctagcagagggatatggttgtctgagagcatcagaaaagaacctgctctggtcaggtaggaaaggcttcccttaggaagtgagccttagctgctatctgaagagcataccagtgggagcagcatgtgcaaaggccacgtggcaggatgcaacagggcgcattgagagaagctggagtgcagagtgaacacctgcaagataaagctttcagggagattggttttaagtaaaaacttcattctttatagatgctttatatgaaatatgaaatcaatatttttatattgacttctgtgtgtcatattgacttctatatatctattttaagacaataaactttgttttcagatactcaaaagatttgaagatttcttcaagttcatttttcccatttggtcctttaatcccctaactaggaatccactgattatccaactgcttgagtataactacccaagtggcagggtcctccctttcttctttggaaccagctttatttccagacacttttaagcaatggagagttctttcttatgtgaagccaaaattctggattttactcattgatactagttctcagtggcaaaactgaacaagtccaatttgtttatagactcttttacttattgaagattacttatatatagctataagtctcttccacaaagagtttttcacccaatgttaaacaaatttcaagtatacacacacacatacacacacacaaaatgaaacatcctccctcccctactctgcgtgtaccagttgcctggcttcaataattatcaacctatggttttgattgatggatacttaatgaataccatttttgccctaggacttgctggagatatagaaagggacctgacacagtttctggccttaaggagctctcattccagtggggaagaaaaaaactaaaataatgatgtccgagagcatcagaaaagaacctgctctggtcaggtaggaaaggcttcccttaggaagtgagccttagctgctgtctgaagggcacaccagtgggagcagcatgtgcaaaggccttgtggcaggatgcaacagggcgcttctgcaaaagagttcagagtgaacacttctggttgataggaaatcaactaaaataatacagcataatgcatacagtcatttaacttgtaagagaattatgggattataaagaaatagcgcagggagggcattttaccctgctaagtggtggaaatgggaggaattagtatacaaacttaggatctagaaatagatttccagagggttttggagaaagtaagcaaggtaagccaaagttcagacattaggtcagcttctgagacaaaaattctccattggcatgtaaaatcttatgtttatatgtacttataaaatagagccattgtgtagtccattaagagatgaagcattgagaattggacttggtagcaaagtcttaatggtcagctcaaacattcttgggagttaaaaagccaaaagagacagatactcagtaaacttgcctgcatgtagtctttattattgtacatagaaaatatttgtactcttcttttagcttaaatctgtttatgtatatatatgcattgattatgtattttaaaatatgagataattagttattacgctaagaggtcagggattcaatacctggagagatgatatccccacagcaaaaacactgcttttctctctagacagtgttggagtctttacttagttcagtttgaaatgcatgctgtgtggacacagggaggacttaatgtttagagttatgttcaaatctatccttgtctttagagccttaccatggataggttattagtgtgatcttgttactgagatttgccctacctgaattttgagacccatataatatctttcagtacagctacatgagagtataagcatatatatgcatgcattctaatgcagtggagcaatttttctcttagagcttttccaatcaaggaagcaggtactatttacagtgtatattagacaaattggaagcaggtgcttcccactctctctcatctttgtagccattctttctctatggccttgcttgtatctgtatactacatgcatctctatggtttttctctttttgtatgttctaaaatagatgtgtgacaaaaaatccataatgcagtcttttttatgcactcaatgttaatttatgtttgaatactagagtcgactatttggtcattcttttttagtttatgatttgcttgtttatttcttctcctgtttactatttaagaattacatatatactccagtctggcagaagtgatcaaatattattattttttacaaaatatcttcaaaattttattggtatgtagcttggtgccacattttgaacatgtatatgatcatttgttatgtttgagtgtttctgaaattgaattacttgataatttgtgagtattatcttttaaaatgaaataaagtgacaaggtttatccttttgaattgataggacctgttattaaaatcatattattccccataaatcagacataaaagtcttatttcttctttctgtttcaattatataatttaagtaagttatagcttcctttagacatgtcccagtttattgaacatactcaatttccattgtaagcatgtagataggattggtgactctataaattttttgggataaattttataaatagtattggaaattaatcttagaattctaagtgtcactattatttttctttaatgcttctgtttgtagtacagggtaccgagtaatatagtggataaaacacatagtcctagccctaataagaaagaaagactagtgtgtaagtaacttgaataaatggtgtaagagaagcacaaataaaactcagctggaaaaaaaaaattgtattagttcttaaaagatatgatacttgagctgggccttaagtaactgttagaaaaatgatgggggaagatttgggaaaagggtattttaggctgagcagataacacaagaaaagagagtcttaaatgccttgtatgattgaagagtctgtagtggtctcacataggagcagagggggagctgttggtgattagactggactgtcccaaactgggtttgatgatcttgtaagggtgtgcagatcttacttgttaggcagtggacagccttagaaggtaatagaccatctttaatgtgtcctctgatatattgataactactcttgttgtttgtagtagatattacagtactcattttggagaaaaactaacactcagaggagctaaatgacttgcccaaggtcttgtgacaactagttgtcagagctagaattcaaaccaaatgttcatttgaacccgcatgtttcatctcttttaagtgggggaacaaggcaatcaggctaaatttcaggaatgtttccaaagcagttggtttcttggattagaaagtaatactgtagaggcatggtagccaactgggagactattttaatgattcagacaagtggtagtatgaacttgaatttgtggtagtaaaaataggactgaaaagaagggtttgcatatgagattaaggtaggagaattgtcaagactgggtcattaagtacgggtaataagaatgcattatttcaaacctatgtggtagaaaaatgatgtccccagtggctggcttacctgagctaagagccagctggtttaaaagagagactggggcttgccagggatccagaattaagtgatataatgttaaagtgatttgattgtgaagagttaaagggtgagctataaaagtcacattctagcttcaggttaaacatatgagcacagagctgaaaactagaggcaaagcctaacattttgggtagactgtgaactgagtatggaaggagtacctgaataaagggtgagggtgcaaaacaattatcatgggctgagactgtgctgactgttgtccatttgtacaaagttttgctccctctcagcttcctctgtggttgtactagctgttatgggttgaactgtatccccttccaaaaagaaatgtagaagtcctaactcctagtaccccaaaatgtgaacttatttggagatgagattttcacagactttaacttagttttggagataatcaaattagcattagattgttagggtgggccctaatctaatatgactggtgtccttataaaaaggggaaatgtagacacagatatttacagagggaagactatgtgaagattaactagagaacagtatttacaagtcaaggattgcctgaggctactagaagatgagagagagacttgaaacagattctccctcacagcccttctaaggaatcaaccctgccgacaccttgatctttgacttccagccttcagaattatgagataacacatttctgttgtatcagccacccagtttgtggtacattgttatagcagccctaggaaattaataaagcaatatataggggattgggagaggtataggggtctggttgcagtattaaatagggtggtcaggaaaggcctcactaagaagcagataaaatgaggaaagaattgaaggaggtgagggaataagccatgaggatatttgccaggagagcattcctgacaaaggcatgtgcctctgatgtatttaggtggaaaaagaggacagtgtgtctgtaatggggtgacctgggaaatgaggtctgagaggacatacagtgaacatgggcagattgggtagggccttctaaaccattgacagccttctgacttatatgcattgatatggaaagccagaggattttaagcagagtgatcttatctacactttaaaaggattatcttggtctttgggatgaaaatagacaatggggataaggtagagagaccagaaaggaggattgtggaatggtccaggcattagccagagctgatagaagtttcgataggagggtggcagtatatgtgagaagaaatggctagtactggatatatatgttattagtagaacattgggatattatgacagattgaatatggggtatgagagaaagtttggactaagcaactggaatataacagagtttgattgagcaaagaatgattcctgaatagagcaggaccctctgttccatccccttagcccccagccagaataggttcagagtgactctgtgctgctgaattggagaaaatttatgaacagaaaaaaaaaaaagtaacataaaagaaaacggaagtgaggtacagaaacagctggattggttacagcttggcgtgccttatttgaacacagtttgaacagttggctgtctttgattggctgaaacttggtgattggtgcaagagtaggttacagtctgtttacacatccagttgagttacagttcactacgtatggagaaacctttaggctgaacttaatatatgtgaggaggtagctttaggctatactttttaacagaacaattttttttcccattcttttactttcagcttattgtgtctttgaaaataaagtgtgtctcttgtagatagcacatagttggatcgtgttttcttattcattctgccaatatgtgccttttggttatagtgtttaatccattagcctttaatgtaattactgataaggtaagatttacaattgccattttgctacttataatctgtgtgtcttatttcttttgtctttctttattcctccatcactgctgacttttgggttaaacagctattttctcccccggccctcactatccccactggatgcttcttacaccagtaaatagctattttctagtgtaccattttaattttcttgtttcatttactatattttttgttcttagttgttttatgcacatgttctcatgttctacactttgagcttctagcagcactttgagcctatgctcagtgttttctagatgagtttcatagggaaataatgccagggttctgacttactaatggtcaggaaatatgactgaaaataattttcttggctgggcacagtggctcacgcctgtaattccagcactttgtgaggccgaggcgggcggatcacgaggttagatcgagaccatcctggctaacacagtgaaaccccgtctctattaaaccctgtctctagctgggtatggtggcaggtgcctggagtcccaggtactcaggaggctgaggcaggagaatggcgtgaacccgggaggcggagcttgcagtgagtggagatcgcaccactgcgctccagactgggcgacagagcgagactccatgtcaaaaaaaaaaaaaaaaaaaaaagaattttcttgtccaacaattatattttcttaatatagtttgaatcttctgtttactcatgtttacagcagggcatctgttctctttcttccttcctttttgtttctccctatctgtttccctccctctaattcattcaacaaacatattttgtatgtatgtagttgcaccaggggcttggggtgtagtagtgtatagaacagatggtctcttcttcagtctttggtcagcagtagatttcgctaactcaaattcttcatagaacattgaaatagccaagtagtatacagtagggtgtggtgggatctgtagacaattccagggatattctcattcagattaacaaaaaagagaagtttgcaggccttggaagacctctgttttaatgtaaacatttctctgtagtaggaattgttggaatttctttaaccagctctcacttgccactcccttgttgagatttgagtagtgtagttttccctgtcttgaaaatatgctcctggaaccagtgtgctttaacgtttttagtgttttcaactgtttatttcatattaattcaaatgagctctgaaaacgtattagattccatagtgtttatacaacagatatgaattgtaaaggatagaatcaccctaacatttaatcgtaaaaagtatatttttaagcctttacttgggtttccattgttctttaaatttatatagaaagattgtcatttttgtggtacagtttttttgttccccttcaaagaaggggggataacagataaacttttggattcattttccattttttaatctgaagttgatgtatttcaagaatattattttcatcaaaggattggatataaattgtgttggctgctggactcggtggctcacgcctgtaatcccagcactttgggaggccgaggtgggcagatgatgaggtcaagagatcgagaccatcctggccaacatagtgaaaccccaatatggtgaaaccccgtctctactaaaaatacaaaaattatctgggtgtggtggtgtgcgcctgtaatcccagctacttgggaggctgaggcaggagaatctcttgaacccggtaagtggaggttgcagtgagccgagatcgcaccactgcactccagcctggcgacagagcgagactccatgtcaaagataaataaataaaaataaaatgaatacataaataaattgtgttgtcaattaactgtataataaatgacatcaattttagcaaataacctagtgtacatatactatatgttcaaaaagttaaggagaatataggaattttactttgctaatgatgaggacactactctcttctatcctgtgtgaccctgaataaggctttattgggaggttaaagctgagatagatctaggtttagtaggaaggaacagattggtcttcattatgctgtcaaaaaggtcttacactaatgcaaaccatgcctaagaaacaaagtgtttttttcctctaatctttatataatttctatttgattaccagcctgaggtattttacaatcaaagaacatattatgttcatacaataccattttataaggttttttttttttttttgagacagagtcttgctctgtcgcccaggctggagtgcagtggcgcgatcttggctcactcactgcaagctctgcctcccgggttcacgccattctcctgcctcagcctccccagtagctgggactacaggcgcacgccaccacgcccagctaatttttgtatttttagtagagacggggtttcactttgttagccaggatggtcttgatctcctgaccttgtgatccgcccgctttggcctcccaaagtgctgggattacaggcgtgagccaccgtgcccggccaataccattttatcattaatctctgcagtcaaccttggctaacttttaatatgacattggccactaccaccttaaaactccttcctgaaagctataaagtgaactattttcagtttttctgttctatttgcatttaagttggcttcatgcaaacctcatcatcgaaatgttttctagaggggaaaattgttacatttgtatgaaaaaggagaatttgtcacttctttcagctaagttgattagaaattacatgtgaagctataaaaaaataatgaaagtcaaagcaatcagtaaacagtacactggcctaaaccagtggacaaatctgcagagtacagatgtctgcattaggagtgcagtgtgataccattttttttctttcttcactcaaatctgtggagttgtcccccacatttactctgcattctctgttaaaatattttgtggaaatatattctgggggaacactggtaactgcacatctttccacaagtgtcttttatagtataaaccaaaacatagatgccatgactttgtcttttagaagggagtttcttggcatccttgcttagaactcacccttgaaaagatgttaacgctaatctttaaatttcaacaaggtgtgtagtttgactctaaaaggggaatgaagtagctcagaatgcttaaatctttagagagcaacccaaagtcaaaggcattataagctgtggttcagctaatttacaaggaggataattgcagaaaaattatcatataagtttactggaaataaccactaaattctttaacttactgtgagtatagcctaagatacctgctttagttatttactgctatttgacaaactgctgcaaaacagtggcttaaaactaggacaacatatattttgctcatgagtctctaatttggaagggttcatttggcataatttgtttttgctacactttgtgttagatgatgtggctcaaaggtgagggccagaatcatttgagtgctactcatgcacacctacggtggttggatactggttagaacatttatatgtggcctgagcatcttcttagtgtgttggctgtcttctaagggtgagaggaaggagagggagaagctgcgaagacctgtattgtctatttataatttacttttggaagtcacacagtactacttccaagacattttattacttgatagaaaggcctgctaaattcaagctggagggaaaattgtctccacctctggatgagagagtaacaagctactagaagggcacgagggactgggaatattgctgtggttgtttttggaaaatagttggctacatcattttacctgattatctatattctcttatttccggcctcagattgattcagttttctggggccaaaatgctcaatagttaagtgtagaaagtaggagacagattaaaatattttcctatgattaatgtaaagctccttcaattacattttctttgtaattgtatctttttctggaactctggaacccttagggggcagggttaaaatggcaaaacccagcattttatgttacattaggtgtactgaaaaatggtgtgatgtattacagttgaatcatcagagttcaagtcacagttctgccactttctagctgtgtgacagagggacagttacttaacctctctgagttcactcatctacaaagtcaaggtgatgatcccttccttatagatatgttttgtaaaacagagatacatttaaagggaccctttcagtgaatgggaggtcctggggtctcagatattatcattaggcaggttgatgaaagtgtatgagttaagatgttaaatttataatgacccagaatgataaaattaagaaacttttttaggatatttagatacttagaagttagaccaaatataggtgcatgtgactggaaggatttagagtagagaaaaacctaagaaggaattctggaagaatatgtttccattttgaaaggtacattatatcttaccagctaccaatcaacttttttttttcctttgttttctttattttttgagacagggtctcgctcttttgcctaggttgaagtgcagtggcatgatcatggcttactgcagccttgacctcttgggctcaagtgatcctaccacctcagctcctgagtatctgggactacgggagtgctccactacatccagctaattaaaaaaaaaaaaaaaaaaaaagtttggcctcccaaagtgccgggattataggtgtgagcctctgtgcttggcctaaaatttttttatagagatgaggtcttgccgtgttgcccaggctaatcttgaactcctgggctcaagcagtcctcactccacggcgtcctaaagtgttggcattacagccatgaaccactgtgtctggcccttaacacctttttacggaaatgaatgtttcaaagatttattaaaataatgaacagttagttaaggtactttaataaatgccttaataccttagttttaaatgttttatatttagtggaaaatgctaattttcttttatttttatttttctataataattgtagaagtgacatacatgttatagaaaagaaattgaggaaacaaatcaccatgattccattactcagaggcagactgttaatgttttgtcattttcctttcagttttttttaatattatagccatccatggtcaagatcataatgtataacttaataactttccttttttacttaattatcataataatttctcacatgtcattaaattttatatatcatgtaggtgtatcataccattttaagatttttatgatttttttctgctagacataatgttgtgatgaatatatatttgcacatgaatattatttgtctttattttgatttttttccatgggaggtatttctagaaagataattactggataaaagtatgtgaatatttttaaggtctttgattaatttgttatatttctttccacaaagtattaccattttatatctctactaaagtagaacagcagtatgattatttgtttttgtaaacaaagttgcctaatttgacagttaaaagtatcctttgtaaaatttgcatttatgctatcttagattaaaattttctttctaatatttagtatttatttctttcattttaattcaaatagactttctatatgttagggacataattttttccatatattttctccaggtttggagaaatttcatcacccagtatattttgttcctttataaacagtttaaaatttatttttttcattttgtatgaaagacatactagagtcacactaacctgcatggtacagttattcttttcaatggatggtagttctcatttttagtaacttagttttcttcatcttttagttatttttagagtgtgttgtgcatttaaagtggatatacacttagtttttaatattatgtttgtcaaacttcaagtaactatattttggttattctgaagggactttttcataaatagaatttatgaaattcttctcactggcaaaattttaatttcaaatggactattttactaggccttattcaggttatataaaaattaagatttatttatttccctttaaaatttttttcaagtgttttaaattcacagaaaagtacaatacaatgtcactccctccgaggtctgtcagatctgaaccttttttgccgtgtgtataataggagaaaacaactgttttttcttctatgttcaaactcagcacagaatacttcacctctggtcatcaaaatgtttatggggttttttcctcactgactggttgtctgacaccaactggttatcctacaatttaacttagctctgacattatctgcctggagatagtgacagatcctgcaggttaagagcttgatcccacaagattgtcccccacttcagacaccaatctcaagtagtaggctatcctcaatttctgtccaacttagctacaaattggaggtgcccaccagcaccttcttgggatcagctcacagaactcagggaaatacttttaccagtttattaaaaaaggatatgataaaggatacaaatgaacggccagatcagccagatgaagagatgtgtagggtgaggtctggaagggtcctgggcgcagcaacttctttccctctggactgggggtgtgccactctgagcacgtggatgtattcaccaactcagaagctctctgaaccccttagttcaggtatctttctggaggcttcatcaggtaggcatgattgattattaactcattatctattccctttcccctccgcataggatgggagttgggtggaactgaaggttccaagcttctaatcacggcttggtctttctggtgatcatccaggagcccaccaagagttgcctcattagaaaaaaagatgctcctatcacccaggaaattccaagggatttagaagttctgtgtgaggaaccagggacagagaccaatacacatatttcctattaattcacaccatgtttagttcagtttttaactgtttatttcttaaatagaactttatagatggaagtgaggatctctgtgatgctgatgcctaattccattctcctttccctagcctcagaggtttttatacatttatttaatatgcatgtatcaataataaaaagcccatataaatgatatctgtacctatccctctgaaatttattcttttttcaccaatatataattcaccaatatattacatatatataatatataaatattatatatgggtgaaatatataatatttcaccaatattatatttttaaacttatttaggttaaaataagtgttgctctagtttagtggttttcagaatttggtccccgaccagcaatcttagtatcacttgggaacttattaaaaatacagcttctcaggccaggactgaataaataaattgtgctacccagtacaaaatgagaatgctgggccccatgtttagaaactattaataatgtcaagatggtgacagcagagcattaaaccaggtgcagggtccttccgtgcttggtagctgtgaagctagccctgtctagacctcactcctgacctagtgaatagaaactcagagtaaggaccagcaatctgtgttttaacaagccttccgggtgattcttttgaatgtttaagttgtgttagttttctacagctgccataacaaaataccacagatgaggtggtttaaagaacagaaattacaaacctgcacatgtacccctgaacctaaaataaaagttaagaaaaaaaaattattttctgagttctggaggctgaaattctaagatcaatgtgttggcaggtttgctttcttctgaggtctctttcctggctatgcagttgttcaccttgctcatatggtcctctctggtctatatgcaagcatgctaagttcctctcataaggacatttcctcttataaggacactagtcagattagattaggacccacccactctaatagcctcattttgacttaatcacctctttaaaggccctgcctccaaatacagttattctgaggtgctagaggttagggcttcaacatatgaattttggagggacacagttcagcccataacaccactactatagttcagtgaaattttagggctatattatattcagttgtatgattatactgtatcttttgtgctgttgctggacatttaggttattttccgtttttttttttttttttttttttgctataacaatgctgctatggagagtcttgtataaatattttgtatatcttgtgaatttctctaattctgatgatatataatgggatagaattattggattgtagcaagtagaatctctgagctttagctgatattgccaagttgctcagcaatttggaagtgaagagaattcttcgcttctctgaaagtgtaagagaattcttgtttcactctctcccaggcaacattgatattgttagactttaaaaaaatattctgggtgggaattgaacaatgagaacacatggacacaggaaggggaacatcacacaccggggactgttgtggggtgggggcggggggagggatagcattaggagatatacctaatgctaaatgacgagttaatgggtgcagcacatcaacatggcacatgtatacgtatgtaacaaacctgcacgttgtgcacatgtaccctaaaacttaaagtataataataataaaattaaaaaaaaaagttctgataggcatgaatttcatagggttgttttaatatgcatttttctgctcattgttaacattgagcatctttttatgtatttattgatcatttaaggttttccttctctgtggattacatgttcatgttttttacctgtttcttttgggtcatttgtccttttcttattgatttgtagactttttctccctagcatctgcatttacaccattattggttatgtgtgggcgaaatacatttttccagtttgtagagttattcactttatgaggtcttcttttctgtataagttctgaattttaatggcaaatttatcagtttctttttctttatgatttcttttcctgtttttatttttgatatggtttcttagtgtagacttcaagtgccctgatgtcaatcgaattacaacaaaaaaacccccaaaatcctgcactgccttttgtttaatggaaggctgcatctatgctgttgattttgctagtgtgtaattttaaatggtggtgttttggctttaggagacaactttttctgtaacgcagcacatgtggtttggaaccatattttgagctgtttaacaacacaagcttctatttctgtatatgggtggatttgtcataatgatatttaaataagtaagtttaattgtctgttagtaaataaaagagaacagtgactccatctttgggtatgtgttgtcttgggttttcttggccttttgtagctcagtatcatcatctagaaatacactgaatactttttatgctgctaacagtactagtgtttatttgggaaatatttgttaatgtcattttactaaaaatttcggccatttattaccaaaaagtaaggttttgtaccagtccaaggcaacattttctctttgtgctgagttcccacatacacttagtacattttttcaaattttattaccttctcccagccccacccccttgccacaacttctaacaaatgcatataattgtgtcactgatagttgtaaatgtctacttgactcattgagggcccattgattatttggatatagactatgtatactccctagcccctgctctgggaacattttggctgttttcagacttgcttatatctccattacaaagcgatggtatataccaaggaggaggtgaataccatcttcctaattgtcatgagttactttttggtggccgaacttggtggacaaagttcaaaaagttttaggatgatgataattgaaactagtgtggtccagtgttagtatcagagcttgttagatttgcaaatttctcaagccccagcgcaaacctgctgaattggaattcctaaggatgaggccagggaatgttttaacaagctctccagatgatctgaggcaggtatctgaagggctgttccgcagcatttccttgctttcatacagttctctaaggacagcatggtatgaaatttctaacagtgtagtagtgttgatagagcaacttatagtacttgcttgtagctcttttttttttttttttttcttgcggtgaggagatgcagtagagggtgggcaggctagaagagtgtgagggaagcggggtgggtctgatcctttcactcttcctggaaaacattggcctttatgtcttttcactgtctgcctggactgctgaagttatataagctttttgatgtgcatctgatgtccctaatttcaaagtaaaatcactgacttattgaatatttatttgcataacgtcgttgtttggccctgtagaagataagaggaaatatatataaggtgtgatcctcacccacatgctggaacatcatagagacttgggttcaaattgtgccactgaacttgacttgagcagtaatctttggcagagttcttaatctccctacatctcattttcttctattgtaaaatgaaagcagcacctactgtgcatttgttactgggatgttcaaaggattaaatgaaataatgtatatgaagcactttaaacataataggcactcagtaaatggtagttggatgctattatcattataatcatcatctagttatttctgtatttgaacatcacacttgactctacagggcatactatattaacggtctaggtgacacttttcaggaattgctttcctggctctgtgatgattccatcacggtggataatttaattagcccatgcatgctgagcactgtggttgtggtgctcagtaaaagatgtggtatagaaagaaccagggctttggagtcagacagatcttgatctgtcattactccagaagtcacgaggtgtgcatcttgggcaagtttctcttcttccatttctcatcagctaaaaaaaaaaaaaaaagaaggaaaacactcactttgatggattattgtggagattaagtgagactacatgtaaagctcttggcccgtagtaggtgcatggtaatttttgtaataaatgttgccttgtccccttccttcctttcatactacagaattttagtgtctgttatccctaatatatgttgagtattcttccactctttgcacttagaaatcatgaggctaaaccaagagtctaagtaacttacttgcaagagaaatgttagagctagcttaagcagaaggggatttattaaggtgtaatcgtttactaggtctttgagggagcaaaagcaaaagactgtaggctgagcttctagatgcaactcctgctagaaccacacttttcagctgtcttactaagtgagctgcagccagttctggtctcagaaccctaatgctctgctcaaatttggaagctactgaatgaagagcttcagtttttgctgctggccccagaagaatcattacctcgcctgccatcattggtggatctgcctgtgtttgatgctatctttccttgttttctttctccctttggcttcctaggagtgcttctccttgggaaactcagggcatatgcagatcctaattgcaaggaggtctagcaaaagtatactttagctttctagccattttggtattgtatgacatgctagaatgggattgggtgggtggtgaggacaaatcttctatatctgccacagctttcaaaaaggaaaggggcatgagacatattgatttagcacctttgctgtcttaaaatcttatcttaaaatagatgatagtttcaagagaggaaagggaaaatgtcaatccagtaatgttgataggaggtaagttctatagtaaagaaaaaaaaaattttgtaggtgaagcccaattattaaagcagtgtaagaatctaaatagatcctgttgtgtttatttagcttatagtatataaattttatttttaagaatgtcttgtaactcttttttaacttcacagttttgcattagggtatgtggatacagcattcctgtcaggctatcaggtttgctcatttttgccaatcagaagaaaagtatatattcttgttgaattgatatcttaaaacctagacccatgcaaaaattttgtaaatgtaaataatttatattactttgaacacatttatggtgggggtggagttgggattaaggtaaagttttcataaagtatagcgtctaatttattttactgttctgtagactagtactgcctaatagaaatataatgcaagccatgtgtataattttaaattttctagtagccacattaaaaaaagtaaaaataaatatatgaaataaattttaatatgattaatttaacccattatatccagaatatcatttaaacatgtggtactagccacatttcatatactcaagctacatgtggctagtgggcacctattgtctgccttacttcatactagaacttttctgatttgagaagtactgaaatatacaatatgcatgtttataaaatgttcactgtgtgccacatcttgataataccttactgcttacactttaaaaaataacaatatgattgtaaatcagtgccactccccaaattataagtattgatataatgacttgctgtattttatgaaagttctgtaagtgtatgaactattaagagtttaggggtgtgaagtatgatactgaggtacactgttacaggcatggttttgatgggaggtattaggccatgcgagtgtagaccattgcagttaatccctaccacttaaccagttcttgatggtgtatccagagcactgtttatcattgtcgtttccctgaagaagtatctaaatttttgatgagtaaatttttttaaagcacatacaatatatatttttatttacctataaacaatgtacatgtatgattgtaataatatgtcaattctgaaacaaatagaagtattagaaacaaaaaaaggattaggttagattaggtctgacgtgtaagaggacactgacaaaatctcaaatatagaggcctggtatggtggctcatgcctgtaatcctagcactttgggagcctgaggtgggaggatcacttgagttccagaccagccttggcaacatagcaagaccctgtctctacaaaaataaaaataaaaataatactgagttttaggctgggtgtggtggctcatgcctgtatcccatgcactttgggaggctgaggggagaagattgcttgaggtcagaagttggagacaagcctgggcaacatcgtaagaccccatttctataacttttttttttaaaaaaaaccagaattttaatattttccacgcactccaaataattgccttgagtagacacctttctttgtagaccggtgctctaaatctatggagcattgactctcaaacttgattgatcaccaggaccccttggggacatacacaaaaagaataataaaaacaatgaaaaaagtatgtctttacatatcactatagacataaataaaatttcacgtgtgcatgtgtgtctgtgtatgtgtgtgtgaggaatatgtatttaagtttttaaatatgagaatccctgttatagttagcgagagttcttaggattcatgggaactctgtgaaattatttacaacattatatatatatatattcaggccttcttcagaggagaagatctgtagtttttatcagaatctcaggtggtcttgtgtcttgataaaataacagccaagtaaacgctagtgtagatacgtgaattggaataggttgttggacttgtgaggccaggatggattccttcagcattaagcttccctgcaatcatggggctgttaagactgagcagtaggcagagttgggaatggtggtatttgtgctgtttcatagatgagggcagatggatctgggaactgacctgaggtggtaacagactagggtcataattatatttagaaggtctgacatgtaagaggacacttaagagtctagtggacaaagtcaaagtctgagtctgatggcataggtcagattttgaagtctaagtagacaggccaatgtccctgacagggaagagggcttaggcagaaatagcatactaatattcaaggctttttttttttttttgagacctagtctcactctgttgcccaggctggagtgcagtggtgcaatctcggcttactgcaacctccacctcccgggttcaagcgattcccctgcctcagcctcccgagtagctgggattacaggcacctgccaccacgcctggctaattttttgtatttttagtagagacagggtttcaccgtattagccaggatggtctcaatctctggatctggtgatctgcctgcctcggcctcccaaagtgctgggattacagacgtgagccactgcaccatcatggtaagttttcccagattctgagtgtaaaggaaaaaacaaacttttttttcttattctcatatagcactcaacactgttaacaccagattttccagtagacaccaactgggtgtcctataattaaattcaattctgacaacatccacctggagatagggtcagattctacagctaagggctcagtcccgcagtactgctccctacaacccaccttcagatgccaattgcaagtccctggttgtgatctgtgcttctgattgactgggtgtaaggtataaatcagggttcccatgacctcctcctcaggtttaatttgctaggagggcttacagaactcagggaaacacttatgtttcctgggttattataaaggatattacaaaaggtacagacaggcagccagaggaaagagatgcataggacaagtctggtggggtgcagagcttgcattccttctctgggcgtaccaccttcccagtacctctatgcattcagcaacctggaagctcctcgaactgaacccctttggggtttttatggaggttcattatatgtcatgattgattacatcattggtcattggtgatcaactcaatcaacgttcagaccctgtcacctcccaaaaggtcagggatggggctgaaagttccagcccactaattacatgatttgtatcctggcaaccagcccccatcctgagggtatccaggagcctagtaagaatcacctcattagaacaatagatgctcctatcacacaggaaattccaagagatttagaaactgtgtcagattctcctatcactcaggaaattacaaacgtcttaggagctctgtcaggaactgaggttgaagaccaaatagaacaagattctcctagtgcccctattgcttaggaaatcacaagggctctaggagctctatgccaggaaccatggttagagaacaaatatatatttcttttttttttgagacggagtctcgctgtgttgccaggctggagtgtagtggcgtgatctcggcctactgcaacctctgcctcccgggttcaagcgattctcctgcctcagcctcctgagtagctaggtctacaggtgcgtgccatcacgcccagctcatttttgtatttttagtagagatggggtttcaccatgttggccaggctggtctggatctcttgaccttgtgatccgcccaccttggcctcccaaagtgctgggattacaggcgtgagccaccgcgcccggccatatatttcttatcacaatgtcacactgggccattgtccctaagaagaaagttatatgaagtcttctgtttggagagggttgtgaccctcaaattcctgccaactccagaattctataatttaaattcagtaaatcctcttccaataaatggttacatccagtaatttatgtccttgtcatatgttttacttagaggcacaactattatgtttcagcattggtgtgtgttcttgatcatgaatttactccatataagaccagtccttagagtactcctccaaaccttctgaacttgagttcttttccctcccctgcctggtggtgttgattgggctttttgagtcctgggataatggtcagaccgtcctatgaaaggttagtacttgaaccagcagccttgtttcctgttttttatttgttgccgtcacaacttagaggagactaggaattgtcataccccttttgtacataagccagcttgttaaaaggagtcttgttccctgaggattaattgagatcatgttggaataacatcttagggaggagtcccctggagaagttttctagaaaaaaaagagaatgcatttgtcttgatctaattgagcgtttcctataatatcagtatttacagactttttttttttagctttttgttaatcatttcatttcagcattcatattttataagaaaatatttcatgtggtgaatttgaatatacatgcgatgaaagcgctggagctttctgaagtagaaaggtacataaatactggattatttatcaatttattaggtatgtatatttctgattgttgcttcaatgttccattgttttcctttccttttagtgtttttaaataattattactaagaattcttgctgtcattattttctaccagtcagatctttgaattgatcatattaacaatataaaaaatatgcggctttctgtttctcaaatttcatgcagttcagatgtcagaaccttctatgtctttatagctaaaatggggattttaaagaatcaaataatgaaattgtgattttaatgcaagtttttaatgccccagagtatatctgtgcctgtatttgcacacatacacacacgcatgcatgcacacacacacatacacacacacacataatgtagatttccatttgcctcaatcttaaaattagcatttgtaacagttctggtagtatagtttgccttgtgaagaacccagaggcctgatactgtgtcagtaaaactgtctcttaggtatgattcaaacagttttattagcaacatatggggtatgaaggagccacagaggggagtgtggagtgtgagggtgctggtctgtcttttttggcatgtaattagatcagtcctcatgcatagtgttatttgttgctgcttagggaatatggaaaaataacatctaatgtagtgaaacaaaaatcagaataaattataattgttgagtttatagggaattgtttggatgaaagatgtatttttttcaaacctaaattttgtttggtattttaaattttattcaatcagtattttaaattaaaacccacattttcaacaattttaatttttggattaactttatacaatagatgcataactgagtttgatagatggggaagaaatttgtttttttccccctattgtgacaatatatggttctgtttaattagtttcactaaatattaatttttctttggagttatttgtagcatttaaatgattacagtacgctgattactagatgctacacagagaacaatatcagacacagcctgtgggcttatggagtttcattctataaaagcaatcacatatagaggatgtttaaatagtggtagaagtgatacacatgtcagcaaagtggttacctttgggaaagaaggagggaaatgggatcagggaggagtatgtaggagcttcatttataagttttttagacttctctttcaactaagattattgattgtcagagactttaaacaagagattcaggttgaggcaaaggtagtggaatagttcgtttcattttccttccctatagatattacctgacttgctcagtacagttttttaaagggaggagggtaaactggtagagattgagggagaagccatagtggtgggggagcagggagcattctggaaagagccctgtagaaaaaggtactgaaatgttttttaaacttcttcccagttttgctcactaccttcagccttaggttacatgtaattatttatattattgtctactctgaatttcacaggtgatttctcagtctttatgtaggaaagttactgagaggtaaaatttctttactctagatttacatttggctttaagactgttctctgagacccagtcctctgaaatggataattcgtaaactaattctcaaatggctagtctggttccttctgtatgctggtgaaagaatatcagaagccaagctgttcaatatttagattgtagtgattaagaaagcagcatggattatatgtttatttctagagtgtgagcaaatagggtcacacttcaagtgcttttcaaatgcttgtgactgctgtcatgttttatgacatgatgattttatgtaacagctatttccatggaattactttatttgaggaatagaccaaacttctgcttaaaaacataaagaaatctttacacttacccttcctatgaaaatttagttgaaagaccaaaaagagaagtacatttatgtagttttgttttactgggggaaaaaactaataagaattagttgtgtaatagatgggagtgattttagacataagaagagaaaatattaagtacttgtaatctttacttagagaaagtgaaccccgctcaaggaaatataagtaaatagtagtaatcttaagtttattatttaaacctctctttcctaccagatcttttaagagtagctaagaaatatctttcatccaatttgcatttaagtgttattatcttttcttggaagaccaccttctttttatttttttgttttactttaagttctgggatacatgggcagaacgtgcaggtttgttacaaaggtatacatgtgccatggtggtttgttgccctatatcaacccatcatctaggttttaagccccatatgcattaggtatttctcccagtgctatccctccccttgcccccccacccccggcaggccccagtatgtgatgttccccttcctgtgtccatgtgttttcattgttcaacttccacttatgagtgagaacatgcagtgtttggttttctgttcctgtgttagtttgctgagaacgatagtttccagcttcatccatgtccctgcaaaggacattaacgcattctttttatggctgcaaagtattccatggtttatatgtgccgcgttttctttatccagtctatcattgatgggcatttgggttggttccaagtctttgctattgtaaataatgctgcaataaacatacgtgtgcatgtatctttacggttggatgatttcaaatccattgggtatatacccagtaatgggattgctgggtcaaatggtatttctggttctagatccttgaggaattgccacactgtcttccacagtggttgaactaatttacactcccaccaacagtgtaaaagcattcctatttctggtagaccaccttctaaacaatgtagaaatcctaactgactggataatcaacattttactatatagacattcacaactaaatatgtccattagagttcagagaataattgaaataataaaatgtggtattataatattaaaaaatctgttaagcttatagtatatagattaattaaaataacccatctaaactataaaataatgatcaatagttattgccttatatttgtgaagctctcttagtattataatgcgttacaaatgtaatttatatttcttatatatgctgttatattttatgattataacggttttggaagtaggtggaataggtgagttttttttttttactaaatgaggaagttggatagcatagtaattaaatggggtttttccatgtggactggactaaaactagagcttctaatttctagtttagtgttctttccttctggatcttagtcagaatcagggaaatttggatttttctggcccgttgtatttttttcttaggtcattttattttggaatgtttcattagaaccccttccatatcttggaaagcaaaaaagaaccaactgtataaaatcagttataattggtatctttgaccatagatttttggggtgagaaggataaaacttgacccaaatgatatttttggattatgtctgtatttatatattatttctttggtgtaacattttactatgcaaaaaataaaaaaagttaaaaattaacgatatcattcacagttgtgaaattaggacaaaagttttggcaattgaggtacaagcagaatctctttctctcctcttttcttttgaagaactgcatcaagcaacatcctaggacccttaagattcttgggggagttttactcagcttctcccattatggtttttagaattattattatttaaaaatgattttttgggattatattttacttttaaatgaattaaaagtaacggtgaatacttatttaaatcaaatatcagttagcgtatattatgaatggaatctcaaaaagacatttgtaacatcttacgtagatttatataggctttaagaaatggaaacttgggggccgagtgcagtggctcctgcctgtgatcccagcacttggggaggctgaggcgggcagatcacctgaggtcaggagatcgggaccaccctggccaacatgatgaaacctcatctctacaaaaatacaaaaattaggtgggcatgatggcaggtgcctgtaatcccagctactcgggaggctggggcagaaggatcgcttgaacctgggaggtggaggttgcagtgagccgagatcgtgccattgcactccagcctgggtgacagagcgagagtcaaaaaacaaaaaaaaatggaaatttggggccattagaaaggaatgtttacttaataattataacatagcaatgttatttaactgctctttttagtaatatgtaatttattcacacaaaggataccttggtttgcctgtattttttggtcagtttaggctgttataacaaatacatcctcaactgggtggtttaaacaacagatatttatttcttacagttctggagactgggaaatccaagatcaaagtgctagcagatcctttgtctggtgagggcttgcttcctggttagcagatggccaccttctcattgtattgccacatagagagcagagaggaaggaaattctttggcatcttttataagggcactagccccattcatgagggctcctccctcaaatcttaaatactcctgccttagtctattgtgcattgctataagggaatacctgagcctgggtaatttagaaagaaatgaggtttatttggcccacggttctgcaggctgtacaagaaacatggcaccagcatctgcttctggtgagggcttcagggaactaccattcatggcagaagaaagggagcaggcattagagggaggaagagagaagggaggaaaccattaggctgtttgtaacaatcagttcttgtggggaatttatagaatgagaactcactcattaccatgagaatggccacccccaagccattcatgagggatctgatttcctgatccaaactcctcccatcaggccccacctgcaacacctccaatactaccaatattggaaatcaaatttcaacatgatgtttagagggaactaatattcaaactgtatcacctcccattggccccaccttcaaataccatcacactggggataaggctttaacataggaattttgggagacagaaacactcagtccatagcactacagttgttattaagtataatgtattgaaatacctatttagagcatgtgaatgaattgtaatcaaaagtttagatcgctattagggctaactcacctctctctctttttgtctttcagttgcaggaaaattttcatctgttttactacttaaatataactttcaggagatttttaaaaacctaagtcctatttctcctgtggaagtgttaaaaatcctaagaagctttcttgagataaagtttgtcccctttcaattattaaatgtgcttttctcttatctgtgaatttcaccttcagtttactggcaactgcttttttgtgttaggatcatagaattatgattaactccttgcaatctggcttttgtcccacctctgtactggaactgcactcgtgaaggtcactggtgaccacatctagccaaatgtagagggttatttttctcagttctcaatctccttgacatgctaatgtcacatgaccttggcttttcagctacatgagcactttcctttgaagtctctgctgcctactcttcttcctgtaatacctgtctctgaggtgttagggtgggtttgtacttttcctttgctaggcgtttacttattccattttgaatcttataataactttagttcttcttgtttagcatttgtatcacagataaatcataattctcacactctgatgggtattgccggtgattctcagagttctatttcacatcattgcctatcacctaaactctagtcctgcactttcatcttagaatagatcccaaatcatctccttcagattatttttttttcctctaaatatctgcatttcttttaaagaagcattctcttaataccttgacatttttagtgtggtgtcctttatgctgtgtcccttaccttccaatacctctaatgtccttgagcctttcctgaaaatgtttcctaaaattgccccatgttcttcatttctttcttttccccaaagtactttatagtttgtgaaacacttacaaatgtatttttttcttgatttaaaataacccatacaacaaatttgtgaagtaggaaggtcagagtttattaaataagtctgcagatggggacatatgtaccgaaagtagtagtgacttgcctgagttatcattgctggttaagggtaaagccattactaaggccaaggtaaagtgaatttaagattatacctgtgcccaaagcaagtgactgttgcagtttcctcttaagagatgtttcaacttccagtcctcctttaattcactttacttacattgctagattaatgtttgtaaaaccaatcacagtagcagctactatcgattggtacaatgtctcagtcactgatctagatatcatctaatcttcaaaactaccatgcaaagtagatattgttgtatctataggtaaagaaaattttatggataaggaaattgaggcttacagaagttaaataacttgctagtcattaagtgtgatggggctgtggggtagtgatttccaccctggctcccaagctctgattcttttttacaaccactttttgccatttttcaaattctggatgttacccctctttctaagaacttactatttcttcattttgctacttaatcctatttacacccctttattaaccttctagtatcttcagtaatttgttcataagtttcctttccatcattttctccagtaaccctccacagtgaactctgctcttgaccttgttctcttctcacaatgacctcatctagtcctactttctcactttcttagctggttattttctccctttatagaattatttcacctcaaattctttacgtattccagctctttaccttctacttctcaactcttagtgagcacttagagcatacagggtgccatggtaggagctgtgaatatagatgaatgtgtgggccttgttggagaggtgagcagttgatggaaggagtcaaactggattctccactctgatttgagagtgctggcagagggtggtgtgcctaggttgctagggatgtgattaattttacctgagtaactgaggaagatgtgagtaagaatggacatttgagctgtaaccttaaaggaagaggaggaggtcctcagttagagaaggggtgggaggagggcattcttatttttttatttttatttttttgttgagacggagtctcgccctgttgccaggctggagtgcaatggtgtgatctcggctcactgcaacctccgcctcccgggttcaagggattctcttgctcagcctcccgagtagctggaattacaggtgcgtgccaccacccccggctaattttttgtatttttattagagacagagtttcaccgtattagcgaggatggtctcaatctcctgacctcgtgatctgcccccctcagcctcccaaagtgctgggattacaggtgtgagccaccgcgcctgaccgagggtattcttgaaagaggaaatattgtatgaatacaggaatgaagttacagatatgtttcccatattttgtaatgtgaatgttaaaggcatttgttgcaaggccatgcaaagtggtgtattgctgccaacaggcctcaagtgactggacttcccttggttgaatcatcccagttcaaggtctggtctttgaccttatactttcagacacctgatttgctgagcccactgggagtgggtctgtcttaggagtgggcttgcattaaccaagatcttggaaactgatacatggatatctatatatttatatatgtttgtcagtgtgtcagtttattaatttccaatgagaaatacaactgtcaagtagattggattgcttatcttgacaaatcagtacactgcctccctgtcttcctgtagacaggattcttgggaagccaagttattaatatggaggtcaattgattgagaaatacagctgtcaagtttacccagcatttctgaccattgcgctccttctctcctggcaagatacatgggaagtcacattactggaagaccacatttggagcatggaaagagatccaggaaggatatttgttttaagaagtatctctcacctgagttagcttgaggcagtcttacccactataggaatatctttgccaaggaaaccgttattggagtcaagtcagccaccactttccctctcatggtagcttagcttgaccttgtcagcatttgcctaggtgacttcttggatttcgttcctgactagcctcacccgtatttcccatagcttctggatgggtgcattctccttttagatatgtttaaatattctgtcaagttacagggaagtctcaagagctaaggaagcaggggaattttcgtatctctgttttgatccatgtggttttaattttaagtcacatttccttattttcagttacttgggaccaaaatcagggcatgataaatagccccctgaaaatatgagatttggtggtggtgggatgtgggaaataggctagaaaggaaagttggaaccagatggtgaaggattttgggtgccatactaaaagtttcaaagtattctcaattcaattctcctcctcacctctctaattagttttttttccccacaataagattgtcttttcagcttttaagtttttgttatctgtatcctactatagaatatgtgatattggctctcagtggacccttaggagatcatataatttatccgctttgtgttttgacaaataaatattaggtgttattatctgcattttaaacatgaggtacgaaggcttgcagacttaagttctgcttctcttcttagttcaggctatttctacagcttcttttatccctcatttgttttagaaaaggtatttttattttattatatagtgtatctttttatattattatataatgtttctatcatagtgcttatgttctatacatgaatagctcccattaattaattgtcatgtatctgtctcttttctctctaggtagcttgtcagttttttatatttaggtggacctcatacttactctttttgcctcttatagtgcctagcccagttgaatttcaagcaatacttaagacaatagaataaaattttaaagctggaaagtatcttggtctagtgcagtattctgattttctctttttttggagacaaagtctcactctgtcacccaggcaggagtgcaatggcacaatctcggctcactgcaacctcttcctcttggttcaaacaattctcctgcctcagcctcccaagtagctgggattacaggcgtctgccatcagatgcctagctaatttttgtatttttagtagagacagggtttcaccatgttggccaggctggtcttgaactccagacctcaggtgatccacccacatgaagccaagattcagagcagctgtaatttgccatagagcacatgattggtagagccatgaccaggacccaaatatagtgacaacatgtccagacatctttgcactatggtacactgtttctctattcacctgaacgatgttttccataggtgtaaaagagaccatcagaggtcacccatatcagtgtacagtatccaaaaccactgtattaaaacttaaattggcagcctttcttgttagtcctaggaacagtatagttttaaatgtcttagatcttattgtgttaggtaaaaatttgagtgaaaaaaaaaaaaatgaaagagggacatagggaagggagcacatatcctgaaaacttgctgtgtacctgccaagcagtaagtgctttacatgtgtcaactcgactatggagatatgggtcgtgagccatggtctacaggcctatgaagaccatattcttccctcccctcccctcccctcctctgtcctcccttcccctcccctcccctctcctcccttcccctctcctcccttcccctatcccctcccctcttccctctcccctctcccctctcctcccatctcacctgtcctcccatctcccctcccctcccttctcctctcccctcccctcttccctttccccgctcccctctccctgctcccctctcccctctcctcccatctcacctctcctcccatctcccctcccattccatctctgctctcctcccctcccctcccctctcctcccatcccctcccctcccctccctcttccctcccctacctttcccttcccctctcacctctcctcccatctcccctcccattccatctcccctcccctctccctcccctcccttcctctcctatctcccctcccctcctctctcccctttcattttttttttttttttgagacagcatcttgctctgtcacccaggctggagtgcagtggcatgattgtagctcactgcagcctcaaactcctgggctcaagctatcctcctgcctcagcctcttgagtagctgaggctataggtgtgacccatcacccccagcttattttttaatttttaatttttaattttttagagatagtgttttgctatgttgcccaggctggtttggaactctttgaattgtgcttcattgttacagcccttgaccaaagccggtaagaacagcatcttgaatagcaggtactacactggacttcctaatgaggagcactccagcagccatcttccattgtctgtggtaatggtggtaaatgttggtgctggagctgggtggcagtgcctgactcactaaataaccttacattttctaaccatagttcatggctcatttttttgaccttttatgtatatatcattgttgccatttccattctgtgggagaagagccatattataagcccacgtgtttcttctgtctacaatcttactttccattttgttaatgctcctcctttcttctctttctgcctccaccctttttactctgggtgtggagagaaaattggatatgcttgtatcaaagttacttaaatggatcagttttaattttttcccctctgaattcttctatgttgatatgaagaatcatagggcaaaaaataaataaataaataaataaaaagaaggtgatacataatcacattgtcttccagcaaaacaattttcaaaaatggcaagatatatgcaattcataacttatataaagtttatcattcatatttatgaaatctgtgttttggtgctaaatgcacttcaagtttcaaagaatggttttaaaaatacttttgagtcgtctccctgagaactttcaacactgtataaatactacactttttagcatttcctgttgcatacctgcagtttgcatcacctttgagaatgcttaccacttttttgcagggcatatgtggagactcagctaacaaatgtcattatgtatgtgggtttcaaaaagcaactggaggaaattatatttaacgtttttgaagagttgttatctgggctttcccccatttcagagcaaaaccaggtgtaaaccaaggacatgcattgatatacatatttttgaaaaaaaaaatctttttaggttttgctggttattatttttgcttaaatatcatccccccctccccgaaatttagaatgtttctggtaaataatttaatctggtggttcccatcactttattcattcagttaattcttaaagattgtttcttaaaaagagcaacacagttatgagatgaggaattagaaataaggcatttgattaaatgtgttcttagggaaaaatatgctaagaaggcattagactttcccctttatgccaaaaagcttattagattggtaggctgtacagagggaggtaactcaggagaatagcgtgaagtagaagatattgaataacaataaagcagagtgagagaaaacagttttttctagaatgggaagtatggttcctttttctcactagaaaggctcaaaacctatgccactatgttgagatgccatttttatttatttagattttgctttagtttaaaggttggaataagatgacctcctttttcttttttttttaaatcttatatctactgtattacaaaaaaatttatagcattcactaagtatgaattaaatgtttaaattctgttagttgtatttatgttgtatttattcttccaggttttatattttatgagaacaatgcttttcatttagaacataacatgtttcatgtatggtttataattatctagtataagctttctcttattaagtgcctaatggcactcacctaagtttaatacagtttaatgtctattttacttctacatagtgggcattagttactgattgaataaatgagtgaatgaatgaataagtacagaaatatgtgggggcatgtatgatttgctcttctgagtcagatttatgatttaaataatattgccctatcaagctcttaaaataaagatttgcattaaatgattatgtactcactataaaaattacaaccattaaggataaaaaattaaacaaattctactacacataaataatcattatatcttggaacatcacttcagatgttttccctcttctgcatacccacacccacaaatacccacacacatacatatatttatagagggagaactaagaaaaaaatgaaggtgaagcaggagtatcctacatactatttttgtttaaataaaaatgatgttatttcatttgaacagaaatgaaagaaaattaaaagaattacagtaattaaataagtgatttttttacaataaggaattcgcattaagtgttttcactaaagttgaaaaaaacaattatgaaaaaagagactaggatcatttcattttaaaagttaactacatattatctcatcagtttatttcctgctgtgaaaagttaaaaattagcagactttctttctcccacctccaaatttttattagttatattaaatttgtaacttgtcacgctgtgcaacatttgcattctattttataattaattttcacagttatttagttttagttttatatttaaaagcattcagtgcttactaactactcttttataatggaaaattgtcctaaaatcctgagaggtgtggtcacttagaaaattccagtctggggaaccaatgctcccaaataaataccactttatttttgttttttaaaaataaatttcttttcttagaccctgaattcctgtagagtaaaatcaaattggcctgtgcagcttaattataaaataacaattttgtgttttagtttaagtgtaatccttcagatgtaagagttttattttcttttagttgtatattttttaaaagattggcggattatttgttcctgaatagcaaaaccccagaatgcttggtcgctcgccaaaagagtcattactgttaggttggtgcaaaagtcattgcggtttttgccatggaagtaataaatccagttggcttcataaaagcagagatcctactgggcggggtggctcatgcctgtaatcccagcactttgagaggctgaggtgggtggatcacttgagatcagaagtttgagaccagcctggctaacatgatgaaaccccgtctctaccaaaagtacaaaaattagcaaggtgaggtgacgtgtgtctgtaatcccagcttctgaggaggctgaggcgagaggattacttgaacccaggaggtagaggctgcagtgagctgagattgtgccactgcactccagcctgggcgacacagtgagactctgtctcaaaacaaaatacaaacaaaaaagcaagaggtctagttgctatttcacaggacattcagagactattggaaatgtcacttctggtgtacctgctgacatccactgactgtcctatctctggatgatcagaaaaggaataacttgtttctttggggtacctgtggctgtaggaacaattctccctaaattattctgttagaatttagtatacctttttattcttcttttctttttacttgataatgggaggtagcattaaagcagccttgtttattattcataccctgtcatgattactttctgtaaaaaccattcattctgaggacaaacaagctattctatgtccatcctgcaaaaataaatttagtctttatactaacacatatctccatttctttatttttttttactctttagtttgattcatttcttagctggctgaatttgatagttctcccttttggttatgtctatatctatatacttatatgtctgtccttatgtgtatacacttcttaagaagagcttatggatgttgtattttctgagtaattggatgcttgaaagtgtttgtaggttgcttttaagctttatggtcaatttggctgggtatcacataactggatttcatatctttgccttacaactctgaaagacgttgcctgaccatctccagataatggtgactgatggtaatatagagaagtctaaggccagaattgattttcttaccttgataacctaaggaattcatgtttatgttttatctctcttgaattccgtaacatcagaaaaatttgttttagtgttaattactttgaattcagtttttctggaatggtttcttttgttagtatttcctttcttctccctaagtaaaagttttcttttattatatctttccttttttttcctctttcatttgttctgctgttttttgtttttgttttttttttgcaagaatgttaagtatgtattaactgggtatctttttaccttctatacttatctcttatatatctttgtatttccatttcatcatttttttaatgcctgtcccttctttttctgactgtttcagtactgaatattctgttttgttgttgtcacttcattggtggctttaatctatgatttttcctcccagtcttcacccttagcctgccaactcgcttttcatctcctttagttgtcttatcttttcttagatatttcataattttctttgaacccctttactttgaagtagcttatattctttatcacttcttttagactggaaattatttgtatgatttttctgtctctgttgacagtttttttcttaatctgccatttgcctatgtttctccaccccagtttttggtagttctgtgtaatttctttgctgatttatttctggttgttactcatttttgaataggatcaatttcattaaggacagatattgcctgaaaaaagtgtgatgttagatgcatgtattgagtattagggagaggggttaaatgaagtgcaagtgataaatttgcacttctatttgggttatctcaaatactccatcacccaagatatttcttttctttgagggacatgtctcacctcagtttgtagtactgtaaaggtcactgtgccattgaggcccacgagtcataggagcctatgtagtaagtagtctagtgatagctgtgtccctctctttgaccccttttggcagtcattctgagctaggaagctaggtcattgacaataagaatgtcttgttttgttttttttttctctctccttctgtggtatagacatgttttctggagaaacctttcctattctctcctaggtagaaacttaatatcataactccaattagagtttactggaatgggctttagaaccattcaaattttagggaaatctttattctgcttgagttcttagggagtgcagataggctctcaggattatttctcattttgattccagatattgcataatttggcagatttttaaaaatagtttgtggtttgtggttatggctgtgtctttgttttattgatgaagtgctcattacttttgttctggttttttttttttttcagtttgtttctggagtagagactgtcttctgctcatctttaaaaaatttttttagtttatttgctatcactgtattcttaagaacatagtagtaaaatatcctgatattagactttactttttgtttttgaaacaagatgtctgtattaagctcatttaatatttagtgtatttacaacttggcaactccttttaaagagatttttttttttaactttaagttctgggatacatgtgctgaatgtgtgggtttgttacataggtgtacatgtgccatggtggtttgctgcatctgtcaacccgtcatctaggttttaagccctgcatgcattaggtatttttcctaatgcctttccctcccttttcctcccctttccctccacccgccgatgggcccctgtgtgtgatgttcccctccctgtgtctatgtgttctttttgttcaactcccactaatgagtgagaacatgcaacgtttggttttctattcctgtgttagtttgctgaggatgatggtttccagcttcattcatgtccctgcaaaggacatgaactcattcttttttatggcagctcttaataattttttatattgagaggtctttatgcatgaatttttaaaatatattcggagagaaaagcaataaatatcaagagattgaatgaagaaatcaattatatgtaatatggtaaaactgcagagttaatacatattggtgaacattggctgcttggtgtataagtatctttattggcattggggacataatcttttgaaaccgtcattgtaaaagtgaagtgacattgtaaaacttcatattttgacaataagaactgcttctcaacatgggaagcctgtcgaatttctcataaaatcacatatgatcagcttctcttggagaactatatttttcaaagaatctgatatgttttaaggaaaaggtgcatttttttttgttgttgttatatgagcaggagaaccattgcattacatttagtattaaactgcacacaccagaacctggactttattttagaaataacttatcatatgtaattaatttaaaaataattaatagactttattttttaagaactgttttaggtccagagcaaaactgaataggaaatatagaggatagtccccttcagccttcccccaaccatcaacctcccccaccccagtggtgtgtgtttgttacaatagacgaaccaatatttatacatcattatcaaccaaaggcctaaaattcagttttgctctttgtgttacaccttctatgcattttgacaaacagtataatgacatgtattcacccttgtggtatcatacaacatagttttaatgccctaaaaatcctctgtggtttacctgttcatcccttcttctctccctccttcagaatccctggtaacaactgatcctgtctgtatacttttatcttttccagaatgttttgtagttgcaatcttacaacttttgcaaccttgtcagattaacttctttcacttagcaatatatgtttcttgtattagttcactctcatgctgctatgaagaaatacccgagactgggtaatttataaaggaaagaggtttaattgactcacagttccatatggctggagaggcgtcaggaaaacaaccatggcggaaaccaaagcaaacttgtccttcacatcacggccaaagagagaagtgccaagcaaagggggaaaagctccttataaaaccatcagatcttttgagaactcactcactatcataagaacagcatgggggtaactgccctcatgattcaattacctcccaccaggcccctcccatggcacatagggataatgagaactacaattcaagatgagatttgggtggggatacagccaaatcatatcattttgcccctggcccctcccaaatcttctatcctcacatttcaaaacacaatcatgcctttccaacagtccaccaaagtcttagctcattccatcattaactcagaagtccaagtccaaagtctcatctgagacaaagcaagtcctgtctgcctatgagcccatgaaattaaaagcaagttagttacttcctagttacagtggggttacaggcattgggtaaatacacccattccaaatgggtgaaactggccaaaacaaaggggctacaggccccatgcaagtctgaaatgcaatagagcagtcattaaaccttaaagttgcaaaatgattctctttgactccatgtctcacatccaggtcacactgatgcaagagctgggcttctgtggccttgggcagctctgcccctgtggctttgcagggtacagcttccctcccgactgcttccatgggctcgtgtttagtgtctgtggcttttctaggtacacagtgcaagctgttgctagatctcccattttggggtggggtctggaggatggtggtgctcttcttacagctccactaggcagtgccccagtggggactttgtgtgggcctccaattccatatttctcttccccactgccaaagcagaagttctccatgagtgctccacccctgcagcaatcttctgcctggacatccaggtgtttccatgcatcttctgaaatataggtggaggttcccaaaccttaattcctttttgtattttatttatttatttatttagagacagagtctcaccctgtcacccaggctggagtgcaatggcatgatctcagctcactgcaacctctgcctcctggattcaaacgattctcctgcctcagcctcccaagtagctgggattacaggcgcccacaaccacacccaactaatttttgtatttttagtagagatggggtttcaccactttggccaggctggtcttgaactcctgacctcaggtgatctgctcgtcttggcctcccaaagtgctgggattacaggcatgagccactgcacctggcctcaaacgttaattcttgacttttgtgcacccatgggaccaacattacgtggaagctaccaaggctggggcttgcaccctgtgaagcaacagcctgagctgtgcattggccccttttagccatggctggagcagctgggacacaggccgccaattcttgaggctgcacacagcagggagcaggagtttggacccagcccaggaaaccatttttccctcctaggcctctgggcctgtgatggaaggggctattgagaaggtctctaacatgccctggagacattttcccctgtcttggttattagcatttggctccttgttacttacgaaaatttctgcagctggtttgaatttttccctagaaaatgtttttttttttttctacttcattgttaggctgcaaattttccaaacttttatgctctgtcacctcttgaatgctttggtgcttagaaatttcttctgccagatacccagatcatctcactcaagttctaagtctcacagatgtctagggcagggacaaaatgctaccagtctcttggcatggcaagagtgaactttactctatttcccaacaagttcctcatctccatctgagaccacctcaacctggacttcattgtctgtatcgctatcagcattttggccaaagacattcaacaagtctctaggaagttccaaactttcccacattttcctgtcttcttctgagccctccaaactgttccaacctctgcttgttacccaattccaaagtcgtttccacattttctgctgtctttatagcagcaccccactatcctggtactaatttactgcattagtttgctttcatgctgctatgaagaaatacccaagactgggtaatttataaaggaaagagatttaattgactcactgttctgcatggctggggaggcctcaggagaaccattatggcggaaggcgaaacaaatatgtccttcacatggcagcaggagagagaagtgccaagcaaagggggaaaagctccttataaaaccattagatcttttgacaactcactatcatgagaacagcatgggggtgaccactcccatgattcaattacctcccaccaggctcctcccacaacatgtggggattatgggaactataattcaagatgagatttagttgagagcacagccaaaccatatcatttctccgtgtctttttgtggtttgagagctcatttctttttagcactaagtaatattccattgtatggatataccacagtttgtttatccattcactttttggaggacattttggccacttccaagttttggcagttctgagtaaaactgatataaacatttgcatgcaggtttttgcatgtatgtaagttttctactcatttggataaatatcaagaagcacagttgctggattgcatggtaagagcatgttaaattttgtaggaactgcaaaactgttatccaaagtggctataccattttgtagtttcaacaaaaaggagcagtggtgagcaatgttctttttgctctacattgtctttagtaattggtgttgtcagttgttattgttttggattttagctattctgataagtatgtagtgctatctcagtgtttcattttgtgatttcctattaacgtgatatttgggcatcttttcatatgcttatttgtcatttgtgtatcatctttggtgaagtgtttgttcagagcttttgcccccccttactttttattttattttattttattttaaaagacacagggtcttgctctttcacccaggctggactgagtgcagtgtcatgattctagctcactgcagcctcaaattcctgggctccagtgattcttttgcctctgcttccccaataactgggactacaggtgtgtgtcattgtgcttggctaatcttttttcaaatttattctttgtagagacagggtcttgctttgttgcccaggcttgtcttagacttctcacttcaagcattcctcctgccttggcctcccaaaattctgggattacaagtctgagccactgtggcctgcttatatgtccattaaataattgtatttttaatgttacacattaaaaaaaaaacatagaggcaggttctcactgtgttgcctaggctggtctccaactcctgccctcaagcagtccttccacctccacctcccaaagtgctgggattacaagtgtgagccagtgcacctggccttgcccatttttaattgcttgtttacttattattgagttttaagagttttaaaaaatatattttagctaacagtcctttatcagatatgtattttgaaaatattttctctcagtctgtgacttgtcttcttattctcttgagagtgtctttcacagagcagaagtttttcattttaatgaagttgagcttaacaactttttttttgtcatggatcatgtttttggtgttatatctaaaaagtcactgcaaaacccaagatcatctaatttcttttatttctcttctagtaggtttatagttttatgttttatgtttaggtttatgatctattttgagttaatttctgtaaagtatattgtaaggtcttcattatgatctattttttgttaatttttgtaaagtatattgtaaggtcttcatctagattcatttttttctacatgtagatgtccagttgttccaacatcatttattggagactctcctttctccattgaattgcctttgctcctttgtcaagtatcagttgactatatttgtgtgcgtctatttctgagctctctcttctgttccattgatctatttgtctgtttcaccatacccactgtcttgattactgtgtaattaatttttaaaataataattagtaaactaagtgttaagatttgagaaacaagttatctcaagccaatttctgttaagtatgagataatgtgatgttttttaaaaaatacattatttgtaattattttagcaaaatttgtatgcagcggaaacagtgtcacaatggaaataaagaaaatggtaatatttccactttaaaagaactacttttatacaaagtggctcattttgggttcaaaatggctcattataagttcattttaaacttataatgttttaacttataaaattttaacttttaaaattttacatttttaaaacttaaatgacagtttaaaaagtttcttttaatcttctaaaataatattgtttggaacttgctgcttttttttactaagaaagaaaagataactacttttctgaagtgttgcgtggtgtaagtcagtgtctaataagcacatttgtgaaatgaattgagctagatattggggaatgctaataaatacatggcacaggtttttttttttttttttttttcggccttaaagagcaattcaggaaaattaaccagtaatataaagtaatgtgtagtaagcatagtgtggatggcagtgtgttgatctcactaagaggttagtatgtctggtaagtgtaaagtaatactttcacacagctggtttttactcatggtatgtttaaccttgtgtcagaaacgtaacaaatttacataaaagtttttaggaaattataatgattatcagatataatcaactgttatgatatatttttatatcaattttatccaggtctaaattacttaaactacccattttaaatggcagtgtgggctaggcatggtggctcgtgcttgtaatctcagcactttgggaggctgaggtgggcaggcacatgagttcaggagtgcaagaccagcctggtcaacatggtaaaaccctgtctctactaaaaatacaaaaattagctgggcatgatggtgcatgcctgtaaacccagctacttgggaggctgaggcaggagaatcgctggaacctgggaggtggaggctgcggtgagccaagataccaatatggctccattccactccagcctgggcgacagagcgagactccatctcacaaaaacaaaaacaaacaaaaaaaaaaaacacaaaaaccacggcagtgtgataagttttgataaaagaatacagctttacaaccaccaccacatttatgatttgtttattgctgtcaccccagagagatctcttgtgtcctcttgaaatcagtctcccatctctgttcccagacaattgctgatctgctttctatattttagattggtttacattttctagaattcttaagaatgtattttgcttactgtagaggatatatttttcgaaaattgatggtaaagtgaatttttgtaaaataaaccttatgttttattatcttaaaatttctaagatgctcatataaagttcagttggtattatccctgacatttttggttttgagttttctgcgttgtccactctctgtaataatttaaatctggattacatataacaatatgtaaaaccaactgatggcacattatattgtaaagcaaggtatccttttgcagttacctccctccttgtttatttttaatgttgattaacaatttgaagaataaaagtgtacagatcctattgtattcatagactttaattcagtcctttttccatataattgtcactcagtagacagtgtaacctcaatctgtaaaaggccatttgccttgtccttatgccctcctgctcagacctctggggatgggaaagtgagggtggataaatagctctttacttcataacattctgttctctgtgactcctcttacacatgcatggtctattctgaaagcgtgctgaaaagtagctgttgatctcatggataaaacagccccactaggatgggatagtagaatctttttatgatttttaaaataaaatgtactgattgttcataccttcatacagaaaagagttaatcctttgcatacaaaaatgagcgttttctggttttgcccagaaaagttctgtttctagaatttgtgctgcgtcatttattaatcattttgaaactagatctaaataaaaaccaaacattatgaaagtcatgtttgctccactaaacatttaaatttcgacttcatttggaaatcctacactcacataaagagaaataatcctaatccaaatttatctatagtcaaactgtgggtaagtaatgttctaaaaactgaattcttaagtaaatgtcattttggggtgataaacatggatctgttaagaaatcctgaaggtctacatttgaacactgccccactgaaggcttcagacaaaggacaaaatgtttcaggagtcagtttgagagacagtatatgtgagatgagactgaagaacaatcagagcgaccaacctgagatcttatattttatatgactattatccctctcaaaactaatcagtcaatactctgttttttttttttaagttaaaaaaagactttactcagattgtttttggaatttcctcattttaggggattgtcttcagaagcacagacatatcccattcagcctacactgaatggtgggttagacactgtcctgtcttcagcagggtaagtcagatgcaagaacagacataaacagttacctgcgatacaaagcaggttgtgcagctgtgctgatagtggcatgtgtaaactgcattgggagggaggagttaattctagcttggccatcattaggtgacgctatttaaatagcgccatgagtgatgagttgcattacaattttaatttattttctttgtgtttctgaagctgcatttactttagaaaattcagcaaaccagaaaagcacagagagaaaaaaattctaaaattaccattcatattttcatgtatatttcattgttttgttcttagctgtttttgacctgtcatttttttattttataatatgaacatttctccatgtccactaaatatttttctacagcatcatttaaaatgactacatagtctttttaactatcacagataaaatgtaatttatttaactagtcacctattgctgaccgtttagattgtttctgtgttttactattacgtaaaacactgtcagaaacatcttcatgaacatgactgtttcttttaaattaaaacttattttgccaaagtaatacattcacctagtttaacatttgaatagttgttaaaggcctattagaaaatacagtggtggctgggctcagtggtgcacatctgtaatcctgttactttgggaggccaaggccggtggatcatttgagcctaagagtgcgagaccagcctgggcagtatggtgaaaccccatctctaccaagaaacaaaaacaaaaaacaaaaaattagtcaggtgtggtggcgtgtgcctgtagtcccaactacttagggtgggggctgaggtgggagaatctcctgagcccgggaagtcaaggctgcagtgaactgaaattgtgccactgctctccagcctgggatatgaaaatgagaccctgtcaaaaaaaagaaaggaaaatactgtggtcctttctctagaggcagccttttatctgtttcctctagtcattatatatctccacattgctaaattacatatatacacattgctatcttttgagttaatttattttagacattgttgactttatgttatggtctttgaagatttttcactattacacagccatctctttccctcacattcccagtatagttagattccaatttttggcttagtgttgcattattatattatgtagctattattcatagatgagcatattgtaattaattctgatgaaaagtttgcttctgacttttcgtatttcatgaaattaataatgccttgttttttcatttgctttgctttttgtccctcttaataattcttcctataccttctatgaactacttataattttccataaagggaattgcatcagataatacatttcaatttttttcttgaagacattcttccagcacacttccattctcctcccattacattctctagacctgcctcttctgggatttttccttgctcttaacctaggaacttcctttgccttttcttggatctcatagtgttttccttcttgtcttactcttacatttttgtttatgtttcctgtagtattcctgagaaaggttttgtgacagaaaaaatatctttattcagttttctcacttgattgataatttgcttgaataattaaattctaagttggaagtaactttcctataggtttttggaaggaaatgcttatgttccattgtcttccagcttgctcttgcaaagtccaagcatttttgattcctttaactgtagaagaaaactgagtagaagaatgtctgggtataaggatgtcatattttaaaaactgtaaagatgaggaggatgaagaggagattcaaggcagagggactcgaaaagccaggtgacagcaggttgtccactgtggtaagagaatgaaggcatctatgtccatgtgaggagagtgtgggatatagttggaacacagtaaattgagactctatattggagacccatatatggagctttaaatttgttttcttttcttttctttttttttttttttttttttttgagacggagtctcgctctgtcgcccaggccggactgcggactgcagtggcgcaatctcggctcacggcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttaaatttgttttctaggcattatttcacctagctatcatcagctatgtgaaactttctttggcttatggcaggcaaaatgaattggcttctgatttatcctcccttagtattaatactttacatgtgcccatgtgcatatgtactcatatatgtacacacacatttttatgtatctatatgcctgtctcccccattagactacatctttggggttggaggaagtgacataattaggtctgtgttaagggaagtacagtagatcagttcttaacattcctggtggttgaggtgccattgaaaactgcagaatggataccaggaagaaaggattaaaaggagagagaacagaaggttatttcaatgcctaggtttgaagaaatgagcatatgatgaactaatctactgggagagggagggatactacttcaaataattatattccgattattcccatgagtctaattatttttaattttggaaatgctatgttatttttatatatttattacacttcttactttaaattttttcccttcttggtccattccagaatagtctgaaacaattttaactcttgctttattgattttttaaaagttgaatgatgttttgtttacacagctgatgattaatagtaatgatgatctgaatgaaataccatcttaattctatttggttaaagaaaaacacaaatagagaattgtagatgaaaataatttgtatatatcttatattgtcatttcctagcattttcttattctgagcagattcgttgcctgaaaatgttaactttgattttaccagagtctttcttaagtagataaagtttgaaatagtatgatacttttcattattgtttgaaaacaatgaacttttccacaaattttcaacattacaaacagagacttttcaccaagatgaatgatcactcagaaaaagtaaagaactagttaaaggttttgttgcatgtttgtcactgatggatttctcaaaagccaggctatgtatttatacttaaaaagatgtaccatatgacatatcacatattttgaaaataacatcccactgatgagtctttactttccaagatgcttttagacaggctgatgctccactaatgataggagactaatgtcttttggaaactttcatgatgctaattacaatttattaagcacttactcatgccaagccctgtgccaaatagtgaagggacactgtctcatttaataataaccctattggggtgggtgttgtttattattagatgagaaaattgaagcataaagaggttacatttcttgtctgagatcatgcatgtagcaggcagcaaagcagggaatgtttatctttgctttgtgtatctcttcattcttaagcttgcttctttccacgttataggaaagatcttaaggaatattaatcctgtagtggcatcacatatgaacggtatttctcacctgtcctatcatcagatgaccatctaatttactaatttcttatagtgagtaatttctcagatttttttttgatccttataaaactgaacaccgtgcattgtctactgtgctttcacaaatgaaaatgatggtccactataagattattatttgcgtttaaaaaaaattcttgtttaatgagaatagccgaattttctttgaaaaactttctgtacttactaagacaatattagtatcctagtttaatgtgtgtgactgatatagttttatgttacttactttttatattattctttcacaaaaaatacaaagcctcccccaactgttgtttctccttagtgctaactttaagaagtcacacatgtttcttcctgaacacccaacagtttggtattctgtcagatgttttgcagggctttagcaagttgttacagtgaatgtctccaagaagcaatacattaggcagagcactgcagagacacctgtagagatcagcacacctgccctcaagcaaaagacagtaattagttgctcatcttcccttgcaaacttccccaatgttgttgtacatgaaacacgtagatcacagcagtgctgtcatgagctccgcactgttggagttgtttatgcccattcaatttttaatgtttctataagacattttgatgggaaccctgagcccaaagggatttgcatgcttgatcaaacttgtgatgatttgaatatagaaataaagagaaacctttgaattactttgactgttaacttttaggaccgccttagtggaaaacattcacatgatacttgaggcaaagatgtgtttgatcaccctttacaacttttttgtttcttgacagcaggtatagcgccagtaaatctaaacaagttctttaatgcttatagatccaagtgcatgtgaatatctgtatagcatggtctgaatattttaaaagatgattttgtaccaatcacttttattgaaattaaaccagtcaagtaccaatcttttagtcctgccacattgtcatatatagtttatattattaaagaatgagatgataggcgattgaactttagtaaaatacagtagtatatatgagttggatatattggggccagataaattatcacttaaagtacttggatgccttttgatatcattgttttaattttaacactatatatggtctagataccataagggataaaagctagtattttaccaagtgacctttcaagtcgtttctaacagctgggattcagttctttgattatatttgtgtaggttattaataaacagcttcaatagagtttcattactgtttcttaaattatattgtttgcaaaatgctatcattcctaatatcatagcaaattccattcacatttattctgagaaaaaataaccctagtagtgccttgttattcaagcatagtctgatggccatacatacatgcatcttaaattggttcttggagataaatgggcattatggagttgtcagattacagtaaaactaaagaagaagatgttatacagcattggactgtcattgacagagttagaaaccttagatgctaataaatgcagtcatcccattgtaccttgcagtttttcctcaatacataggtagaatcttcctgtgagtttctgagcgtagtttttgattagctcttcagcacaaaatggaatgagtgatgtgaatatttaaagcttacctctagattttatgtttgcctgccttttttagccatatgtaagcctaaatgtggattaactggggttactccatttgtgaggtgatgattatgatgctagtacggtagtataggcagaatactctttttttttttttttttttttttttaagtagagtcttgctctgtcgcccaggctggagtgcagtggtgcaatttcggctcactgcaacctctgccacctgcgttcaggtgattctcatgtctcagcctcccaaagtgctgggactgcagccatatgccaccaagcccagctaatttttatatttttaatagagacggggttttgccatcttggccaggctggtctcgaactcctgacctcaagtgatccacctgcctcggcctcccaaagtgctgggattacaggcgtgagccaccacgcctggcctcttatattttatatgcataacattttggctagcttatacttcattgactttcgggaatttcacaacagtcattgctaacaattggtctgtctatagtggcctttggaattcctaataactttatgttaatgttgcataaaacatttggcagtctgtttcttatgtaaagctgctccatgtgccctgagtcagaagcttactttttatccttgatacctagcttaatgtgatcagtcagtgttggttggattagtggatgattgaaaatattatgtaatggatatgaatagcccatggaaacagtaaagagtggatcacacttaacacttttaataatagaagtaactttttctcctgcttgtttttttttcagcataacccttggttcatattttttctaggataagttcctatgacttgattttaactttatctctttactatcagttcatcaaaaatattctgtgaaaaaacattttatacttttactgtactaaagttaagctcttcttattctgagtcacaatctggacccatttaactactttagctttattttctattgtgctatattctctagctgttttttctcctcctgtgctggagaaactttttactccttgtttcagagcaagtcaaacttccacttcctggtgtcatgccttggtctctgagctccaatctcatgaatttctgagttatttctgttttccacctgccagttaagaatgaaatcatatgtgtccctatgttttgcaaaatggatctatctccagctagctcatagcttcgttactatgatttctttctttcttttcatttttttttttgtattttaattcttttctttctggcatgtggtagaatgctaagtactttgtagtcacatagtaaatactgtacacacttacacactaggtaatatctagctttatagtaacaagataagcttcctcctaaagaaaggaagacagaaagaaagatggacagaaagaaaggaagacaaaacagaagaaaagaaaggaaagaagaataaaaaagaaagatcagcaagaatattttgaggaatagggaaagagcagtaattgtggaattttaaaaacttgagtttaaattctgattctgcttactagtttgtgatattggatgaggttcatcatcttttggtgtaaaatggtaatgatatctatctgacaaacctgtaagggttaaattatataatgtatataaagtgcttattggcataccctggcacacattcgacgttaaagaaatggtagctaactcttttattttgcatgtgagggaagaagtttagagagctgaccaagggtcatatagctagtaaattgtggagagaaaattgaaaaccaggccattcttactctaaagcagtgtttttcaaacatagtgcatctgagaattatctgaaagacttgttaaaacactgggccccactccagagtttctggttcactaggtctggggtgaggcctgagaatttgcatttcaaacatgtttcctgttgctgttgctgctgctactggtccagggaccacacttcgagaaccagtgctttctggcatatttctcaaccctagttgcacctaagaaatcaagaaatcaccctgagtagtgtctataaattattgatgaaaccagaatctctggttatggggcctaagtgtggatttttaggtttttgttttaagctatccaggggattctaacgtgcagccagggtaggaagcaccactctgcttaagtgaggctctttgcagtttttttcttagaactgggtattaagtgaagcagctgaccctgcaccctcctgggtgctcagtgaggcaaggcctcagtagtgtgtcgtttttatgctgttatgttttaaaacaattgctttggcctagaatccttttactgttttaacctgttctacttgtttgtgtggactgtttgcatttctccatcttcaccctcagtgtatcctgaatgccttcatcaatctctagggtggattttatgttaatatttggcaaaagccagtatttagcaatagtagacttgaagtataaagtaaataaaggaatatatctagtttttaaaaaagcagtcacattacaatttaatgtactttcagaattctgattttgttcttttttctgagatgctttggaaaccttacattgtgttttagaggacccagttattggttagaataggtaatgataattgtgcacccagaagtgtataagtaaaaatgtcgtagattaattgataaaggagtcattttttctttataggattcagttggtaaatatatacaaatcaaggcatgaaatcatttactggataagagtgggcaaaataccacataatttcattaacctttaagcaatgaaattataaatccctatgcaaatgtttaaggttatcattgcctatcaccccttttgattcctacagactgttaattcttctctgtcctgctgagtcttattaaaacttctgactgatgtacttttattaaaaggtttagaatttaccaatttaaaacacttgctttacactattacctctaatttaactaggcccattaaactgcattttgcaaagggaagaagtcaattgctgtttctttaaaaaataataaattgaaatgaattttaaactctgcttagcggtgagcaactgctatatactactaggccttttgatagctgatttgttcctttagtatgcaaattttaggtttacagagatctaatgcttttatttaggaaatatgcccagaggctagattggtaggctttagggagataactagtttggtgtgaaataaatagttgttaaaggatcacatgaattgggtcccagaagatgaagagtagactgagacagattgaggaaaactgactgtacttcatttcatttggctataaatatcactgaattaaaaatgaagacaatgaatgatggcaatacaaagcaaattaatgaaaataagccatttttttgtgggttttctgaaaagttctgtcttctgagcagtttaaagaaaagggctgggtacacccctaaccaaagaagcttagttcacatcattctgggaggccagccttttgagagattgtagctttagcagggaggaaggaatgggtcaactcccctcccaccccccaccagtcaaagtcagcagcatcacttctggttagtgagatgacagatgtcatagaaaaccttacattcaaaacaagaggactcacggatgctagcttaggttggcaattgtagatattctggcttgcaagtgttaaacaaataataatgaacttttagctttgggaagttagttttaagaggttatacacttgttttgtagcattgctcttttggaatctctgacttccaaacatttatttttccttaaataactgaaaataatgaaatacgtttctatattgatagcttgtagcatccacttttcttttttttttcttttttttcttttcttttttttaacagtgcgtatatctgtctttttggttgtctaagcagttaggccctcaagaaatagaatattcgaatagccttagcatttgaaatggtctctgtatgcctatttgttgtatgtctctggtggcagaagtgcagagggcatgggtgatgatgatgtgtgaaggtgggatgctagattctttcattgaggctggaggtttataatcttgttatcattaaagtttcaaagaggtgtggtgggtaggagtgccaatgccacagtctagtagagtgaggaatgagaataagtaattggttcttgccagccttagcaatagtggttttggtagagtgatggctaaggaagccaagttatggtaattcaagcattgaatggaagttgaagcaaaaacaacgagcttatattattattttttcatggggatagttggtagggttggaagaactgtgttattgatgaaggagaagaaagcagtggagaagaaagggagaaaccagatagtgcacgttcctagaaacagcataaatgaataggattcattgtacaggtagagggtttcataatggaaaagagggtcaaccatgagataggaatgaaagtgttatgagacaggagaattttcatatgtagagtgggttcttagttgcaggcaacagctagtttgagttgcatacagagatgtatcacatgctacttaatttgcagaagtgccaaggaaccaaagttgactgtgaatagctaggaacagcacaagccatgagaaacaccccatgatactattctagtagaaaactccactgccatttgctacttagagtctatgagactagggatcatttagtagcatatctacatagttgtttcagaagaacaaaatgccttcactacaaaatttgatctcatttgtagttggctacttccttgatttgctcatttctgctttctaaattttgaatggatttggttgaacctgggttccctgtggaaggcgtgatgcaagagcatctgagaaatgtttttagcttgagctttgtgaatacaggaagttagagtgcatgctagaaagggattggagtgcagcctgggtaattctggctcttggtctttcataagctgcaatcaagatgtcagccagagtgacagtcatttgaaagttagactagcctggaggatctgcttagaaaatggctctctcacatggctgttatgttgattctggctatttggcaagatgccttgtgtacctttccctaggatggcttgagtgtcctcacaacgtggcagctggcagctggcttcccccaggaagatccaagagagtaaggaagaagctgtaatatcttttaggacagacactgtcactttcactgcattctgttgatcactcagaccaaccctggtatgagcaaagggattacacaaaggcatgaattccttgaggtgaggattattgggggctgtcttggaggctggctacctgtaccctcttctcccctttctttgacagcacaagttgatcggatttatctgtggaagcaaaaaatgaaattcttttaatagaatggaacttgacaagaatttggatagaacgtggttctttatattaagggtacacagtgtgcagtattgtcagccaggttttaaagagataacgaaacgctgttcatttacttgttgtcaggtttatattctacaagcagagcttgtatcgtaacattatcattcaatctaggtatatgtattttgaagtgtagagataatgaggtagtgatactgtcttctagaatagctactctgtcttcatctctgaaattcacaggtctggctagctgtccctaacgtcatttcctggtctcaactctttaagaccctgacatactctgagattggagtgaagatttctgtgacatgctgggtgggtataggctgctgtctcatgtcttggtcacatcttattgtttattttttcatatcatgtatcacaaattgaaatattgctgatatacttgtttgtcaccctgcatccttctcccattccccaaagtaaagcttcagcagaatagggctttgttgacctgttcactgctgagtcctcagcactgagtgcagtgcgtggtaaatgcccagaaggtgattgtctaaatatgttattttttgagaatatatacgacatgattattatttgaaacaggacaccacaaaaggtaatttttcccttcttctacttgatttctgtcttttcagcctttttcttataccccaccccttttttttggtggcatctcagttcaggatgttctctgtggctgtgaatgctttcccatcttgttcacagttggtacctggaaggttctctaaccttgtttctttctgatgtagcctattctgactctgggattactatttaaagtaattcttttaagagatatgtttggctaattctgtaatttttttgttatgtagactgtttgggagccacatttcctattgatttgatcacaccttattttttccttgtcataaatggtcctttttggatgagttactgtgtgagttctgaccctgtcagaattgatattcttaggaatcctgactttaatatacacagaacaggaaaagtttccttgtcataaatggtcctttttggatgagttactgtgtgagttctgaccctgtcagaattgatattcttaggaatcctgactttaatatacacagaacaggaaaagtcatgataggcacccttgggtatatatggtaacatgttagttctcttcaagactgtgcatggcttacagggatcacaggactgtgtgagttaagcaacagtttaaacctgatgtattgctctcccagaaagtagtattcttaaggtatttaccccagatctgcaagtgtctgtgtttctctgggagggaacccccaaacctggaatgctcatccatatgcattccaacctgcctctgagatgttaggcaagcctcagcagaggttcttgacagttttttggactatagaccttttggcaaatctgacaaactattgaccttctcccagagatacttatttacataaacccacaaattttacatatatcattcaggagtgcatagattcctgaaggccatccagtgaccaaggttaaacacctctaatctgaatagtaataataataataattattattattactgagttacagatgatttggaaaatctctggagagactgaaaatctcttattaattaagaataaccttagaagcactcagaaaatttctgttcttgcacgttcttctcccatcttggaatatccaagagccagactagatcatccgaatcagctcttgaccagctcaagattgagaattcaggctgggtttattttgaagttactaactatgtcttttgtgatcttacaggtatctctgcattagccagattggacatatgtaaagggacatcagtatatctggatcatcaggtaagcagatgggacttcatttttatatctccatcaattccgtcctgtggcaatatgcgggcattttctatcatgtcttgtttactgcagtgtgggtcagtaagatgattgatatttctaaagagaaggaagcagccttttttaagtttcaccagattatttccctgctgcttaaagtcagatttcttcatttttatctcattattatttcatgtattcatacatctatagtagataataattctctacttttcttttaatgtatattctttggagagttgtggacagctctcatattgttccttggttgtcagccaagttatagacatttaactcctttaatctttctttgtaattgagttagcttggctgccttttccagattttcccctcgttttatggtaccattaataaacagaaaatcagtctattgcctggcttcttctacacctttcattctttttgttttctgtttttgcctcatattccttgttgaactaaggccagccagacatcattctctggactactttggcactacatgaatgccttgcctgcaactatcagtgtcccatgcagtaataccatcagcagtatgtcctagagaaaaaagaaatataaaaggcgagcagcgaggagcaaaataatgcattctttaattacatggcagacttacccttaccagccaaagtaaatcattgtacctgagccctttaacacagcttttgtcatcctaaagtgctgtgcatgggcactaatttgaataataagagaagcgtgtatattgtttgaagtttgcccactgttctcacttgattccttccccatgttctcactcccccactgcctttctcaacacagatcgtgacttgttatcagattctgtggccgtgaacaaaactgggcaggggatccttttgccggaaattagataggctcaggtggtaaatgctccatgtctccatgtataacatctgaggcaagtgcttcagttcttgctatttctataacagctattggtcttcttttaacagctgattcaatggcattgtgcaggaggaaaggactagtagacgtttggttctatttatcaacactgtattagttgcacaacttttttcccttctgattggcagggagaagcatactgcttctagatgatgctgagcttagtgtaaaatatgccagcatgggatctgagctgacacagttcattctttcttttcatttggtttgtagaaaatagacctctccctttacttatcttgtgcattagaaagaaaaaaggtcatacatctaggagctaatggcttattggtgtcttttagtcaccagattcagatagtatatttagttgaaggttgcagcagcacacacttggctttctcatttgtgttagcttcacttctagtacagaattgaataggattgaagagacggttttcctgtttgtgtctgtggcaactttttcgatgatttgtggtttaattctttaaacatttttgatcacttatcacctctttctctgtgaaggcttaaagtattcagattctaatgttataatcttttcatcagattatttaattttggagaaatcaaggtcagaatagcagctgacacagttgtctctgaatagtgacctaaaaattataatacttctttttttttggcctggattttatggtctgcctttgtggcatcagatttttaaataagattatgtgattgtgaatcatgtatttcttggtctctggcctcttaaacaggtaactatatgacttggaccctttttaagtctgttttttaaaaaatgttaatctctcacatggtttttaaactgttgacagtattgtacttgacattaattttgttaggcagttaatgcattcttcggcataactttgtttcttgggtcttttcaagacctgtcaaagaaaacaaaatgctaacctgactttaaaggggcaagaaaatcccccccaaactatatcattctttgttctctatgtgcatcaaagtgacaatcctacactgtctcaattgagcgagtctagcacaaaaatgaaaaacagcctggcactgttataggcttgcagccaaaatgttttgtgtagcttggttctggcagtggtttttgtaaggcagagggtctaccctcacagcatcaccgaaggaaggcaggcagccttagtctttcccacttacaccattatttccccctcttctcttcctctttcttcacacagaccaccattgtgaaaagaaatatttttttctgaaatagaaatatcattccccttacaacttccacatttagtaagtggctttgttccttatagaagttggtgctaaatttgccttttccactctcttagatattttctttacagttgcatttttgctactattgctaactttggtcatgttgacacagtattttttattggttggaatcttgtctgcttcagaatttattatttgaatggaaacttttgagtgatatttgcctttattatatggatttttatgccaaggtatctcttgttgagaccaaaatgtctgccattgttttctatttttgtctaaaattcagggtcagttcatgtcttttacaaattgaatactcacttttagagtgtctgataagtcttggtagataagcaagtgaacttccattaaaataaaggatgtgcatttaaaatatttttcctttgaaataaaaaatgcaaggtaaaacacagaagtgtttttaagtttaccaattcttgcaaaattatagttagtgccctaccattaggagtgtgaaaatgtggcataatgaattttaaagagatgatttgagcaggagactagattttcactatgagcaagcattcgatgaaatttcgtagaatgttcctcacaatgtaaatatgttttctgttgtattaagcaaaacaaatgatttactttcaggtgatctatttttaaaattagattttttagagtgatctattttaaaaattagttttgcaatcaagataagaacagttaatagtcagaatatgtttttatagaaggagattgatattattttgactgatctttattttaaaaattgtcaatgatttttggcaataagaaaattactttgagaagaaaaactcatgtatttttgtaacagtgtaacaaatgtgactgaaaaggaagtaaacagtggctcatgtttgaattattaatgtgaaacatttttatatgccatatatactgggaaatacatctattatgggtactttaagataaaattgtgcaatctaacagttgtttcttttgcggggatttatttttaatttagaaaacactttaaaattattaaaaggatttgtaaaacagaggtgtatcagcagtatgcattaaataaactcacctgttattttctctcattcagaacaggctcagcaacatattggttcactactttagcaaaacaaacaaatattcaaattgctttgtatgcataatacacatgtaataaatgctacagttccccattgctcccaatgctatctttttaaacttgcaaagtggctttttttatgcagagctactaaaatgaatctgggtgggatgcctgttaagttatatgaattaaatctttaggtcaacattttaaacttctgaattctgacagttttgcgaaggcatgccagcgaaacttttttcacttgatccagttaagttcatgactgtcttgaatcccctgtgccaaggtctgataatgttaacattagcgagtaaagataacacacacacacacacacacacacacacacacacacacacacacacacacctctttcattctgtgtatagtgaataatgtttattgcatattaaccactattcagtgactttaaatacactttctgcagtggtttaatttttatttgcagtgaaaccctttattttttctgtggtaagaatatatcttttagtgatttaggacaatgtgaattgtcctatttatttattctaactacacacagaggcataggagaaatatttaagagccataatgtttaagcagttttttggtaaatacggttgagtttttcatttttgtagaatagaatttatagacaataaattgtatagttttaattcagaacacatagcaaagctattatctttttagtttgacattatatattttttaggaatataatatagtaacttaatcattatatttgtaaaaacatggagaaaaatttattaagagataacagcaaaattgaataaacactgttgattattttaactaggattttactatattaagtatcaagtttataattataactagtacttcatttcatttgaatgtcaatataggtttcaaacatgactcttggggagatgatttgaatgtcttgtttgatatcaaatattggtaatgtaataacaaatagtgatttttaagtttatgtggtcaaaatgagtaatcttcccttaaccatatggtacatactttagtgtcaaaattcaatagatagtattgcatgaaagagtacatgttaattcagttgtttgatttttcctcttaatttttgatacgttttaatttctcccaccctctgacatattattctgtagaatacttttacaagtatttcatatgttttctatggcatctcacactgctcactttttatctatagtaccatatgagttcctcttttttaggtttacactgcatattttaagctgctgatagtgtaagtagattgcaaggtaaagtgacatttagctttttgagttagcttcatttttagcatgagaacaggttttttttccctgtcctaaatcttctcatatttcccattaaaacaatcttactaacattgaacaaagaaattcagggatttggctaaagcagcaattgaaatgcatcaaaaagtggctactacaatacaattttattaatgaatgatctacattggttccagctgtgtccatgtgattaggccttcaccaggcaacaatgggtatttccctattgcttttatttgatttccaagaatgtgtcatctgttacatcagcctctgccaatatgcccctgtaaaagtgtttttttttccttctaaatttctgaagcataagttgaatacccacacatagccctgctgaaatattgtttctattgaatggtggcctaggtttgtatgcctggtgttgcataccaaaatctcagaatgtaaattaaagtaaatgtttattaagtttatcagtaaatttttggaagtgtggttgcctggtaatgctaaagatagactattttagcttttacattttcatcttaatattttattacagtggtataatgtgttatagaggtggacaagcctgcagattgaagtggggatcgtccagattgttcccttccctggaccatatggtatagttctaaaagccttttgtacgctgtctgttcagtttattgtaaactcaatctttagtgcgcctaaaaagataaccaaataaaagtgagcctgagaaaacggacttcatatcatatagggaccccagatatatatttttgaaaggagataactgaaaatgaaattgaagttgagatgatattataaacaagggagatttgtcattctctgaattttttttatatcacatggattttcatagattgtctttgaatactgcttttaaaatgaaagcatttatgttatgtgactatagttattatgcttatttatcccattcttagggtttcaggaaaaagaatgtagcattgttctgttttacagaggaagcctctacctgtgactgatggtaaggaatatataaactacaggttttatgaatatgtggattttttgacttaccttcgtgacaatttaggctagataactcagtaatttcattctgtgaggaattacctatacccagagttgaaaggtttctaattcttatttgttttcctttcttccccccacgcctaacttaatatgtttctataattctattttaggaaaatagagtaagagattgcttatcctatatgctaagatcctttagaagcaggaatgagtgattgctcctgactctcactctccttccctccaaagtaagccactgtttgagaagagcattagacattacccactgctttttggcataagagatttgaagttgaaatcctaccaaactgggggataaaaaggaaagcctgtgaagaacatggttctttactctatcattaccctgaaccactgaaagggtaactgagaggaactcaaatgtttttggaatgtgtaattttcctttgaattgccacagtgaaatatatttcaacaaaaaaggcagaacaagtatatgtagtgtacggagttgatggtgattgaaattaatgaatcttttcagcactatacaataggaattatcccaagaatagtacacatttaaaatttgtctgagagaaacatacatagagaatgattattgtgttattattaccttagggagatgactagagatagatggaatattaaataatacaataatgctagtggtaaattagacacaaagtatttgttgggatatacacttttcaaattcaaaaagttttctaaaacagaaccattgatttcaagtgtatgtgtggagtcttccctatttaaaaaatactgttgttttgtaatctctcatttattcttttttttttggatggagtcttgctttgtcaccaaagctggagtgcagtggcgcgatcttggctcaccacaacctccgcctcccgggttcaagcaattctcttgactcagcctcatgagtagctgggattacaggcacatgccatcacgcccggctaattttgtatttttagtagagacagggtttctccatgttgatcaggctcatctcgaactcctgacctcaggtgatccgcctgcctcagcctcccaaagtgctgggattgcaggcatgagccactgcgcctggcctttcatttattcttaagccactttctaaggtgcccacaaaattgaaaagcatagtttacactttcacacaaattagatccctcccgttttctctccccccattctccttcttttctcctttcttcctaaccttcagctatttacttatatgtgtgtattatatatatgaatgttatataccatactatagaaaaatgttattttaatagatttgagggattgaaggttccacttaaaataaaaatcttgtaataactatgcaacaaatggatttatatggaggaatttgaccatgtttatagaagtaattcagattacagaaaattgtaaaagtgtacattcaaaattcttttttttctagctagtaaggactggattatagcttaagaaaggaggaaccataaagagtctaactcaagtatctctgttttaacggtaaaaatgcctctggctccaagtagtagaaaatcttactgacattaatttaaatgagttagtgttttatttgtctcataagaatcagaaggcagttagttcacaggtaactgatactatcagggatccaggtaatgtcttgcttccccaccatccttagcatgttacttttgcctcttatttcactttcaagcaggaagaacaaagggagagctcagaaacttccttcccatggatactttctctttttctttagaaagggatgtttactcacagggacttctgtctaattctcattggtcaaaagtatgtcccatataaccacctctagaatgaggtaacaaatgttttcgctttctagcccctagagtgagataatgagtgttttagctttgtagcctcttttggaggaaggcaaggagaatgggaattagaatgagtgttgaatgagccattctaaagttatctgctgtacttccttaattcctatgtacagttagttgtttggacttttgaaactctctggatacttggtttatatagtaacttgctattggttgtcttttgaacagttagtgcatatgtgttggtattgttatgtttccatgtctgaggacaggaactgtaattgggtcatcttggtgtctttacgcttagcacagtgcctacatgttgaacctcaataatcccttcttgaatgaatgaatggatattaagaaatatatttgttaatattatgggtataaatcatttatacatttaaaatatttttaatttgtgagggtttgtggactaaattttgtggaattgtttgttattgctaaggggacatcagtgtaataatgtccaagttgttttgaaaaaaaggtaagtcctcaaaatggtttagtaccaatgtttgttgggggctgggtattccatgagtaaataagaaatgtgattgcttttaactctatgcatagactattgtttaaacaaagatattttgtagtacttatatgttaagatctcagtttttaaagaaataggcaatcggaatttatttattcaaaaggcaaacaggtcatttgataatttatattgctgatgctgatttacaggtccttggaagcgtcatatggctaaagacatattaaagcagattttgcattagttgacatttgagtatatatgtttttaaattcttagacgggcagctttatactttttaatacacaagcaaacaattatgtactatagaatttcatgtccaaaagaaatcttaagaggtcatctttacatctgcttgttttgcccttgactgtcttagaaggatggagactacctcttcatttaaaatctgcagaaggaatggctcagacttggtaggaatcagtatcttacaactcctccagtgtctaagttaaattctctttattgtatttccattcagtttctgttattttaacctcagaggacaaaatgaacaactgtctactatctcccatacaacatcccctatataaccctattttaataaattcctctcttttcattgatgatggcagggttgtttgtaccttaattactaaaacagtctgtgcatggatagaacttaattcaaagcagggaatgtattcaagtgtctggaactcaaattttctatctgagcagtttatagtcactaagaataaaggaagcccttttaatattcaaaagcagtactaggagaagggttcttacataatcacaatgtaggcaaaataatttcctaaatttgaactcagaattgggtattggtagttttatttggcccttaagcagaccttttggtcatacttttggaagtaatgaaggtcaacactttgcacttaaaaaagtgcatgtaaaatattagccctccctcattatttttacctttattctcagtgatcagtatagtatctggctcacagtatgcacttgataaatgtttgttaaataaattgtaagtatcccttgataatgcttctaacatgggtagctttatgctttgcatttctccattcctctgtatttcatgctgtccaataaacactcacactttattttttactgtctttatctttctattcaatgatattgaccatgatttaggatttatttgaagatctgaataccatagtaatacctgaacaattcattttgtgatgacactgtaattttcaaattcaggaatacctcttttgttttattcctcataagatagtgatctaattatagcctattgatgagaattcagaatacattaactgaatattgtgtacaaagcactttgctgggttatgagtagttacaaacatgaattgtacataaactttgctgccaaggaattgagatctgattgggagacacacacacacatatactgtataactatagtataagagggattgtggtgactgctgtaaatggggtaaaagcaaaatttagggcactacagaggaaagcgtaattacttccgactagctgaatatgggtgagtaattgactaagtcttcacggatgagatgaaatttgaatagagtcttgaactatatgtctatatgtaggaatttgacaggtcatgaaggcaaaaggtttcagagaggagaaacagcaggagcagtatttgcaggtaggaatgtgtatggagtgtttgataaaatagaatggttttagtatttcgagtaatagtgtgtctgtgggagtgacagaaattgaggctagaatggagcttggaaccaaattgtaaggggtcttatttcttgttaaataattttctttatttcttagaaaaagtataggtttttgagtggaaaagtgacatcaagatatctataaatttcagaggaagaatggaagatgttaaatgtagctataggtagggagatgagttagaaggctgatgaatagctcatgttgaagatgataagggaggctggaggcagcagagcttggaaagaaggtctgataccagaggcctggggtgggtcagatgccctgtggcctgttgatttgcttagaggtgtgcagcagtgtactggctcccagtagaaggtgctttccaattttgagtcttccttctacctataccattttggtggtctgtggaacatgctcccacttgctgcacctgggagatcaaatattgcaaatattttagcttgaattctagaaggaagcaaaaggagaatttgaatagttatgtgagctaatgatgtctgccacatttcctcaactctgtatttcctgggctcttggttcaccttcttgaactattcgtataacttgctattggtccctctttgagaccctgctcaaatgttctacatttatcattctgtattaaagttatatccaggcctgagacccgagactatatttgggtcatgataatatcacaaaacagttactttaatttttagaatgtaataattaataaatgcttgttgaataaagcaaatttgtttatgttttgtggtcgcacagagcttcctactttttgcacataccaagcatgtgtcttatcagggtcttgctgtgcctgttgcttagatccagatctacatactccccaatcccctcgccccttcttctgatttctgtttagatgtcatctcattatcagcaaggtgtttcctcacaaccctgtataaaataacctcctcacaccagccctcagtagctcctatcctctgttaccatgtgttatttttctttataggtgccctcatctgacatacatttaatttgatgctggtctttttactccaattagaaagaaattgtttgtgataagagtcccatttgctttgttacctaatttatccccaagcatgcggaacaatgatgagcagacacttagtaggcacaataagtatttgttgaatgaatgaatggtagagattaggctgaaaaggatacaaaacattcacgtacaggtttgtttataagtttatccaagccatggcattgttgttataacttttatgatatcaaatcattaatatttctctcagaaaataaaaaagaattctattttctatagcttgtgcctgtgaaatctaattaaggattagtatttgttttaaaaacatttgaatgccaagcatatccagtcagaaaacacttttattatccatgccagcttaatttttaaggcagtgaaatggaagactgtcattccagtaagcaacttattttcatttgtgaaaatagaatattttgagtattctaattgatttttgaagatggttttacaagaaaataatccttgttgctgtacgttgtacatttgcctttaggatggaaggaaactagaaacaggcctggaaattatttgctcagaaaggtacaagctataactgaattgatttttgacaaaagtatcaggaggagggtcagtcaggcccaaggtgaaaggtaaatcttgggattctcaacactttaaagaagacctgattttaaaaatcgttttatatgtatatttaaagtttgtaaagagattccagactgtcatgagctcaagactattttttactgtattttatgtcaagtttcacttggatatttttctagaaatcttaagtctataattgggcagtaaaaaagttggttatcaaatcaatattgttatatggcttttagtgtcataagaattcccttttggaaacccataaaagctcattttttctcactataaactttatctgtcagttttctagaaggtcagagtactaatgttggaggtgatctgctctgggacaaagagtcaacaaagtggtagtaaagttaaaaaatgccacatggtgctttcctaagaggaggatttctttttcatatcaagtttgtgcttattttaaaatatgggaaattatatgtcgataagcatagtcttcatacccatctaaatagataaaataagattgtgtctagtttttgtatttatatatttcatattttattagtttttttttgttttctagaaataacttcttaattatttgtatacttttagtagtttgatttcttgctagatttgtaagttaggttttttggaatgggtggtttaaaaatgaaatgtgatgaaatggttgtgttggaaaacaattccaggaacagagtgatttcatattatttgaaaatgaaacatgttgtttagattgtaaaaagtactagagcttggagattccctttaaaaatatttctctactaagtctgagttgccattggttaatatttattgattttccattcacatattacgtgtatataaatataggacaaatctgagtggttatgagaagtcttttaaaatgcaaatctctctctcttttagttgactatccaatcagtcctcgctccgttttttaacatgtgcaatacatatggatgattatacaataacattttccagctttcttttcttttttctgtgacagagtctcgctctgtcgcctaggctggaatgcagtggcgccatctcagctcactgcaagctctgcctcctgggttcactccattctcctgcctcagcctcccgagcagctgggactacaggtgcctgccaccatgcctggctaattttttttgtatttttagtagggacgggatttcaccgtgttagccaagatggtcttgatctcctgaccttgtgatccgcccgcctcggcctctcaaagtgctgggattacaggtgtgagccaccacgcccagcctccagctttcttaatacaagacacttcagaaattaagtgtgcaactagaagtccttttcaatttccttcaccttaattaaatatttccccttatttcaagacccatacctaattatcaaagcataacattttggcattttacttgaagtttaaaactttgagtttaggttgggcgtggtggctcatgcctgtaatcccagcactttgggaggccgaggcaggcggaccatgaggtcaggagatcgagaccatcctggctgacgtggtgaaacctcgtctctactaaaaatacaaaaaattagccgggcgtggtggcgggcgcctgttgtcccagctacttgggaggctgaggcaggagaatggtgtaaacccgggaggcggagtttgcagtgagccgagatcacgccactgcactccagcctgggtgacagagcaagactccgtctcaaaaaaaaaacaaaaaactttgagtttatattttacttcttcatgttccatttcaaaactgtaagtaccaaaataattattttagtttctaacatactgtcaaagtacagcctcagattccttatatgtaagtagagactttgatcagtttacaactatttaataaacaagtacattttaagattgagaattacttttagttcatatattacttaaacaagcagtatttgcaaactaaatgatgctgttttgaatcgctatagcactattagttttaacccttgtcgattagtttttaaatgaatttccttatagcaatagtagttataataatttgaaaaacacttgcaagctcctggaagggaggacgccttcagtaattgggaagtagtttgttatatcaaacaatttggcctccttccctaaagttaagaaaaatgttgtagcttcttttaattgaagttgaaacatattcaatgaagataacttgaagaataaaatgaagcacaaagaggaaaacaaaatgattcccagttttacctcaaatgatcatttatgtttgcgtgtgtgcatgtactctttctctcgtattatgatatattcatttcataatatgtttttatatattcatttcatgcagtcatgcaatagtgtaaacattttcccatggcaatatatattcattatattttttgatcattaatcatttaatcatgagatccctttttgtaggatattttgattgtttttaattgggggaaagactgcagtaaagatttttggtaacttccagggttaatccttaaaagtggtattgctgaatcaaaagatatgcatagttttcaagctttttgtattatgatgaaaagtgatagaatattctaatactttaaagcaaagctaaccatatgtattagtcgattgggtagcagctttcagtctacattttggagacatgagaacagtccttttttaattcacaaactattctttgcatctactgtacagatggttgaaatttcactatcacctgttgttctcttgtaacatacaagtactcctgggagaggtaacacattgtaccccagcaggcatttactccaaaaaatatgatgtggtttatctgatattttaaatttaattcttgcaagtgaagtttggaaacaaggtgggtacattgaacaagggtaatgcaagaggataataggatacttcaattctatcaagatcaattcaacaactattatagaaaatagaggatattatatgcctagttttagtagtttgagttataaattctctctaaaataattcaggctgtttgttaactgtgaatgctgattaatccagtagacagactaatgatcccatatatggtgtatatatgtgctggagagagatgcaagggggaattaactaactcctaagtaactttactctgtttgaaaacactgtttgcaaagtgtgaaattactttaagagatggtgaggatgcagtgtgcagctttgggtagtttgtaaggaatactctggctatagggtctctgcttcattagacaaaatatttgtatcattggaatgtctccttgaaaaaccagttgataaagagataggcaaggccactaaatagataaaagtcacagtgcttgttccagtcaggaaacttcaagctgttgatatgggaaagcccgtgcttcctctgcagaaactttggacaatagtagaccttctagaaattatacacagttgtctatgtataccttttctttatttaatagtttcaatcctaaatatcttcaggattaaaaaaaaatcccaatctattattaacagactgactctttttcttataatagtgggtagctaataatatgcctcttgtgatatttaaaaatagtgatacagctctcattaccacatctattagtcccagatttactcagccctggtctaaactgggtttctgagctttttaaactttagcattaaagatctctagactctgtccagtttttctggtgttgcctttgtaaactgtcagcacgtgtcttaaactattagcaaatcagaagattattaaaaatatatatagtgactagaaaaagaactccttcaaaaaataaatagaagaaaatgtacttttactgaatactttgaatacctatctgtattcatgtagaatgttggagatgagagcagtatcaataaatatgttaactgatgcagcttttattttattgtaaatttattttttctgagacagggtctcactctgtcacccaggctggagtgcagtggcatgatttcggctcactgcaacctccacctcccaggctcaagagatcctcctacctcagccttccaagtagctgggacaacaggcatgtgccaccacacccagctaattatttgtatttttgtagagacgggggttttgctatgttgcccaggctgctctcaaactcctggactcaagcaatccgcctaccttggcctcccaaagtgctgggattacaggcatgagccattgtgcctggtctgatacagctttaaaacatggttttgttgatttggatgttaaaggacagtttctaatactggcttcacctcacacttcctaacactatttaaaaagtctgttactgtaggccgggcacagtggcttacgcctgtaatcccagcactttgggaggccgagatgggtggatcacctgaggtcaggagttcgagaccagcctggccaacatggtgaaatcccgtctctactaaaaacacaaaaattagccaagcatggtggtgcgtgcctgcaatcccagctacttgggagggtgaggcagcagaatcacttgaacctagtaggtggaggttgcagtgagccgagatggtgccattgcactccagcctgggcaacaagagtgaaactccatctcaaaagaagaagaagaattaaaaaaaaggtctgttactgcaaagtgatttttcactgatataaaatgaatattaaaaacatcaaatgtgtctaaggttgatccatttaaggatatctatttctagttcttcagtctcttatggaaattcctctttcttctcccaaatgtttacctgatattctttcacctcctgagatgctaggattttgcttttttttttttttttttttttagatactttccctcatagataaatcaaattgaattgtgagattatggccttttcatttttcattagaagtgactaaatccagtctaaatccagtaccttatactcagtgacatttatttcatctcatcaagggaatgccacccatgtttgcttgtgttactgtacttcaaataggacgttgagaatatttgtatgttagagtaacactgctatttctgtttcaaaattaactgaaaatgtgtctcccacttggggagggaaacttctcaataacttttgtagttaatatggattaagttattaaaacatgtttgagtattcttaatcagtatagttaagaatatgttagtcatcttattttaaactcatttggtgtgtatatttataattaccctgcacaaactcagtctgagttaaatgttggcatagaagccagtgtagggtagcaagataatgtttctgtccaataaaaaatgccagtgtaatgattaagccagtggactccttccaggtcatagacatgattatttttgaattaaacattcttgtagactccagtcaggttggggaagatgctttgccatggcatggaacatagtttctaaatccctcagcagggcagacaattttccttagattgaggggtgaaattttaaatagaattagatgccacctattatatttacatggtaatacaatctgtacataaaattctgcctatgagagtaaatagtaatgagtgataggaagaagtaattttttatgtctgataatagtacaactcttgaatgaattaggaagaaatcgtcacggccattgctaaagggttttacggttcattgactcaacacacatttattgaacactttctgtttgctgagtgctagagataacaatggtaagcaaaacagacctagtcaagtgtctccgtggaacttaatgtccagtggagatattgacattaaataattacttgtataaatatatcctacgtgtgataagtacacagaaatactacagattgttttgtcaagagaaccttgactttgcttgatggtaacagtagtaaatttttgagctagactgaatgcggctacgtggctgacttcttcaccttctactccaaacctttattggcatgtgaatcttcagtattgtttttttttccccctccagtcctagttcttaagacctattattctatcaaaaaggtgactgtccagtgctgaggggtaaagaataagggttatatcttcagaggagttatgattatgttggactctgggaggaatcccaagagattctaacaaaaaaattgaagtatttcactatatgatattcagttacttatattattgatgtcttggttttacaagtgaggaggcattattaaatattgtatgcaattaatatattaatttatagtgacatttatattccacaagcatataaaacatataccgtgttatatatatatcatttaaatattaataattattaaacatttttatttaatcctaaaactcaaagactagaaaatggagggttttttttaacttatattgtatcctgtgcctgcagtgaagtataatgggatgccatgtgaatatggagttggaagacctggattttagtcttgctgtcacttactctatgatgccgatattctttatattttgtattctgtaaaagaaaagtggttcaacaatggtatcagcactccttgcacctattattctgaacacaccttgacttctctgcttgggcattcgtatccgaatgggtcagggagcccagttttctcccactgagctggtttacagcccatttcaagaaggtggaagacttctggagaaaagccatctttgagaaggaaatacattattcatcttgtcaaacttttataaaaagaataattgttggcagaaagtatttaaaaatgtctttttttcttctctgttaaataaaagcctaattactaaatgtggaatgggctctctagattgatggtgagggaattggcttcttatcctacttccacttctcaaattaaactaggatgataatagatcaaacagaataagaaactgcagatgattttcaaaatttatgaaatttacaaatattctcttaggccattaaatgcactttggcctagaattcaattgcttattctgtttctcccatctctttaatcggtgttacttctcttgtattggtaggttaaaataaacacatatctatatggaaaaaattattatttcccataaattctgcttctgtcaacaataaaaaagaatcagtatttgaaagagaacataataaaatgtgtccagatatacttgctgcttgatttagtttagacttcaggaataataggaaatcattagtatcaagtacagtgctgtctgacacttgttgctgagaacctgtgttaagtgaaaccagtgttactttcaaggcagaagaaagcaacttcctgtgtccccctgattttcacttcagctccagaaaaacctagtttgtctgctgtgtgtcaggtcctgagacaactttcaggaaaataatagcatagctcccagttttcagattttcacagctgcatgcagaagcagaacgtgtgactacagtgaaacaagtataattctactatacagagtataaaggaagtcatatttaggaggagttcagggaaaggcttcatagaaatggtgattcatgagcagaaattttaacaaaagttcattagttgaacagagagagaaggctgatggaggtgagataaatgtgtgaagttataagagtctaaaacagctctgggagtgtgggtgtttggtattgctaccaagtagagtctggggaagttggggaaaaggaattgaagtgggagaaggccaaatgtggctgtagtgaagagaaaggaaggggccaggaaatgagtcttaattgccatgtgttgggccttggattttacccttaggtgatttaaggtttttgagcatgtcattttatggtcacatttccattttggaaagattatttgtgattagcttaaggagaatggtgtggtgggaacaagattgtatggtagcatggagacctacttaaaagggcaatgcgatactttaaatgagtggtgagatgatattccagtgcaaaactttctattgattcataaatatgctgccacatttgtgaatgttggcaaattaaaaatatttgtagtattcagtagaacgaattcattgctgcttttatagtttgaaatcattcatggaattaatagcattaaaaaattgaaagagggttaatattttgtcagtggaattaaaccactcagcttctcacagaaagaaaaatcttgtaattttttaatataatgtggaatataacctcacaataatatattgaacttttaatatatacttatccagttatttgtggaaattgtgcatatttgaaaacaagtacatgacgtgcttagtacatgctaagtactcagtaactatttgctgagtttgcatttgatgcttgtggagttttaaccaagacactttactaattcaagtcctggaataagttactaatatatgtgtgtgtgtgtgtatatatatatatgtgtgtgtgtgtgtgtgtgtgtgtatatatatatatttttttttttttaaaaaataaagacaggacctcactctgtcactcaggctggaatacagtagcacaatcatggctcactgtaacttcaaactcctgggctcaagtgattctcttgccttagcctctggagaagctagcattataggcacacactaccacactcagctaatttttaaaattttttgtagagatggagcctcacaacagcccaggctggtttcaaactccttggttcaagcagttctcctacctcagcctcccaaagtgctaggattacaggcatgagccagtgcacccagccatgactgatacttttaagcagaaagttgaattccaaaccaacaaaaaaagaaatgttttttagggaaaattaaattatcacaaatacatataagatgctaactttgcaaagagcatatatttaaaagatcattgcaattcatataattggaaaagcacatttgaaaatagctttaaattttctcacagaaagtatggcgtatgagttttcctaccaaatcttggtttcgatgcatgaattctcagttcttagtctctacaacaagacacaaaaatcagaggaagagattagcatatccatggcattgaggggggtatacattattagcttaccacatctttgtcagtttgaacccagaattaaagcgaaatgttgctatttaagtacatatggtagtacacaactacaacataaatattagactgtatgtctcctaaccaaataatggaataatgatcagtatccatcaagtgttagttatctgcagttcagactaatgctccggaagcagattcatttctattagccaaactttgtttaaatttatgtagaatattttcagtgcatagagttttatgactgcaaaattattactttgcatttgataccagattatatttcagtttttagaggttatattcaggttttagaggttaagatgaatttgctatgcctgatttttatagaagaatttaaaaaaataacttttttgtagaatatatttatcttgtctcttttttcccatatgataattgattgtagtacattactttgaggaaagttgtttagcaaaatgtatttttacttcacactcttaatagattctgttaggggaatcactggtcacatgttttaaagcagagatcttttcatgcttatttttactatttaatgagatttcaggtatattttaacaacttggggtttccgtgatgaatcattaaaataagtgagtgggctggaaggtaatactaacttttctcacccctgccctattttactctgctgggttgttggttgctttttatatagaacctgggtgtgttggtgggtggaggtgcagaagggaaggaagagaaagggtcagtaagaaaataccaggtaaacttgtgatgacctactgagaaataccgctcaagtttcactttccccaaagtaaaccatttagtgtttaagcccattgttttttgctttaacaagcttaagtttccaaatattgcatataggtaaatcaaaactatattttcaacaattgattgaagttttaaggtatcaagccatatgtggattagcctgtggaatcaatttctcatgtgtgtgggatcaaaaccgttaaaaccatcatcactgaaactataccttcctacaactaactaataacagaaaggtgtctatggaatatattaatacaacaattcctctgatttaaaattattactgggtgtttggttggaaaatgatttgaatattataggtaactaaattgacgtcatatatgaaagctaattataggtttcagtgtgactaaaatttatttttttaattgacatgatatacttaatatttagcatatacttttcagtaaatcactggcatattgcagatttttaatatctatactgttaaaaacatttcaactaccacagcagttctaaatgctaaaggaggtagacaaaaatgtagttcaccttgaaaatgatcatggcttagggaataaagaaattgggtcaagtctaaaataattgcaggtacagtgacaaaaagttttaataaaaatttaaaaatattcatagcgttggtttcaggctacttttgttctctgtgatcttatcaatgcattattagtttttaattgggatgatgctaatggtgatttttcattttggtcaaaatgtttgtatgaaatactattgatattttcacattgtatcccctttcgattatgaatatgcatttttgaaaaggtagacaatttttaaatagatcattttgacttctggtgatcttaaatagaatttgaagtggtatgaaatttctatgtcacagctatcactttgacttattttatattgccaaatttgatgtttagcatttaaccatgtatcattaaatcatagtattgataatgaattaaactttcaaaaagctttaatagtatagtaggttttcattcatctggtgtcattggggaataaattgtgctgaagaagtgagtttttctttaactgaagcttgtttaagcagaaaaacttaaaaattgattaaaatttatctgaaatattttatatgctctttcagggagcaagcatggagtggccatttactcttttcttaatgtcatataatactattctgagcgccatgcagaaaggacatgggttttctgtttggtatttgttttccaaactaagttttttgttgtttcttccttttaaagtgccacatccctaattcgggtattctttcgttgttgtttttgttgttcttgttgttgttttgagatggagttttgctcttgttgctcaggctggagtgcaatggtgtcatctcggctcactgcaacctctgcctcccaggttcaagcaattctcctgcttcagcctcccaagtagctgggattacgggcatgcctcaccatgcctggctaattttgtatttttcatagagacaggctttcaccgtgttggccaatctggtttcgaactcctgacctcaggtgatccacctacctcaacctcccagcgtgctgggattacaggcgtgagccaccgtacccagcctaattctggtattcgtgatcagtttaaatgtttcataatttaaggtttctggtagtacttgtgataatgctttaagaggttcataaactcaggcaccaataggagacatttggctctctgccatcttctagcaaacacttgaccacagcctccttctacaaaggaaaccctgtccttggtttggagttagcactttcaacagtgaggccctattactgctgcttccaagtactcactccttattagcctttgctagtggtgcaaaaatgtctgtattcaccctacatgcttcttctgaacatctgtagtatcaaggtgaccacttgtagctttctttgactattgctgaaatgggcaactagtatattccctttatattttagcaaattccaccatagcagtgaagtggttttttttttctttttcttttttcaacctcatgcttatttgtttcaagcagttttctaaaacaaaactcaagctcagccaaagtatttgaactgttctttaatgtgctatatgccatttggtttgaatcatatatttaaataccagcttctccccatttacttgtatctaataggaatcatctttcttccagattgtgcttcaagaagaccatagggaagaacgcattttcatcttgctgcaaaagttgcaatagaagtaagtgggggaactgccaggatatgtctgtctccacaaaacaagcagaacaaatttccgtgaatcaaagccactaagtatagttttcagagatggtaggacatagttattttccctagaaaaacaccccaaatgcaggcacacccattggccagcagaaaaaatgctcacgtaaatgctagttcaaacctgtacatttcactcttcttactgagctgtcagaggggtggaaatctactatagctataatctttttttccccttttctgtttttcagcctcccacatgcttagtgttcagttctgcctactgagcgtcttgaatctataggagcatctacatgtactgcctccatagtggctgataatttgcagataactcgtgaaccagacccataagaaacatcatgatatgtactttagattaatcatggaaaaggacaagatgatgaagaatcagaaagcagttttcttttccaatatttatattgctttctttgaggttagatgagtgagatattctttagagtggtttatatcacatttcatcacttggggaaataggtcatttttacaagagccttttagagaccttttaagtacatacagggcatatatttaatacaccttagcatttcctctgagtaagtcagaggaaataaagcaagatggtagatatctacgatgtgatcaagtaagcaaattaatgttaaactgcttatattctgtcttgaaacccttggtataattttcaaaattgccttttattgttctttcagttactttctagcaatttccatcatttgaaggattaatggctaccactttgttgaacctagagggtgtctgtgaacttattgaacactaccttattagagcagaagtctccagtggaccatgaactctgcatggctgggactctgaacttacctcttactcacaaaacctgcagggctctcaaattaatgtttaaaatgcaagctactgacaaggaatgggtaaacatccactgcaatttcaaacacatatgtatatccactttcctcatctattcctggtgggtaggggatcatgattgaaaattactgaacttaaaatggtagaaaatttgaagcgatcctttctacttaagtagagtgatttatactaatggtgggatgggctaaataccttcttgctatttgtagtctactgtgcttcacatgcattttctaattttatcttaacacatgtctgaggttagtactgttgtctctattttggagatgatgagactaagtcctacaaaattaggtaacttgtccaaggtcatacagcttggaagtgacagagctgaggttcaaacatgtatgtccttgatcctaggattcatgccttttccatctgaggacgaccactgattcttattttgcatataaatgaaatatacacacacagtcccccacagcccccccccgcccacataatatatagatttatattcccccatcctcccaaatgctcattggaaaatttagacatcaaaaggaagcctttttgctttgaaatgcaatttaagtagccattactttgaacaaagtgtagttttattagtgaagaacatcattgagtcattgagactaataattttgtggaacaacattattaagaaaagcattatgctatttaatgagtgatatttacttaagtcataaaggaaaattcaaacatctggaatattttttaagcaatatagcatttatgcatggaatgatgtttttcccctatgtcttacaggaaataacatataatttgagatgtatattagagattttatgttcatagatatctttttatttcactgagcacattaacaaaaattatattcaaatgaaaaatggcttgatagctaattctctgtgatgaaattttatcatgtctttagtaaccccattattgctactttatccctcttaataggttgcttgtctaaagaaaggttgtagaaaccttactggttcacacacatacaactttaccacattgttttggtgttccattttggggtgatacattgacaagtgtggggaagtgatcaaagtatgtgtagtgtctcaagaaattgcttcctaaagtttttaacactagaaaatagagatttgcatttggttgatatgccttcttttaaatacgtattcactaggggcagttatacctgatgaatttaaagatggagtaatacaagagttacagaatcacagaatttctgaaccagaaagggccttataaatgaaggactcttgaagtgaaagtcgtcattagaagatgagttcagtgactgtccaagactagagctctaagtcaagtagtttctgagattactgagttaggcttacagccgaacaaaccaggaagtgagtgatcacagcaggtgagggctttcagctttctgatgttggagaaaaaactaagagtcatagtggagacaatcttatgacatgaggaaaacaaatcagaaaaataaagacacctttatttcttcttattaacacaaatgatataaaactttaagtgttatatacttatttaaataatgggataagcctattttgaaaaataacacattgctaaattatttgtattttctgagtatgaaatttgaacttatttttattaaaaattttatacatgtatgtaatggaaaaaatatacattttttggttgttatttaggatctgaaggtttgaatgggccaatgagtatcctcatcattgaagcattctatggaggctcccataaacagctggtggatcttcttcaagaagagttaggagactgtgtcgtttatacccttcctgcaaagaaatggcattggagagcccggacatctgctttatatttctctcagaccattcccatcagtgagcattacaggtaattagagctcaggatgcattttcagcgttttttaaaaagtacctgttatgaggatgttgcttctccatcagtatctttgagaatttctccaactatggaattggttattatgactatagtagatatttctttagagagagcagagcagtggagtatactcatcctctaaggacacctggtcagtaggaaagaagcttcatttagaaccaaccatatgtgttttctcattgtcttgtgatttcattatgtataggggtatgggtatgggtaacaatttttggcctgagagaacagtagatcttctagtttggttcattgtatctgctctgtactaggaaccagagttgaaaggtggatacgtccaaggctttaaagtctgttgaggtagagataggcaagtgcaatgagaggtgaaagatggagaggttgatttggattgtgacaaactggaagtggctttgtagagttggtaacctttgacttattcttgaagggtgagtagatttgaggggcacagaactcaattctgaattctggtttgttaggaagtaggaactaggaggacctattagaaagcgtctcatgagctgggccagtggcatgtgcctctggtctcagttactcaggaggctgaggtgggaggattgcttgagcctgggagttcaaggctgcagtgagccagccactgcactccagcctgggcaatagagtgagacccccatccctaataataataacaataataataataataatttagaaaataaaagagtcttatgggacacactgaaaagatggaggtaaatactcattacatttttactgagggaacaggtaggatggaatccccttgaacatctcttcctccttattctccatttgtatgtattcctgtgtattctcctgatggttaaatcgtggaagactatcctatggtggttaacatagctgatgttcttgccgtttattaacacaaatgatataaaactttaagtgttatatacttttttaaataatgggataagcctgtgtgtaggactgcattggtttgggcaggaatgaacagttctgggctgataatgaatggagttagagcagataggttcttagaggaagggcatgttggaagctccaatgcccatcttgcctccagtacctctacccatctgctgcttctaaagtggccacaggagacatagcagcttgtgacttaaatgtagcttgctgttcctagtaggaacttgagggattcagagagtaacgattttctgtatgaaaattatgtatcgtctctgagaatgcatagtgtcagatggaatagcagtgagcattccagttacatggcttaggattttaaaggtaaaatgctgttttagtgcgtattcagaattttgtatttttttcgaatttaaagtgtatccttctttacatgatttaatgttttatattccgatatcactaagtgaatattgttgattcactaatagtatgaggaatttcaatgaacatgatgatataaaagttgtaaaggcaatgataagactattgctgtgttaaaatatgactgtttatggttgctttcacatctcatttaattgtgtttttgcagcaccaattgtattatattacttaaggtcaagtaatccagttgactttatggcactttttcatttaacagtgccattcagtataataaatttctacagtgatttgaacattaaaatgagccatttctatatctgttgtttgatttcattttgattatgcagtttttcagaattacattattgtatcacaaatatatgtgtgtgatagcatgcaaacacttctgtgcatatggcttccctactctctttgaagcctgaagcatttgagggtaagtgtcacagcatttgaggataagttatttgggaggtggatatctgaaagatggtgatataaagccttactctgcgatagccataacctccaccgcctaacaatggtatctgtcatctctcaaggtatgccatttagcctttgcagttaactatactaatctaatcagtctttaacccaaagacatgcctcaccagtttaacttatatttgagcaatgataacttctctactctttaccaagtaacttttttgaatacttttagaaaaatagcagtagcatgaaaacttgatagcatgatactaagtttacaaatgcgtgcattcaatcctagattgaagtgcaagagtaaccttttgctacactaaataagtctgagctctgtggagatttttaaagatatgaaaaatttttgctttccagttgttactctttttgtatatttagtgcatgaaatcattaaactcataaaggtaaaatgattaagcaccaatattgcctactatgcaaaatactctgaacaaatacgagtgtgtctgatgagaaagactttgaatgtagatacatattggtgtttttctcagcttctgaacatgtattgttgctattataagcttactctctgaaaagtattttattattaaaagaataaatgcttcagcctaattaatcagtttgattctgctttatcttgacaactaaaagaatatatcatgattcatgttagagctgtttagttttattatagattacgaaagctcaacaagttattttgtcaaaagtagtcaatagttattgttattcttagattatattatagctttgccttagaaacttcacaggatacagaaaaaagttttgaatgtggagcttgagggaaggcattaacttttgggttatgaaatgttaatcattcgttccaggatgaagcatttctactttcttagactgcaccctaaactaggtatcgaggatattttattcacttttcattctgtagtgtctttagtgaagtgaaagaatctctgttatttagaaatcattttttcaccctcaggtgcttacaattacattttttgtttcatctgaggtattgtgacagatactgatcattgcccacttaacggcccttcttccttgttaacagaatcacagttttctttaggatggataggtatccagcccttgggagtgaagcaacattgacttaaattagttaggatgatcccattctcctttgccaaattttccctactctccttgcagcttgggttgatcagtctccaagttgtggcaaattagagttaagtgggtgacttctgggagttcttccagcaaagtggtttgattttaaattttacttataaaagaagaaggccaactcccctttcctacatttgactggttgtgatgtccgcaaccatgaagtacaagcatgaggacagaacccctggattgccataaatggctgatgggaggctgcaaagtgcctggattagtggtggatatgtgatttgagttcaagtctggccacctgcaaagactatatactattcgttcttcttcttctttttttaattatacttttaagttttagggtacatgtgcacaatgtgcaggtttgttacatatgtatacatgtgccatgttggtgtgctgtacccattaactcgtcgtttaacattaggtatatctcttaatgctatccctcccccctccccccaccccacaacaggccccggtgtgtgatgttccccttcctgtgtccatgtgttctcattgttcaattcccacctatgagtgagaacatgcagtgtttgattttttgtccttgcaatagtttgctgagaatgatggtttccagcttcatccatgtccctacaaaggacatgaactcatcattttttatggctgcatagtattccatggtgtatgtgtgccacattttcttaatccagtctatcgtttttggacatttgggctggttccaagtctttgctattgtgaatagtgccacaataaacatacgtgtgcatgtgtctttataccagcatgatttataatcctttgggcatatacccagtaatgagatggctgggtcaaatggtatttctagttctagatccttgaggaattgccacgctgacttccacaatggttgaactagcttacagtcccaacaacagtgtaaaagtgttcctatttctccacatcctctccagcacctgttgttttctgactttttaatgatcatcattctaactggtgtgagatggtatctcattgtggttttgatttgcatttctctgatggccagtgatgatgagaattttttcacgtgtctgttggctgcataaatgtcttcttttaagaagtgtctgttcatatccttcgcctacttgttgatggggttgtttttttcttgtaaatttgtttgagttcattgtagattctggttattagctctttgtcagatgaccagattgcaaaaattttctcccattctttaggttgcctgttcactctgatggtgatttcttttgctgtgcagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtctattcgttcttcttaagcccattgtcttaacaactattctgtcttcattccagttaaaacatggtaaattatttaattaaattaaacctaaatatgtcttgattaaaatatatattattatattttacaattagaagtaggtatggtacttctcccagtcttgagacatattacagttcttgattcttgttggaggctggagggccagacaccaggtgcttttctgggtctgtgaatctgtgatgttctcttaatcttcagaagtcacagttcatttgaattttcctcttttgaggtctttgtatcattcagcctactagcttcgccatcctgtactgccttgttgtgggtcttcttttggtttgtttctgtaccagtcttgctgtcctgtctagccagcacacaccgcggcctagttctagacttgcatggcccttagggcttcttccacagtatttcatctcactggagtttcttctgattgacaggattgtttaatttaggcatgctgactttatgttgaaaatgtagctgaccacaaatctactgaaataggataatcctgcaaaccaaataaccaaccatttggtcagtccctgcctctttctgtctctttgctctctcccccactcttctgtttctcatatgcgcatacatgtgtgcgtgcgcacgtgcacacacacacacacacacacacacacacacacacacacactcttcattgtaaaactagaacttaaacctgtcatcattgtccctaaaggatggtttctaggcttcatcttttccatgtttctttgtgttcctttgtcagtgttttcaagatgaaaatattccagttagaaggggaacaaagttttcttgttatggagtttatagtttattcttaccacaggttgccaattcaaaagtgtttgtgtagttagtagcatgcactgtgaaaccactgtttcccaggagttaagcgcttcagtgcaacttcaagtagacacttttaatatcctttctagcttattttaaaaaataaaatattacacgtaaggttctatatggctccctggatacaagacattattcctaacagactctgctttaaagacctctaggataaatctcctgtatatttgccctttaaagttcgacaactgtgttttaaaagacaagctggatgtttattatacttttacagagggaagacaatcattatttttaatgaatggaatggaaaataaacggggaaaaaaactcatccccaaatggatgcaaaatatgctatataaaagacctctgactatagaataaggagcatcatagttttgcttttgtaattaatgtgcttgtttttaacataatgattgagactattagtctgattttagagcacttcttacctagttgcttttaagtgtttagtgtcttcatggttagttctccatatgacaggaaaaaaattagaaaaataaaagatgtatttaattctactttcatctccaacatttatttgtttataggagaaagattttctgcttttattaaggtcttagtcaatatgtttacttttgctactgtctctgatttcctgtacatggggcctctagagctacgatgcagatactctgttgccctttcctttccttatcctttctttaggcagctttcatgctttcttgttttcttggggtcacatttggccaactaccctctttggggcacattgtcctttccattaatgactaattcttgttcatctttcctttatttatactattctgttgttcaggccctggtgtttgttcacatcatggacctgctggtcttctgagctgccatcccacaaagatgactgcaaggggagagtaggagctgagtcacagatgctgctcacaaaagtgcagtcatttcatccttatgtctttctaaagaacttaattctgtatttcagtgaattttttcctaaagtctctgctatgttttcctttgttcaccatctcatgctgataataaaaatgtaacactccccttctttaggagaaattcctggttgaatatgtgtagttgagagagcattgaggggtgggatggcttggtcaaaattcctccagactagttatcttttggttcttttctaagcttgttttcattattcttttccatcattagtatttattaagagcttttatgttaaaagccagtgcctatgctagcactggtgatacaaagccaaacttgacaaacatggacatatggcgctagcacacagcaagcacttagtgaaccctttgttgattgaaagaaagcttagtgcctatatccatttgctgatacttgtaaccttgattaaataatccctgattgaaagccatccgtgatttcctattgcctatgtaaaatccagagtatgcacagggttgctgtggtccacgcaatctgggcgctgtctgcctctgcaacatcatctcctcccctgtcttctcgttaatgtgctgtggcagcactggccttgtttactcactttgaaacatcaagctttttcctgcctcaagtcctattactgcttgctggtccctttgttggcaatacttactcatgcccccaacccacaccccttgttcttcatggctttctcaagtcagctaaagtttcgtcatttcagagagtcctttcctgagcacccgatctaaaatgagacctctattttagcactctttttctgcctctgtaataacattttatataacctgtaataattttgtttgcttgatttttttctccccattttattctaagctttatgatgacaagagtcatatctatcttgtttatcgttttatccctaatacctagtatgccacctagcagataatagctgcttagaaaatgtggtcgaaggaatgagttattagagtttgaaaaatatggttgccattcactttgttaatttacttacttttttcctgctctgcgcactaccggtatcctctgcctaaagatatcatctcttctacatagaaacacagaaacaagtcacttaagggctggtgttactcagttttactggattaaaccaaagaattccatacacatttttttcactttcatgggttatattaatcagactatgaaagctgccattttctgttatgtaaattttgacaaaagaaaatatgattttctggaatttcccttgtataaaagtatttctagaaaaaaagtttcttagttcaggaaacattagtctagaacaagcttgtctagcctttggcccaggacagctttgaatgcggcccaacacaaattcttacattttctaactttcttaaaacattatgagatttctttttaagctcatcagctattgttattgttcgtgtattttatgtgtggcccaagacaactgtttttccaacatggctgagagaagccaaagattggacaccactggtctagaacatgcctgtgatattgtgtaaaatttcatgtgattgtattttaaggctttttagttttgacagtggccacccatgaacaatgacttttaaatttatggaagagacactatcagaataaatgacagattagaatttggcccaaagaggtattttgcttggatactgcaattgtttaaacttttttttaaattaatgcttttagacagatagacattcttcattttggtcacaaatactactggtcaccattattttataacagcctacttttcacatttatgttgcttaactggcccatttaggcctttgtgtttgtagcccctggcttagaatctgccccacaaaaatgaatctttaactgatctttaataaaatattttaaattgtatatatacataaaagagtttaccaaaagaataataatcacttgtgtttgaaagaaacaacatactatggtaggagaatcagcagtcctgggttttaatctcagctctgccattaattatttggcctgaaaaaaatcactttggagtattagtattaacttttgagtatgtaatattatttttttcatttgtaactgaaggtttatgatttatctgttcctaagttttatgatgtcatgaacaaagaattaacatcaagatcaagatttaaggaatttgtcatgtctctcattcaactttgtcagctcattcactgcttcatttaacttaactttttcctaggcttatttgtacatctccttgaattaaaatatatatatattcaactttaatttttagagctagagatttttggggaataagtgttaacagtgcttctatcttcagagtcactctaatatgacttcttatttgttcagatttcctttttcagcctcagcccttcatgattatttgccttttcaaagagaaggcatttgactgtcatgttagctatctctctctacaggacatgggacataggacatgtatgtatactatatactcatgatattactgtagaactcacacagaatactcagttctacaggagggcagtattcactaaagaagttcagtagaaggctgagcacggtggctcacgcctgtaatcccaatactttgggaatccgaggcgggcggatcacctggggtcaggagttcgagaccagcctggccaacatggtgaaaccctgcctgtactaaaaataccaaaaattagccgggcgtagtggtgggcacctgtaatcccagctactgaggaggctgagataggagaatcgtttgaacctgggaggtggaagttgcagtgagtcgagcttgtgtcattgcactctagcctgcgcaacaagagtgaaactccatctcaaaaaaaaaaaaaaagtacagtacagagaagtgggtttaattcttgcttagcaaattctgacatagatctaaggggatgttaaagattttggtaaatagagatgaaatggaagagcactgtaggaaaaggaagtattgtgaacaaaagttcacaggaaaaatagagaaatgtttggaaactttaaaagcttagtttagcatgaacatattctgagttaggaggagttatgggagatcaggttgagtgacagacaaatttttttctagttcatatgcattcttaaattcaagattaagaatttgtagagcttttactataggtgatgggcagcattggaaagctctgttgctctggactcttttgtgcgatacaaactcaattcaaaatcacataaacatgaaagcaaatgtaattgagtcgtgtaactgaaagttttagggtggttggctattggcaagctggatcccgagatgtcatttgttctcctgcgtccttgactcttctttcctgtgttttggctgtatgctggaacaggctcttaccatatggatcactcccagagctaagcttatattccaccagcttagttgcattatctgcgagtacctcttttttcagaagctctaacaaagtcttgagatgaaccaactgtacctttttgtatcatgtggcctttggacttgttaatgaagcaaaaggcatctgatatcatgtttggcaaggcctatattacatcatcactttggaatcaggaagtggagtcaaccccattcaaaccacgtgaattgagtacaagagagcaaaaggaaaattacattacattgctggtattttgttttttttttttaaacaaagtcttgctctattggagtatagtagtacagtcatagctcactgcagtcttgaactcctcagctcaaatgatcctcccacctcagcctcccgtactagctagtacaggtgtgtgcaaccatgcccagatactttttagttttattttgcagagacagtgtcttgctgtgttgcccagattggccttgaactcttagcctcaagttatcctcccaccttggcctcctgaagttcaggaattacaggcatgagccactgtgtgtgacccattgctgggatttaaataaggggaaatgatgctttttcagacaaaaacaccaacgagtgctataatagaacatgagagtgaggcaaggaaaactggataggatgattattacagcagtattggatggagactattgatgagtataggagatgatcattggattctaaatatctaatagaaaaatagtgagattctaaatgagaacattaatagtaggaatggaaggcaggaaaggaactagcaatatggatgaaagttgtgttatttgctttttactagttaagaaatttgtctggaacggaactgaaatttaactttgtcctatctatgtgaaaaggatttgggatataaattaatttagtcaaaattacagaggtcacaattaaactactttagtggttataattattttaaaaactagataatgctaataataaatttttcatatttactcattacattggctcagtaagtttgttttggcagcattttaagttactccatgcacgtaaatgttctaaaatttttctttaaaaatctaatgtaatactgctttcttccacttaaatacaattacatatatacatatacacacatacatatatctacatatatatatatatacacacacacacacacacacacacaaatatacagtcatgtgccacataacattttggtcaacgatagattgcatgtgcaatggtggtcccataagattataattgcctgtttttactacagaatttaccttttctgtgcttagatacacaaataccattgtgttatagttgcctacgatattaaatacagtaacatgctgtacagatttgtaacctaggagcaataggctatgcaaatatagcatgggggtgtagtaggctatactgtctagatttgggtaagtacactctgtgatgctcacacaataagaaaattgcctaatggcacctttctcagaaggtatcatcatcaagcaatgtatgactgtatatataaatacacacaatcaataagtgatccattatttggcattaacttgtcaaacttatcactatcccccctgccaaaaagtaaagtattaagtgcatctgtagagttcatgtattatgctagatctcagagtgaaaatgaatgagtaaagtttctgctcgtcactatacttgatatatagttcagaaaagccagtttcctcctcagtgatctggaatagcaggcatacatttgatgaacactcattacgtgctaggcacaaatgatataaaggtgaataaggcaatatgctttaggaagtaaatgtcttcttttgaatatagtttcgaggtttttttgtttgttgactttggtaccatttgaacaatgttcacttgagtcagcattctgaaagggtcatttactaatatgtttctaagaaaatttcccatacttggtaacctatctttcactatagtagggatctaaaatgtagggcatggggggattttagctcatagtttctctgtatatccagtattgatacagatatttatttgtattcagactgttttggtggttccaagatttttataaaattaaagtagataagaatgtgaattagtttttgtcattattttttcctttatcgtaaatttaaatacaatgagaaatattttcataaaagccaatataattcaaagcatatattatatatatatttcgtgtgtgtgtgtgtgtgtgtgtgtgtgtgtgtggctatgtgtgcatgcacgtgcacatgtgacaattgtattatggagtttctcattcaaatgtaatgattcttagctttcattttgtatcattgcttagtattagaaaaagcctcaggattttcaaagggaatttttaattttttaaaacagaaaaaatgaactcacttttaatgaaaagtatttttctatactattttgtaagaggatcactgctaggaaaccaagcaatagctcaatgccattactgcaaagatttaagaatccttgacttactattttattataattgatgggaatgaagagatgataacttttaagtttataaagagtgattttaggattatgcagttattttagtagcaatattattatttttccaagtcttcaaagatatttaatgacattcatattttatttgcagtcttttttgaaagagaagcagaggttaagaattgaggtcttatttgctctgaaatttgaatcctgtttaatatgtcagtagactttacgaaagtaaccatttctttgattttggtatttagaactaggagtagaaaaaggaaaatgcacatacgtacacatacacataagacatagaaacagtggcagttttagaattgaactgcctgagaaaccttcaggcttttggaaacatgaacttaatatttgtcttctttcaatcagttttattttagataaaatgctggcagatggtagtgatctacttgaacacagttgagttttctttattttttccatggaaaaaagctcccagaaacttttgttctttaatatgttcagcatgcatatgttttacatctattaatgagtattaaaaatgcaggtcctaattagatgtctaaatctgagaggagttgtggtgagtaccagcctcttagaattattaaaaaatacagttttgatgaacaggagtttcttttttgctgtgacatctttcagccttctcctgttccagaaacgaaggaatttgcattatcaatgcttctcagctattgtgttctagggtttctactagatattgtgagttttgatgataaaccttcagatgttgatgatgtcaaaacttgggagaattcaggatatttatgttctattatcacctgttttacaggaaaaaaggtaatacctttttttacttgtttaaatatttaggctttagatggggcatgaatagttacaaacttttgatatgccttatattttagaaagctggtagaaaaatctgaaatattatgttgcaacctggttttgtttggtactttagttttactttttaaaatgtggaggggtagtggtggggaaatcccttcactccagatttatctatgagtcacctgaagtctttcttctaatagagtataatgaaatggtgccatctgaatcagtatttccatatttgcaattttggatattcagtttgtactcatcaacatttatctacatttctgttttatttttaaatttgccatataatcctcttttagctaataagcacatctaaccaagaatgccttccgtttttcatagacattgattgttaattgttctctcacttattttgtcttaccgactaatgtatttgttcttattttgtcttaccgactgatgtatttgttcacaactccaaaccacaaattaggcacatatgtactgactaatcccaacttacaaatattagcccacgcagtgtgaatttcttcaatgtttgggcattcctaggaacatatgatggtttttgatgttctctcttgtacctattaggcattttattacataggagcccagagggacgaggaaagggccttggactagaagtcaggggagctaaatgcaagcccaattcagccactcacctttaaaagtacaaatcactgtcattctgtatcttcatctgctaaatggtgaaaataaaaataatactcttcccttttatcttcaagatttgtgaggatcaaatgagataataatcttccaggagtattttgtaaactggattaaataatgttttaaagttggaaatgttttagttagaatttgtactgttcccctaagtgactgatttgctctgaatttttttaaaaaaattatttaatctctagtctctgtttattttaaaatgtgagtaggagagatgacatagaattaatactttttaaaaaacgtagtgcttaaagagtgtttggcccgaaaccataatgtacttcttttattcctcagatataggtggtttgataggcacagtgatagagcgggaagaaataatagagggaatattatttgcagatttttattctctcttttaactatttcagttctggtatcaattttgaattgtagctaaatatcagcaatcaaatatttgggggtgctgggcacagtagctcatgtctctaataacagtgttttgggaggctgaggcagaaggattgcttgaggccaggagtttgagacctttcttggcaacatagcaagactctgttgttacaaaaaaatttaaaaaaattattagccaggtgttgtggtgtgcacctgtagttccagttacttgggaggctgtggtgggacgatcacttgagcccaggaatttgaggttataatgagctacgatcctgtcattgcactccagcctaggtgacagagcgagaccttctctctttacacacacacatacacacacacacacacacgtaatatatattatgtgtatatataacataatatatacataacatatatatgcattatatatacataatatatattatatataacataatatataatgtaatgtatatataataggtgtagtaatggattaaaataggggtcattttatgtcattttatgtttttgtaattagaaaaataaattaagaataattcattttcttcagttaacatttatctaatgcctcctattttataagacactttgctactaggtacttgattcagaaatgtctgtaagaattatcagtatgaaaaagataatatggaaagtggttgaattgctctcttatctagtaaacactgaagaattcttaaagaaataaaaggtgtatagttgtctcatatctgaaggtttgatgatgtctgtagcctttttaaggaaaagcaatatttcatacctgtggtggaatgagactgactttctaatacaaagtagttatttcacatttatacatcatctctttgcttaagccccaaggaaaagaattatgtgaatgtctgcacatgatgatatttctcacattaattttaataaaagaataacagctgaacatcatagctgccaaaaaaaattagataaatgaaaataaatgttctaatgtacattcttcaaattgataccggctttagtaaacataataaacgtttcttgttcacaagagaaattgtgaatcgaatagtaattggtcatttcaggtcagctgtgtcactggtcatccattagtgcaaattatctagcttgaacatatctttgaaacttacaaatatgctgaaagcattgtcttagtaggtaaaacttacaaagagatcttatgtaaattagttttgcatttttttcctatagaaataaattttcctttttatttctttcaaaagtcttggaacacatttttacttttgctacttgagactgaaggtaaatatgctgcaggagagatggagaaatatatttgaccaacttgttgcagcaggtgatacctaacctgctcattggacctccctacttttttgacagtctatttaactctttcttataactggttaaagagttaaactaggccaggtgcattggcttatgtttgtaatcccagtactttgggaggctgaggcaggtggatcactggaggtcaggagttcgaaaccagcctggccaacatgacaaaaccctgtctctactaaaaatataaaaattagccaggcatggtgttaggttcctgttatcccagctacttgggaggctgaggcaggagaatcacttgaacctgagaggcagaggttgcaatgagctgagattgcaccactgtacttcagtctgggcaacagagggagactcactcaaaaagaaaaaaaaaaaggagttaagataaacacctctaacttttcacaaccctatctcctccaaaatatttctaaatcttttcattcatttctttcaccctttacttcaagtattttaccagagaagctcactagcaaacagttttgaatagctgttaataatgtttttacgtttgtcattgcaaaacagtattctattatttttgtacaatattagttgtggtagaggagtggtcagtcagtagaggaaaagagaaagttataaagtattagataattaacttatggattcttgagcaattgaaattcaaaagcaaatatacaaagtatactttagggttattttggtattttatatttaatactgcccttttcttgaacttttataagcaaagatcatcatagatttgcctcagaaatattttattatatctaagttccgtgagggcagagactttgtctttcttaccaccattctcagggtctaattcttagtgttcagtaaatatttgttggatgaatgaataaataatgattatactaagaaatatcaatcaaaatttataatgtattcttttgctgtatccagtattctaattgtgtttatatccagataagacctaaataggaaaacaatgataggcgattttctaatactccattattcagcaattgctttgcaagattctactttctattttccttttctttcttccttgttctgcacattgcacaaccctgcccgcatatagtaatggcttaatactttttaaaatgcttgcacaaatagtatgctttattttagtagaaatacttttttcttgttgtataattagttacctgttcagtacagagaataaggtggctattggtggttttcacttttctcgtttggattctttttcaagcagcaaaagatagatataatgaatttaaagcacattaggtagaatttaaagtgacaaataggatctacaagacagagtgctgagacttctctttttccatgacacagtggcaatatgcataaaactgttaccatttgttagttcattggcagagaagctctggtttgaggaatataaatgcagcaggaaaaatggtttcattagacacgaactttctatgcagtgttaaaactcagtgcctttctggaaatgtaaggattttgatgtgaaaagaggacagtggaggaacatagtggttttataatgggggtctagctgttgacttgccaatgatgcaaatttacatggtctgctttgtaggaacagtgtatcacagtttcttttcaggttgtattgcttgacctttgtagcgcttttgaaggttttccaccatcccttagaatcataccctcctaagtcttcctttgtaacttagatttttactatactccttctacatcattaaaaattttgcttttatcattgaatatttcttggaaatgatatcgattttaccgaattgttatttaggcatcagtgattattagagacttattgtataatcccagctaagataaagtccccttttttgttgttgtttgatatgttataaaaggcacttggtttcctttgcttcagccatctcccagcaattttcatgagtaaaagcattttagatatcaccttgattcagttatcaaaagatttcagtgacagccagttatttttctaataaataaattcttattcacatagttaaagcatgactacctggtcctttcctcaggatagtcctatccattgtaagtatatttttttattttctggttaatataacttgcttattggaggtacatcaagtttcctgttgtgatttgaacgagtgagcaaggacattatgggaaactttaaccatatacaaaatagagggaacagataatgaacctttttaccttttaacaagtgtaaataaatagccaatcttgatttatcagaactctgcctagttgttttccaccccagattagattgaagcaaattctagacattccattcatggctctatatattatattgaataccaataaaagataaaatttctttaaaaataaaacataattgtaatatcattaccaccctgataaaaccccaagtaattccttaatgttatgaagtatatccaatgttaaaatacatttactataaaatactaaatgaataataagaccctattatgcagtgaagaaaagagaaggtggccaggcatggtggctcacacctgtaatcccagcactttgggaggctgagttgggtggatcacctgaggtcaggagttcatgaccagcatggccaacatggtgaaaccccatctctactaaaaatacaaaaaaattagccagacctggtggcgagtgcctgtaatcccagctacttgggaggctgaggcgggagaattgcttgaacccgggaggcggaggttgcagggagccgagatcgcaccgctggactccagcagcctcggtgacagagtgaaactctgtctcagagaaaaaaaaaagaaaaagaaaagagaaggcagtctcccagggaacagaacatacttataatgtcctgtaggcaacggttgctcaataaaagcgaccaattgcccagagctgaagtatggtgctgcttatttgagaaattattaatcagtgttcttttagtggctcaatatctttaatgctctgtagtcacttagttgttattcttccatcttacagattgcactgtattgagtgaatggtggccactgaatggcacagagcaaaccctgtgtactgccttaggggatagccctgccctgcaggagggccttgggcatcagtatttatatttaaatactctgcataagtggggcacagtggtgcacacttgtaatcccagttacttgggaggctcagactaggggattgcttgagctcaggagtctagaccagcctgggcaacatatccagaccttgtctcaaaatgcatatatgtatgcatacacacatatatgtaccctgcaggtctttctaatgtgcatccaaggttgagaatattgtctaaagtgtacagtctgggcctagtacaaataatagtattatctgtttcattttaccttcaccagttgtagattgtaagtataaatataactaataattctgtttgttttgttttacttgccggctatttcctttcctcttgttttgctactttgaagggataattatagtagtatgaaacattttgtccacatagaagcttattgaagaggttaaatgttcttgctaattaaagaaaacactaattggacagattgttgttttatattagtaattttcattattttttaatcagagctaaaaatatttttaaaagaatgctattttatacttatttttctcattatttgagggatttaaatattcagatgaaatttatttttgagatagttgatcatgctttggtctctaggtgcgacagagacaagatataattatttttttgaagtgtcagaaagttttataattctcaatccctatccatgccttacctatcactaaaatgtccatcacccatccatccatccatccttccatcagtccatccatccatccatccatccatccatccatccatccatccgattgcaaaaggactcagcataatgtcattaattttctttgcactcttgcatggctgattagtttgttaaatctcactttttaggaaaagaaactgatatgttcaaaagtcagttggtttctctattttcaaaggggaaattagtggtagatggttaagatgtagtctgtgttttatcccgttcaaaggcactacttttcaatgttgtgaaagcttaaattaaaaaaaaaaattggtgctacttgtcttttagtttcactaagagaacatatttcttggagttcttctaataatttttttatttgcctggctatctcttcttgcactgatttgaccatctgtattagtttcctaagggtgctgtaacaccagaatttattctctcacagttctgaggccagaagtccaatatcagggccagcagggccacactccctctgaggctctagggatgaatccttccttgcctctttctggcttcttgtggctcctccaaatccttgacattctttttggcttgtaagctgcatcactccagtctctacctctgttgtcacatgaccttcctctgtgtgtgtgtgtccttttttataaggaaaaacatcattggatttagggcccacactaatctagcatgacctcatctaaatttgattaaatcagcacagacattttgaatggggtcacattcacaggtactatgggttaggacttgcatgtatctttttgggggatacatttcaacccactacatcatcatcatcccagaattcagtgtaatatgcctgtcattttctgtgccttcagtttttgttgttaccgttaaataaaggactctgtctggtatcatcatgtataaataataagctgtaaaatagtcattaattctgaaaccagaagacgctgtaagatattttatcttcagtttgtcaataaggcaattgttagggtttgagtttgtacccatcaaaactcatgttgaaattagatccccaatgtggtagcgtggaaagtgggcctcagtgggaggtgtttaggtcatggggctggatggctcatgagtagcttggtgccatattggagtaagtgagttctggctctcgcaagactggattagttcctgtggaaatgaattagttttggaaagagcaggttgttaaaaggccaggatgcttcttcggttttatttcttcactcgtgtctgattcttctttgacctcagccatgttatgtcaccagaagccagggccatgcccttatattttctagcttgcagaaccatgagctaaataaacttctgttctttaaaaattattcagtctcaggtattctgttacagcaacaaaaaacagacaagacaaccacaaagtggtatcagtgacttgacaataatcacgtagatgattgtccacagagtagtatgaataaggtgttatttgtctgctattatataatattttctgtgatgtcactttgttttttcttattaagattaagcatcttaagatattaatacctgacactaagatgacatgacaaatattaacacagttatggctttagagttattctaatcaaactgctgtcattttgcagctgaggaaagggaggtcttgagaggttaagtgagttactgaaaaggagagttaggtgatgacatttctgggtggattttgagtgtttggtattgaattctataacatgaacctaatgtggcaaatttgatattacctagaggacactgaagaaaatcaataacaggtttgaaaataaatactgaaagaatttgaaataatttaaacacaaaagtaaaggatgactaaattaataatatttttctcttaccactgaaggcaaatagaaacaggctcaatcatcaagcagattctgctttgtttttcagctagaaagtgtgacagtgggactgttgagaattgtcatggagaatttgaagaggaatgaactcttatccaaaacaaaacgaaaataaaacccacatacatctatgtattagttttgtcttacctggaaatttcaaattttaaaaaacccattagtttgcatatttatttccagtctacattattacttcctcctcagaatgcaaatctaatttacagggagggacttccaccctctacaacataatctctgaaatctttgaacttgtggctcttcagtgcctgatttttatatctgtttctcttataaaacagggcatgatgtaactaatggctttcaaatctctgaccttcagattgtagcataatattcctacctcagacttcctatagatggattaaggtgtgtacctctaataggatccttgatatctttcaagagatgaaggcagaaggagaaactcagtattcctagtagatatattgacccatactcttctgggcattgtcctggcttcagttacctgatggactgtctagctgtaaatgaataccatgtctcaactgatctgaatcatcctgttgggtagcttctgcactgacttttcttcatttgccagttgctctgttattatacaggcaaacatacattgcctgcctgccatttgtgtacgactttataatcttttctacaaactatctttcctatgtctatagctttcctttttgacaaatttaagcaatttctgctcattgatttttgttttattttgtttaaaaataatctaacttcttttctcctacagacttttacaagctatctaaaaacaaaacagaaaacagctaactcctgcttgctagtggctgtacatccaattgccttccttggcttggaaaggaagacagttgtcactcagaaagtcctgttgcatctcgtcagaaattcttaaccagcccttgtttaaaatttcaaggcagtagctctcgagacttcaaagaagattatggttactagtactctttctggttatcaaacatggtaatctttgcctatatttaggataaattaaggaagaagtagacgttgatgaattaatatgggccaattcaaaataacaagtgcatcagctttccagctggtgcgtccaatggaacgttagagaacctctgcattactgaaatctacttcttagagggtagcattgagttgctgttaaaatcataactaactaagagttatgcagacccacagtagatgactgtgaaacataggagaacagatccttgtatggcctaatgtagttaccctcagtgttgccatttagtagctataaggttttggagaaattgcttaacttttctgagcttcagttttcttgtcttttaaaatgggactaataatacctaccttacagtattattgtgaaggtgaagttaatccaaatgagataatatatttttggagcctgacatagtggctggcacaatgtgagtgcctcataaatagtgcaatattttttctgtttgtatagcactgtgtaattttctcacataccgtatcatttgatctttcaaattaagaagtggtcaggaaagatggtaagagtttggtaatagcaccttttttacagttgaaaaagctaagtttcagagtggtaagtcccgtatcatatagctatttacggttaggttttctgattcctcatctagagcattagacttttccctcctttatttaaactcttatttttaaaatttacttatttaagcttctaactatataggtatatggagttatacctatatagggagccagtgctttaatagaattcctgatgccctcatccctgtatgcaaatgaaataacagatacttaaagggctttggaaaataattttaagtgctaaggaaacataaaattgaatgatttttttggttaatttattatatttagtcccttctgtaattggtagtaaattggaagcatctaaaaaaaatcatttccaaaaaggaaaagaaatacttcctatagccatttttccactctcattactgtattaaccgtgttcaaatattcttttaatagaaaattccatattgtttctaagccttttgttgaagaattcctaagcattatagctccttatttttttgttggaggaactaattttattaacgtggcaatgaaactgacacttaaggaattatgagcaaatattgtagcatttgctagattatctttcttttaagctctctaaaagaaaatatttctcataattgttaacacttgtagaaaatcttgtgaaaaaaatagatggaaagtattccactcttctgccatacctggctattaaaaaaagaaggattggcccacttatattcagtatagtgcatgtttgacttgctctacctccatgtacttccctcagtgtaaagaacttaggcaggtgttattaataaaaaaaaataataaaaaactcctattttaaataaggatgctattctcccagctttgaagctcacacatactctctaacttatcccagcttttgctcatctggtctttaaatgtctcctttcatgtggtcagcccacgagccgtgcgtattgccgctcaatcacgccactgtacgtagccatcatgagggtggtttgcatgatttgcatttcctgtactgtttgagcttcaatgagctctaagcgccacgtatgaggaaaccactgccaagtaatgcaatgattttagtcaaaccagatgagtgtgtgctagagtcaggctaccaagttggttgggggtggggaggtgttgttaggatatcctgttaaaaaaggattcttcaagatgtccgcacatgcaggatgtgaattccttaacaaatctggccatgtaatgtaagaaagttacatttgggaagataagactaaaaggctagatgaataaccgtgtatatgttgctcttaaaaaattcagccctatagattttagtatgatgctttaatgtgattatttattgtgacaataatagattttgatgacattaaatttctagccatatagaatgaaatttagtcagaattaaattaaatacattgattacatgtccccttgtcctgtaaaagaaagcttgtattttattaaaaaatgattgatgaaaactgttggacaagtattacagaaatggcatagtagtgggccaatgaatagctactaaagtggagaaggaaaaaaaacatgtaccagatactagtcttcatgaaaaacatagacagatggggagacagacctatatgatgccacaaatagatgaatatcttgtaaggatttcaaacaaatgttgaaagatccagtgaaattttaaaagttggtttaaaagtatatcttatgcttataaacatagtgtatttattctgctcacctgaaacccaacctctaaattgttaataaaatattgtatcaatattaaccaaaaagagtgtaggctgaaactatatctaaactcagaaatattaaaatgaatctcactaataagagggactaatttttcttaggcttcttagactcagatatgatattataatgcttacaagaaaaccttctatagaaatcttttaaagtattgcttaataattgtttcaaatatttcctgttcttatgtatggacaattgaagaatattctcttttctcatattttatatatatatataatatatatatatataaaatatatatataatatatatatattatatataaaatatatatataatatatatatattatatatataatatatatattatatatataatatatatatataatgtacctgataacttgctgtggatgctactcaatagtctttagtactagttcacctgattacagcctactaactaatcagtgcctatcaggcatgccctgcagcacttttaaggtattcctttttttttttttttttttttgagacggagtctcactgtgttgtccagcctggagtgcaatggtgcgatcttggctcactgcaaactccgcctccctggttcaagtgattctcctgcctcagcctcccaagtaggtgggattacagatgtgcaccgccatgcctgactaatttcttttgtatttttagtagagacagagtttcaccatgttggccaggctggtcttgtactcttgacctcagatgatccacacacttcggcctcccaaagtgctgggattacaggcttgagccacaatgcccgtccacttctaaggtattctaaagaggaagcttttaagtcacacatacctactgaggaaattgttctataattatctattttaagaaaaggtagacaatttatatggattaaaaaactatgtattattatatctacactaaaatggttttgcatgttgaatgtaccatgtagtcaatttaagtctgagaatatttttcattgtgctgtggactgaaatgttaaaggccagtttttactttttttttattctcttttatttcctagtttccacttttaacatttattgaattttaatgtatgacttaacccttacataatgctaagtttggcacttttgggttgttgctagcttatctgccatgggagatcttgggccacagagcgcttttttcagagtctgaatttgaaggagggcatatttgacccacagagctcttcatgtgtttaattggatatgttcactaatgctattagaatgttgcattttaaataatgtaatgtcataactgtcacataagttattttttatttattgattgatttttatttttgagatagggtgtcactctgttgcccaggctagagtgcagtggcatgatctaagctcactgcggcctccatctcccgggctcaactgatcctccttcctcagcctcccaagaagctgacactacaggcatgcaccaccacacccagctcatttttgtatttttagcggagatgaagtttcaccatgttgcccaggttctcgaactcctgggctcaaagtgattcacacacctcagtatttcaaagtgctgagattacaggcatgagacaccatgcctggccaagttattaaaattattatttcttaccagttaaattagttttaagaacattgagcttattagtgatcttagttttatgtaaatacatttgaataatgaataatattgtaccaacttttctttgaacatttttcttggttacttagttcctaaaaaactagtatttgaatctaaaactaaattgtatttttagatgcttaatcccgtgggggaaaggaacacattttgcattagttgtctttaatttattaaataattctgtaatgcactgtgtgcatagatcatgaaaaccactggcacatatttttctgacttcacaacataagctggactcctgttgcagtcccagcaaatgtgtttataaagattccagcagtaatagtcttgtgactaaataagaaacagaagctaaagcttagagccaaacagatacctatctgtttccttgagtttaatctgattaaaacatgggtctcaaaaacattaaatacaatgtcatgtcagagaggtggtatatgataaatatagctcatgacaggaaatggttattaaatcagtattactagtgaatctgttatggaaatttccctttaatttagtttaagttcccccatttgtcacctccagtacatcactatagttttctgttttaatgataaatatgttattttctgttgaatgaaagacaatttttctactttatcatacatttgctatcactgatcaaacacttcatacatgaactacctcctcactttaactaggaaaaccaatatacggactaaaagagaatccatactagtcattggccaatgggacctaaatacaacaaacttaaaggcagcagccacctggcccttatcaaaggtacaagcagttttttaaaaatgtgaaacacatcaacttgatcaaacttaaaattattggatttaaaattgtaattatttgacacaaaaattttgagaacttcctatttagcttcatcaaaaataccatctttactgtttgaggaaatagggaaaaagtgttagtaagtataatacacatatattggtagctaaactctgaatactctaattttttttaacagttcagaaagcattttttaaaggagaaatatttttacaaagcaagaagattatttggctgacttacattaatgaaacattttggcacatgtgaaagatttcatcgagctattacaaccactcccaaaaaatcttggtttccatttaaaatgtcaccaatgtggaaaaaataccatcaatcaaattgcgtatcttttaactgaagaggaaaaaaaaagtaaagaaaaaatgaaacaaacagtgagcgttcagtgcatttttggcttcccttaaggaattctgacttaggtatggtcatttatctgtggccttaagattacctgttttttctgtttgttccactgtatgttttcatcttcattggaatacatctactgagtaatgttcctaacttcatgctccactagccaaacactgggaatgttacagttcttgtgaatgagaacagtaaaagaaattattttcccaaagaaacatagggatacacctttacaacaacaaactacaaaattccatatgacattattcttcttgctttaaaattattcttaagaacttggtagaaacaaagaccttcttcacaggaaacttaagtactaagtccatcttaggagttttatccaggaaacctgtatgcaagttgcagaaacagcactgagacccttatttattaaaatttagccctttcaataaatgtggaaaactaagtagctgtgacctaactatacttcttgagttttgtaggcaactcttgtctagtggatcttaggcctttctgtttgcatcaggactacttcacctttgaggtgagcccggtatcatagtcccaacttatgaagacgttcagaaccagtttcctctgtgctcctaaatgcacagagtgaaggatggttcatgtttctactattggctacttttaggaacattgggcttaattgtatcatgcactcggtgttgaaaaatatatctaaatcacattaggaaatcaaggttgaacatgaaaatatctggagggttggcattcaatgttttagcctgcatagaaagtggcagtgaatattttcaaaacaattgagcaagcaaagcataattattttcaattaacatgtggaaatatactgagagattaagttatttgtgcaaagtttggccacttttcagtgttaggcagtagaaaaacccaggtttatgctccttctactctactgtcagtaaaggaatatcccatttcatctgcagatgagagaattgtttcactcagaaattacacaagtactcttgctgtctaagtgacctcaatcaaggaggtttttattttatctcagggactcaattctagttgagggtaatctgaaagacttgactatatgtaagtattcctattttttaactcacatactcaaaatgctagccgtaataatttaaataatcaaagaagttttatgggaaagtaacgagtttctctaactctcgtttttaccaggcaatcagaaattacaaattaggaaacaggagagatgagaatggaatgttaaccttttggtatgaagcaggtcaacattgaaaatgcaagaagcctggatccagcttcctgaaaagaagctccttggtgactctttttcttccggcatcagttgattatttctagtatccaaccctttttactttctctaaatctctctgaggaacatcctggagtttcttttctggctttcgttgtaactagttcctggcctacctgaggggatgaatagcattatggtatagggtaggtgctgcagaccatatggagaccagcaggatacaagagtgtgagatgcctagggaaagcctccctttgtcaagttaaaggagagaggtttccatttggaggcagctgaaatagagaaagaagtattgagcacaaatttacaaatcaaaataacagtcttccagggataggatagagcatggaccaacatgatacagtgtcaacctgcattttcatgggtgaaggatggatggactatagtaatcaaaacagaaacatagcatcctctggaaatagtgaccacagagacagagatctttgtattagtaatgacaggtaacgtttataaagtgcctcactgattgcttatgtgtgtgtcatctcatttgatcctgatagcaacccaaaatggtggataagcgtgaagaatctccttttacggatcaggttcagaaaaatgatttgaccaagttacccactaggaaattttagagtcaaaacttgaaccctaggcttctaatataggaaatggctttgtttctcaaacaggatgcattcctcacttctttcctcctcgctgtcatgaaaatatatccaggaactgtacgagcactggataaacggtggtgaacaacatagccctgttccctacctttgtggaacttagtctgcacttcttaggactgtgctgattagtatggggttattgggcacacttgaaatggggctagtctgaactagatgtattataattgtaaaatatatcctaaatttaaaagatttcaaataaagaatgtaaaacattatttttatattatgttgataatgttaaaattctaatcttacctgtttcagttttattttttaatggctactagaaaatttcactggctaccagaaaattgaaaattgcatatattgttcacatttgtggctcactcatttgcattggatagcaagctatgacatatatggaactgattttctagggcacattaatccttttagtacttctttggttatattttttacattgaagcatttggataatttgaaatttgcctgggtgcatgcctgcttagatcccagtttgtttttcctccagatgtctaccaagttgactcaacaactcagttgagttgttcatctctgatttgggaggccacctttaccatatgccaactcctcgtatgcatttgtatctatttctagactttgctgtcgtataggcatgttaatatttgaactagtattatactttatatttttgagattttaaaatattctttaatgtctagtagggttggtcttcatctccaattgactacccccaaaccccacagagtttacttggctattgtttttcatagtcttcggctatgaaaattagaatcagtttgtctagtttaaaataaacaaaaacaatgttttttttttttttattgggatcaagataaagaggattgatgtcttcacatgttgactcttcatgtctggatatggtttggatttatgccttgcccaaatctcatgcagaattataatcaccaatgttgcaggtgaggcctggtgggaggtgattggatcatggaggtggatttcccctttggtgctgtccttgtgatagaattcttatgaaatctggctgttttaaagtgtctggcacctcccaccactctctctctttgtcctgctctgaccatgtaagacatacctgcttcccctttaccgtctgcggtgattgtaagtttcctgaggcctccccagccatgcttcctgtatagcctgtggaactgtgagccaattaaaccacttttctttataaattacccagtcttgggtatttctttatagcaatgtgagaacagactagtacagtgtccaaggagatggtacagctttccatttagtcaagtcatctttgtgattccttcagtagtagtttaacattttcttcatacaggccttgtccattttaaaaatttatttatgtaatctttctttaaatgctgacatacatacataaatatatataacatattaattgtgtgcactatcagcctaccaaattctctaattgtaataaatgatttttttggatgatggtgttgagctttctaatattatctaaaaatactgataattttacatatttctttccagtttttatacctttggtttttttcacttgcctaattttgttgtctagtaattgcagtacaatgctgaattatagtggtgatagactttttgtcttgtagctgactttaatatttcttcccaagtatgatactggcttttgagttgaactgtacatattttattagagtaaaaaaagttcatcttcatattttaagaataaaaattttgttcacttaaaaaatcatgagtagctgttacatttggttaaatgccttctcatgatcatgtgattgtttttctcttcagagctattaaaatgatgaaatttataaattgttttattaataatgaaccgtaattgtatttttgagaaaaggataacttgtttatgatgtcttactctgttttcatttcctgctagattctgtttgataatatttatttaagattttggcatctaattataagtgagattatcttgttgtgtattggtcttgttatacttactttataacaataaaataatattgaagttctcatcaccccatatttcactataccagtttaagtagaaatgtacttatctaggccgagcatggtggctcacacctgtaatctcagcactttcagagctgaggcaggtggatcacttgaggtcaggagttccaagaccagcctggccaacctggtgaaaccacgtttctgctaaaaatgcaaaaactagccgaacatggtggtgggcctctgtgatcccagctacttgggaggctgaggcaggagaattgcttgaacccaggaggtggaggttgcagtgagccgagatcactgccactgcactccagcatggatgacagagcaagtctctctctctctctctctctgtaaatatatatatatagataaatagatacagataaatatctctctatatatatctttatatagaaaggaaggaaggaaggagacttatctgccctttaaacatttggtagaattcctttgtgatgccatgtgaatttagtgccttatttggagggtagggatagtggtggtgatggtagttccctttgtgggcagaagcattctctgtatctgttatggaactctactgttttagattctctacttcctctgagataggcatgtaaaaaaattttttttggcagacttttgtgtgtctaagtatagttcttttgatgttaggaaggtttactttttccccctattgattacttctatagttacaacctaggttctctattgcttgaggtagtatctattagttctatctaatgaacagagtggtaagattaatgtgttctcactttcttgttctttgttcctttgctgccatcttattttaatcaacattatctttcatatatttttttcttacctgtattctctttaaatatgagtatacttctcttccttgatttgttcagttttaaattgtatccaaagactcccacctatattatatggttaatgccataggtaagtctactctgtctccaaaatttattttacttcctggtcccctacccagttggattatatctacatggtcacagcaaataccttttatgttgtcttttattatcctgattccctcactgtttttggttttactgctgtggttgtattagtccattttcatactcctatgaagaaatacctgagactgggtaatttataaagaaaaagaggtttaatggactcacagttccacatggctggggaggccacataatcatgacggaaggtgaaggaagaggagtaaagacacgccttacatggcaccaggcaagagagtgtgtgttagggaactgccctttataagaccatcagatctcatgagacttattcactgtcatgagaatagcatgggaaaatcctgccccagtgatttggttacctcccactgggtccctcccacaacacgtggggattataggagctacaattgaagatgaaatttgggtagggacacagccaaagcatatcagtggttaaatgcatttgttggaagccttctggttccaaccaatatgaagtaacaggaactgaatttacattttcatctgaaacagacaaaaaaaatggacaaaatctatgaaaatatgattttcgagacactggacatttagcaatgagggacatcgattcctgacagaagggaaccaaatgaggggggaggctatgacatccccagcttaaatccttgaaatagtttctagatcttggtgcaaggaggaggaatccagagtggtctggcagacctcttgatttgcggagatggaggtaagcatctgggtacataaaggacagaatactggaatgaagaaagctgctccaagagagaattctggatgtctgtagagggtttcacctgattattcagattaacacatgctggagaaagaaccatctaagaaggtttgaaggtatctttgttagtgttgctattaaggtatacctgaggctgggtaatttctgtataaaagggttttatttgggtcatggttctgaaggcagtataagaagtattcccccaacatctgcttctggtgagggacttgggttccttccactcatggtgaaaagtgaagtgagctggactatggagatcacatgttgagagaagagcaagagaaggaggggaggaaggtgacaggctctttcaacagccagttcttgtgagaactaagagtgaaaactccttcactcccatgcgagtagcttggtgccattcatgaaggatttgccacacaatccaaacacctctcacgagaacccccatccaacattggggatcagatatcaatgtgagacttagtggagtcaaataaaccatatccaaattgtaacaaaggaaatcatgcccattgctcacaaaaggccagaaatagtacctgttcccaccagcctactggagaaacatcatgattatgtcagggctgtggtcttaactgagggtcagttggggaggaatttgctgtcaagctcacacggttgttagtagcatgttgttctttatgggctgttggactaaaggctttagtttctgacttgttgttgcccagaggccaccctcatttcttgccacgtgaacctttccaatatgtctgcctacatcctcaaagccagcaaagggagagaatctccttgcttggcaaggtgatataatcttatgtaatgtaatcacatacattttgtcaccttttctgtattctacagtttagaagcaaggacctattcttgtccacactcaaagggagggattacacagggcatgaatacaaggagatggaagcatggggctaccttagggtttcttttttacaccagagatgaggagagtatcttaaaaacagctggattttttaaaataagaagaaaacattcaccagaagaacagagttaagcacagcaacagatttctcttaggaaacattttaaggggtagtgaagcaacaccttcaaaacgctgaaagaaaaaagctatccacctagaattctgtgtctagcaaaaatattactcaaaaacaaaagtaaaatggggcttttgactgaaagaagaaaaaaaacacaagaagatagagttgaaaagaagcaagaagcttcatttggcttcatttggagcattaggttaccccccaccccgcaacgccactaccttcattaattctgtgattcttccttggtcataatcttaggtgaggcatatatcttaggtaaggcataatcttaggtgaggcatctctactagtaggtggtggcaattagaatcaagtgaaaatatttatcttagtatttttgaataattttatctactgtgtttttctttataaaataactttctaaaagggcagtgagcttcctaagttaagcttcttaagaagtctttttttttttttttttttttttgacagagtcttgttctgtcacccaggctggagtgtagtggcacaatcttgcctcactgcaacttacggctcccaggttaaagcaattctcttgcctcagccatctgagtagctgggataataggtgtgtgccactatgccctgctaattttttttgtatttttagtagatacagggttttgccatgttggccaggctggtctcaaactcctgggctcaagtgatctgcccatctcagcctcccaaagtgttgagattatgggtgtgaacttccgtgcctggcccttaagaaatcttttatccagatagttatttgaggtttgatatttaattgagagtagtatgttaaaatatttaagtcgtttaaatcttaataattgaaacaaattatttaaattcaatttaagcaatttaaattatttaaaataatatttagcatgcttttaaaaaatctaaatactgctatgttttagcaacaaaaatatttttattttgctatggcggatctcaactccaatttccttatctgtaagtggaacaaaaaatatctatactttttatgtcataagatttttataatatttaatttcatattatgtcatgaaaatactttgaaaactctgagaacacataaaatgtgaagcgtattttttagaattacagcataattttcattttgtgtcaaaaataactatacttctgattttcaaaatgcccactacagtgaagatatttttttgaagtacatgtgtgtattttaggaaattccaagttttctctatttgtaacctggttattattctagtctaatggcttcgttccataaattatttgggcttctattttatttattttagtcctggatcagtttggtgctacctttatcatggtgaattccgttattgctctaggggtttgagagtctgtggtttctactcttttggtgtataatttataatttacagtttgttaaaaaatatttcctccaaatattgaaatgtccagtactgtttcattgactcttatcaacccacagaaaattattgatttacttcttaaaaaatcacttcagtttttcacataattaaaatataaagattttcatttacagtaatttgaatttgggcagcattattttgacaccagtaggatcaaggaagttaaaaaatttttgtagatgctagaaagccttttaatactgtcacggaggtgaaagttgtgaagcattagaaacaaaagacatatggtcatttcagacctctttacacagtatataatgaaaaggtaaaaggtccagagtacaattgggatttcggagcaggagaagtctgtcttcattgaagctgtggtatctgacatagctttgaagtatgggtaggattgggttggacatagaggagcagccagacgtgataataatagcatatagttacatagcatttactatttgccagacatggttttaagctctcttcatatatcagcacatttcattattatattaattaataaggtgattatcttcactttcaagatgaagaaactgggatgaaaatttgttgagtgactgcctccaggtctcacagctagtgaacagtggtactgctatttaattcagccctttcagcctcagtctctgtcactgtgttttcttcctctagttactgtgctatattttgggaggacagtaggacagatgaagttaaggaaagttgaagtcatggaaacttttgaaagggaggcagaagcattcatatgttatcaatgtgaatatcaagtagttcagtctttctaggacgtaatttggtactatattgtatcaagaatctcagtaatcacactgtatgtatttgtcctaaagaatgtagggagatagttatccataggtctcttgaatctgtatgtctcgcaagcagagaggcatcaaacacctttttgttctggactacttgctcaaggaggtttgggtaacacacaacattggaatatagagatagtatctcccttcctgtcagatagcccatttatttgctatccagtatactacagataatatctccctttggagtaaaggtttggcaagtttgcttgcagctactataaaagatctgagtttcttagagcgcagggttcctcagctatgatgcaaacccactccctttgcatcatccatctgggccactccacatcacctctgtgggccttggagaccaaggggaactagcatgaaaatgatgctcatgctgcttactgtgttctgagtaataagtgctttgtctttgaccttgaaatgttatgtctgctgccagcatccaggacactgtggcaggctaacttgcttgtaagtagggcagaatctcagactcttcacagttattgacaaaggaatgtttagaattattaataaagcattatatatggtaattggaaagtaacaccactggccaataataagggactagttttgtaaatgatagtatattcatatagtgaaatattaattctgcagaccttaaatattatgtttgtaaaaatttaaagacttggaaatttacttacaaaagtgttaaatcaaaattatattatgaaaataatgtatatagtacaatctcagttgtataaaatatgtttgcatgtataggaaaaaaactggggtaagatattcaaaatgaacaaattgttgcatatcatttgtagaattataagtgattttttcttttctatttctgtatttccaaattatcctataatgaaaatacattacttttataagaaggaaaagtacacattattaatgaagtcaagctgagggatttgatatagtgtaatgggcagagtagatattgtatataatcttgagaggacagtaatataaggatacatttaaaacccatgcaatcaaagatctattttttattaaaatgtacatacacaatataactgaagaccattgaagcaaaaacaaaaataagaaatccaagttataacagaagtataagaacacagatattttagaaattctaatgtaaggaaaatccatttgaataacaataaaaaagctaagcaaagcctctcattgtctaataaaaaagaattaaatccatgatccataagaggtaatatttagatactgaagtactgaaagatgaaatgatctgatatctggaatttgctttaaaatattacagcaaaaaaatattttttaattaagtgggagagacaggtgaaccaactttggcaaaactattgatagatgttgaagttgtgtatattatgctgtcagtttttgtatatacttgaaaatttccatagtagaaaataaacaaattgtctctgatttatatagttctaagactatgcctctcaaccatggctgcacatagatatctcttgggagctttaagaactactgatgcttggaccattaaatggtcttgggtgtgccttaggcattaggattttctaaatctctcaggtgattataatgtgtagcttacattgaaaactaaagttctaagaggaaactgctaggtatatctttattataagggacattgaacctaatggatattttttatagcatttctttaaaaaaataaggtttacattatgttggctcatggatcatccctcagtaaaaagtgagactagcctatttttttaataaaaataattctacggagaacgataataaaataatgttagatacatagcttaatggtttttttacttaatgatgaagtttcagtgattctaagggatgaataactaagatattcctttcacatgtgagttaacaagaagcctaagatgtacagatgggatagtttttaaaaataatttaacattttataactttcttaaagtaattcttgctcattttagacaactaaaaaggatgtatagagaaaaaagaaaataatcagccaagggtccattattcatggtaaatactaataaccttttacagtacttgatttcaaatttatttaaatttttattgtaaaaatttcaaacatatacaagtatcgtagtctctatgtactgattatttatcttcagtaattatcaacctatgaccaatcttatttcttctgtatcctcgtcccattttaacccccctctaccggattattttgaagcaaatcttctatcatttcatctataaatattttagtacatattagagaaaataatcttcaggtcattaacacatatctgaagtatcagtattctgtgttgactgaaaggagatccatatgctatagctcccaattctctagttgccaaagatggtgttgttttataaaagtaaagagtctggcttatatccttgagctgcagaaggatctgctggcagggccaagacatttctcgtaaagtaactccatcagtttagatgatgaaataagtagactgaagtctaagaaacccagagttctacccattaaacaggccgtaatttggaagatatggaggattagaattacccattgttttgcttttgattaacctacattagtctccattgtcattttgtttagagccagttagtttccgtaaggatttggcattaatcatagcagttttggtaaaattatcatgaaggcaatatgttagaaaggagttgaagacaggaaagttttttaagaagatactcaatctttgtggcccgagctgataaaaatccagggttggagggtaagagaaaagacaaactttagcatttttgctatagtaaaaatttgcatgacttatctctaacatatggcagagggtgaagttgaaaagggaagaaaatgaatttgtccaatattagtgtattagtctgttctcacactgctatgaagaaataccgaaggctgggtaatttagaagggaaagcagtataattgactcacagttccacattgctagggagacctcaggaaacttacaattatggcagaaggcaaaggagaaacagtcaccttcttcacagggcggcaggaaggagtaagtgcaagcagaggaaatggccagatactcataaaaccatcagatctccttggactcactcattatcacgagaacagcatgggggaaaccatccccgtgattcaattacctccacctggtcccacccttgacatgtggggattatgaagattacaattcaaggtgagatttgggtggggacagggagccaaaccgtatcaattagtgtactgggttaaaagtaatagcatggcatccaagtagttacttctggttggccactggaaatagaggactagtattcgggtgatgcatagaagctggagatctacatttgaagatttttcatgaagctgtgaggatgattgagttttcataaggaatatttgtttaaggagaagagtgtgtggctaaagacaaacccttctgatagttggatgggaacaggaatataaaagcatcaatctataatacattaaattaatacttatcaaacatctatgtcacaggcattttgcatggaaaagggaatgagagcatactgaattgaatgggagacctactttaacacaaagggaatgctaagcagagataatgtacaaagattcatgaaagtagaaacttgaaaaaatgactcatggtacccagggcaggaggcctgaagttttttggtactatgagtttccccagagaataggatggagtggtatttcatgcagaggaagaggcacagtcacatgtgcttggggcattggtgagagtctggtgtggctgaagcataggttatagagtgaagagaataacaggggatttggttcagatatgtgggaactaggaactcatttgtggagtctgaagaatgttagagtcattattgaaatagaagacaaaatcaacagtttgactttaacatgaataaatagaacaggaaataatggaaaattcttaggttttctattctgtcaagcaaatactatcacaataatgtggggtatattttactggtatgaatttatattcatttttattttgggatttgataaatgacaatgtgaccaaagttaagttgccaaagattgcatatatatatgtgtatgtgtgtgtatatgcattcatttgctcaacatattaattgttaagagccaggtattggggttacaaagatgagtgagtaagataatgctctaccttcaatacctttgtcgattaattgaaaatggacaataagtgtttatgtatactagtagggtaagtacaaagatatggggacacccaagagaatatgtaatccaacttggatgttagtggagggacctggaaagccttcttgcaggggtaatgacaaccgattcttaaatgatgcagacaagtttgtggttgggttgatttgagggaagggagcatggaatagtggcatacaatgcaaattagatagcagtagcatggagataaaaggcaacctggtgtgtataccatattggaatcatagtcatagtcatttcattatacttgaagctccaattgtgaaatagatgaggcaggagatgagcttgtagagctgggtggagaccagcacaggttgacatttcacatacttaagggacttggttttatgcaggagagtgacctggccagatctgcattctagatgcatgattctgtagctagatgtgggataaacttgttgggaaggtagactttgaaataagattagttaggtgttttttgcagcagtccagccttcactatgtaaaagtttatgaataaggatgacgttgaagggacatatttgagaaatatttaggaagtaaagtgcacaggattcattaataggttcttaatggaaattcagggagagtgagtcaaaggagatgactctcaggtttctggtttggtaagtggttgtgcctgcagctacaacaataaattcagcataagagcatatttattgaattagatgaagaattctgttttaggccttttgtatttaagctgccagtaggctatccaagtgaaggtttccaacagggaatgtctgaaggttgggtgagaagtctaggtttgaaatccagatacaggagccatgagcatgtaaataatactgaaagcctaagagtgagcatctctttagtgtcagaattatgttcataatggtagtgaatatgccaagtatgtactgagaaaacttgacccaagaaccaaaatttgaaatgaactctgcttagccttgcctatttatttatttatttatttatatttatttatttatttttttgagacggagtctcactctgtcacccggagcgagagtgcagtggcgcgatcttggttcagtgcaacctctgcctcctgggttcaagcgattctccagcctcagcctcctgagtagctgggactacaggcatatgctaccatgcctggctaatgtttgtatttttagtagagatagtgtttcatcatgttggccagtatggtctcaatctcctgacctcgtgatccacccgcctcggcctaccaaagtgctgggattacagtcgtgagccaccgcacctggccagccttccctaacttgcttaattttgaacaggaaccttctttaacaaagtgagctatgaacccaaccaaagtctttttaaaacatcatgtgtttttccaaaaaatttaattgtagcaccaaagcagcatatcaaaatatcatttgcactgaattgatagatcatctatttggattcttagaattgggtgactagtgtatacaggacactgtagtcagttcaggacttcaaaggcagtctgtataattttggcaataataataatttcattttttcttctctcagctcaagcacaagtgatctagggagaaaaattacttccaaatgagcttacaattgccaacaacccaaaatttaaccaaattggatcattgcacactgcactgtgtttggaaaaaagactgacagaatgttctttcagtagattctaaggtataggaattacttaagtgcagtggctctggaaaatggttattgcgtaaagatctggagtaattaagtcacatactgttcatgtgtagaagaattttctaataattttgataagtaacattttgtatgatgaaaacaagaatagtaagagtagaaactatagaatggcaaataaaacaattctcagatattgcaacattttgaaatttgattcatcatttaatttggatttcattgccaaaacaatttaataataataatggtaaacagtctcaaaatgcttacatcatgcctacaatgtaccaagcagtggtctaagcaccttacacatctcacaccaccctataagaggagtactctcataggcccatttatcacatgaggaaatagaaacaaacagaagaccaaaaacaaaaaatgcaaaaaacaaaacttggccaggtgcagtggctcacagctgtaatcccagcactttgggaggcagaggtggttggatcacctgaggtcatgagttcgagaccagcctggccaatatggtgaaacccccatctctaataaaaatacaaaaattagccaggcatagtggcgcacacctgtggtcccagctacttgggtggctgaggcaggagaatcgcttgaactcaggaggcggaggtgcagtgagcccagattgtgtcactgcactccagcctggtgacagagcaatactctgtctcaaacaaacaaacaaacaaacaaactttccctaaatcgcatagctagtagttagcaaagcaggcagtcttcccttagaatccatggtagacctgggtagtctgccttcatagtccatggtacacccaggtggcccacctttggagtacatgaccttaaccacagttctagtttaaacattaatgaatgcagttgttaaatagtgtatctatgcattgtggggttttaaacaaatatggagatgacatgattttttgccctttaaaaccagtctctggcactgtttgccatataatttgcattgcacgcacaccacaatgattcctttgatttaaccttttcctactactgtgaaaaggcaatgttagcatatattccttatgtatttacaaataaagggatttttataaaaagaaaacttgagatgatctccttagtttaaactgtaccttatagttatggataaattagatgtagggattactaactttaggagattttataaggacttcaataggtaaaagcctatgtacataccttgctctttacctaagaatattttataagtagaaattactttaaatcaaataattcaaaaggtaataggcatgcttactattacaagttttattgttaatattttttattttttaaattttaaaagtaatatataattgtataatagaactttggagataaaatatgaaaattcataaacccagaatctgtaataacctgttttacttccttatggtcttttcctatgtatctagtcttacattgctttaataatagtatatttataattttgtactttaggaagttttaaatttattgttaatattattagggatcttttttgggtaaaaatacaataaaattttgtcttttggataaatccacattttcatattccgggtttgttttgtagtctctaccaagtacacatattataattcagaaacagttttgtgttattctatttactgctgtctcttcaccctctttttgtttctgtgcctttggctttccctagctgggcacagtcaggtccactgatgccccctatctgcaaactcagtcttgcacagtacctgagccattcttacctgagtcagctgatagacacatccttagcttcagatgcacacctgctcgttgatgtgacttatagttttatccatccaagacctggaattcgtccgcacagctgtttgggctcctacgttcttccagctgacattcacccctaggtctctcttgttgccagttgccatgagatcagccctaggcctttactttgctgctctttcccttatctctcctcacctttcaactgccacctttagctaacttggccagatttttctctctttgtttttttcccctgatatattctgctttattctataggcaccttctggggctttgatacttcttccttagttcctgccagttctgtccgctgcataatcccagtcaagcttgacatctgtacaagattttccagagtcacttcctaaattctgagcaagacttctccttgaaatctttactcttctgctttattcattgaatttaaccagcatcttgcccaagttatgctcttttgacctaggttttttgattggcccactgtcttttttgatgacaggtgttgtaggtggtactgtttcctttgaagtatattcgttcctggaaccaggtctcagcctcatttgcaaaggcctgaaaacacccaggacagtgtcagcatggtttctcctgaaggcaaattaccgtgtaaaaatcaggagagcaaaataaaaattttaatgcatgtagttactcttctaaattcactcactgatttttgttaggtctattcagatcctttttacagctgaaccatttatcacttgaagcaaaaggagcaactgtctatgccacgtccaaatgtctttgtactatgaaaacttgagatgcaaggcatgttgtgtctaggtttaacatcactgtaacacatgaaataagagtccatcaatgcaaactaaattaaaactgtagttgcataaatagaatctatggtaagctctctttgccttaccccatttattctacttattgatgaattttcataacttactccttgaataaattatccaagaattagcctgtgattttctttacatatttcttcatatttgtacacaggtattgccataataaaatcttatagtgattactgttttttactacttacttgggctggattttaaaataatgattactgtttttactctccatttggactggatttttcatttacaatttatattaaaatggaacaacattgtcaagtctactgttagaaaggactcaatcattctttcgtttttttcaactgtagggacattcatatcctttcctccctagtcatacatgtaactggtcctatcagtaacatgattagatcacaaaacttctttctggtaagatatgaaatttgggcattcacatttaattttaaccttctgacattatgctgttcttttcctctctggcttctatgtggaataatgtggcatggccagtttcttacaagatgtaagtgggtggggaggttctgcaacagggtactggaacaagacagccacagggaattgactcgattaaatatatcatttccattgtatacagttgtgatgtccaagtgatctgatgatatgagtcataatcataggaagcttttggtcataaataaatacaagaaagaagtaatgaaggatcccagctagtagaacatgacaatggagtgtctgtttaaccatcaagtgtagacaggctggtactcgatttcagtatgatctcttcagaccacatgttaccttttctttcgtgccatactcagatgtcccaaattattatcactcttatgactgactaacatagaggatttccagcattttcttgggttgcgtggagttgtctcagagatttctatatattaatatatacaaaggacatgttgtcaaaggaagtgaaaaaaggttgagttaggtgaatttccagaccatctattcctgctttactcaaaggtgtttttgtgtattttacgtaccagttgtgtgtaagaattcatttgagaaagtggctgccttaaattagtctgagagctatttcctctgtccatcacagatagaaagacacgatttggtgctgtctcccctctaaccgttgatgtgacagctattcattgaatacctgttgactgccaggccctgtaatgctttgttaggcatcttgatcatctactgaggtattgaatgatcactgcgttacagtcttaagttttccctctggttctgcgcataagttaccatgttttctttccacattttcttgataatcttacaacttcaaagtgacttctataccaaaagttccaaaatctgtctccagtctcactttgccatgtaatactcatgtgagatttgataagtcatcctttctgagcctcagttttcttatttgtacaactgatgtaattaccaacactagaaggataaaaagacagtgaaaggtacaagcttatataagtataaaggataatattatttttattgctgtaatcagtaactttaggaccatatctcaacatttttgtaggaaatgcttgtttgtacagaccctgacaccttaaacttaagatttactaaatagtgttcagtcactcttttttcttgcatgagacactgtccttgattttatatttttatgatggcatgatctttccgatagtcattacatttcaaaatcttgaaggtacatttttagtgccttctcctcctttagaggagaaatgttactacatttcttcagactttctttgcaacttgtctgtattgctctaatcatctcataactggtccctttttctttagtctttacgtgtactgttatggaatttttatttttttgtttttgttttgttatttttgccttttgtttctctactcctaaaaaaatatagcctgaaacttcagcatccccgcactgtgtacacattggctcacttgtaagccttgcattcaaggtcctctacaatatatacttaatctgcatttgcagcttttcttattacaactttttcatgagccaaccccttcagccaacctttttgttttcaaattgagtattgaccacttttatttctgtaagctctctgtctggaatgtcttctctttgttgaaaaactacagatccagtctggcctattgaaaatgccacctccatgaaagtatttgtaatattcctcaaacacatgtgattatggctcttctcttctgaactcactatctcactgttctttacttcatctcagctattccatgcttgtataatacctaagtaacggcataaaatacacttaactatttctttagttgaacttgatcactgtgtatctgtttctttccatttgtgaaccatatttgaatcagcctcggccccatgatgagaaagtggttggtgacggtaatgcagtttcatcttacagtttatgtcctaccatgttgcaagtacaagaaggaaaagtggctcccaaccagctttacactattgaaaatatgggggaccgttttaacactattttttttcttgataacatgcaggaatatgtgttgaaagaattatttcaggcatttttatttatatccatgttaaaatatagttaaatgaaagtatcttccaatcagaaactaaaattttatagaacaagtaaatttacttactcctagaaagatgtctcacctgttcttgtcttgattaatcttcaaagggattattttttatgatctgcagtttgtgcatccctattttaaggcattaagctctgtatcaaatcctttttgtattattgcaaatcaaccaatcttttgctactttaatgttgtcagccattcactctttattgttattttaaatgccagaaagtaaaatgcaaaaaccccaccctatattaatgtaattttatggttaagattttacattcaaaaaagtccagaaattcaaagttatagttcccagaagaatcctaattcagtcacattgcataaactgatattaaggctgaaatgtatcatcattacagtaatgcacaatacctctatatgcatgaggacacagttatagttgctgagggaaccataattttggattttctgactttttttgcacatacaatttcaaacataatgttgttaatgcaggcttttttcattgactctgaagtaatgtatctgttgcaatgtttatcttaaaaataagttttcattggctcaatttttttccttctttatatcaataaacctatgcttgtaaagatctgatgtccctacagcgaactacctaggaatatttctgtataaaaatagtttttagcctcatgtatgctgatattctctctgcctttctttctcacacacacatccacacacagcctcacacacttatgttacattctggcacattatagaagcaggtagcatatccactacctgctgttgaaagtgttgacgatactgaattatttattctatcttctacactatccaaaatcattttgggtactttgacacattttggtctcttccatatggatacttcatggtggcagagttgccagatgctcaggttttgtgacagtcttagtttttcaaggactgttggaatattcttgggagaatctcgccttgttactgattcctatggagtggtaaaatactaacatttctttgaaagtgtttttcaagacaaggagttgttataaaaaagttactagaatgtcccatctgagtgtttttaactttgggaacctagtaagggaggaatttatcatgaaattcatttacaatgagttggcatcatcttaaaaaggaataataatagcagtatatgtaaatatggggattaaacaaacatggtgatatttcaacatttgaaatattagatatttgactctcatagaacgtcagccatttatatttcaactgccaaaatgcaaaggagcaggatgccatctagtttatttttttactccttatcaactagacagaatcttgcatgtactatatagataccatatagatatcatatatatacaccatacatatatatagttatatatgtgttatacatatatgtttatatgttaaatatttgcttaattgaatagaatgtggatatttgtggtctcaagtatttacctttcctgttcagtatgaatagaaactccataatctcttccctttccaatccctgccttcaacacaaaaataattggacattctgctcatcttttaatagccatcgcaagtgttttctccttttctaaagccttttttctggctttcctgggccatatctgaggttcccttctcacttcgcttatggcattctatgtatttcttggcatttctagaccattgttatgtacaagcagagaaaaaggaagaagggacagctctgagtcagaagggaagcctccattccatggcctatgtgtaaatgtcttttatggctgagagaggcttttgactgccattatgtgatctatgacatgtgatcttcagatatgtgaccctcagacatgtgaccctcaaatgtaggcaatagaaaattcggatatcattaagagtcaggtggatatctgtattagtctctactgcatatttataccaaaagttcaagtactttgtctacgttgtgtggagagaagggatgaaacagaaaataaacaaacactgtaaataaagtttttcaaactttttttcttggtgagtaaactttcccccatgtaactagagagcattttcattgaaacgtctaacttgaaaaagttgcttttactattggaatcatgagtccaggctcacaagcagcaactgtgactttctttttattactgatttcacactggttctatttttgcctcttactggctaacgtggggcagatgacctcattttctgctcttcagtcacctggtaaagaagtgtggcctaggaaattttaaggtccttctttctgtagtgttagatgagtcctacatatcatgtttcatgctaggtgagacccagaaaagtgtgtctcagaaagttagcatgtgatgtaggttgtgttgaatgactccagtacttcattttagataatctaatatataacttaaagagggcagttgtgatcaacggaagcattttttttgtttgttttttgaaaaccaatgtttttgtttgttaaatttagctgtgtacagaatttttaatttttgttttactccatttgatctttaaaaaagtggcttttaaatgtttcccctctgtgatatatggggtaattaatattaaaatgagaattctcacacacaggatttagcaaatcagtgtttgtgaaaagtcttacctttaaaataagtgtataaaggaccaggactcagtcctaagactcacctttgattctttttctgttgcagatgtacaacattattaaacatttcactctctctcaaacatttcttgaatgcctactgtacatagtacagtttgctagttttgatgtttataattaattattcagtggtacccttgtaattaaatagcaaaacattggggatactaagttatttgtggggaggtatttctccaaatggtatattaagcaccaaatttaaggaggatttcaaagaactgtcgtgaacttgccaaaacaaacattggaggaataatcaaaacacagacataatttctatgagaagcataacaaatcaaatgataaaacgagtaactcaatagagtaaagcaaactgggaagcaaacttgaagcaaatactcataagcaccaaaaaaattagatgttattactgattactgaaagactgaatatttaggatatattttattttgatagttttatcagtagataggactcagtagaaatagcaagtccctatatttttcctggttagcttatttgttatttgggcacaaaatacttttttttttttcatggttgtcaggaacagcttagttgtcacgaagcagatattattattgttattgtcatgattactttaattattatagtgtcataatattcaagcctaaatcatgatactgtccaaaagccactctgtacttgcctgtggtttgtttctcaggcttgcgcctcaagagagttttctgaatttacttgtggatagtgctctggcttgactggtcagtaggtccttaaatgtgtataattttagactacactgatagggtcggattgcagtgatgatagaacttacatccattaccttgggtctccagtcttcaaactttatagtatttagaagggaactccagagactcatgagtggcatgaaataaagggcaaagaacattccaatgtaaaatgatatgctgcttttaaggaatagtcttgtacgatagattaatcatgagatgaattataaatatttcacatactaattatattagtttatggtgataaaacaccatatgaagtgttcccagcacactcagcaagttagatgctctttgcatgttaattgacttacttcttcaaggctaatgatcatgaatccctgaaggtgacaaaaattattatcaagatattgtacattgctgatctttgtaccaggttgacatctacctttcctcttgagttccttttgtttggatcctgtcttgaatactttacgatggtgaagcagagaacagtgcctgaaatactattagggaccccaggaaaaactaatgagctcaataaaaaatgacatcaaataacacatcatagaatcgtgttgggtgttcacatccatggggcatggggaatgtaagcacccatgggcatggatgcttcccagcttgttttaatggtaggagtgaatattgtattgaacacttctgtataaatggaaagttaaccagttttattttctcacagtcgttgagggaatgaatgatccattcactccatttattcattcacttatttgaaaatatttgttaagcacgtggctaggatggggaataagacagatgtaggacctgtcctaatggaactttaaaatccagagtgatagctgccaagttaggaaaactctaggatactaaagaaaagaacagcagatctaatttatcttatcaaggaatatatacttcagtgtgaagaaacgggataatatattaaatattggagaaccacatagaatagttatgtaaaattatataacagactagatcccacatttttaacaaacatatttggtgatcaggcaagttctttatttaaatcaactctccagtgtatttcctctcattaccctattatctgtaatcttcagttacctactgggcactctacttatattcagtatttgcaaaacatgtctctttatttctcctccaaaccaggatttttttcctcttgtgttaaggagtattacaccatcactatctgattatgtaagctagaaacctttagcctcttacttttaataaccaagccggacatttctttcatcacccttaatgttagccactctctctattccagtgccctgacctcctccttgttattccaggaggctcgctcctgcatgttatttaggatgcttcctagagtgcatctccttaggaaagcctttactgatggtcattacctctccacaatttgtatagccagagcagtctggccactcagtaaatatgtgatggataaagggttgaaataaaactattcacttttgtatagttcttctttgtaccacttatattcttttatatttccaacacagattctaataagtacaattaacacaaaaacactgagtcacatactaatcttaagatgattcaaaatcagtgtggagtaagtgaaaaagtagaggctttaggcccagatcaacttgaatttgaaactcatctttacctcttagtaactgctgttgtctcagcatttaaccaaacctcttgtgctttaatttcttaaccagtaaaatgaggataataagtcgtatctcttaggggtggtggtagtgatgtgtgtagagaaccttgcacgatacgtggttttctatcttcctttaaaatattaccatcaacattacaatattatggtgattaaaggattccattatcaaaaagtgatcatggaaagccatggatttaaatgaactgttttgtttttgtttttgtttttgttttctttgagacggagtctctctctgtcgcccaggctggagtgcagtggtgcgatctcggctcactgcaagctgtgcctcctgggttcacgccattctcctgcctcagcctcccaagtaactgggactacaggcacctgccaccatgcctggcaaattttttcgtatttttagtgttagccaagatggtctcgatctcctgacctcgtgatccgcccgcctcagcctcccagagtgctgggattacaggcatgagccaccgtgcccagcctaaaggaactggttttatatcttctgtatttggttatatttagagtaatcttccttattttgagaataatagtgatttatagtggtactttatttatttctttatcttctcactttacaaccatctttttcttggccaataagcattaaaaactgagttaattaagaataagaaaaaataaaagattgttagtataataatgaacatgcagtgagtcaccaaattgctgaaagataaagtacaaacttcttatcctgcatctggatacttctgggtctgaggagggccaccgtttcagttttatctgattattcatttttttccaaacgctaactgctagccctctctgactaattcaaatagcactgatccttttagtcccgagaactcaggacctgggcctcttctgccacccctgataattctgagacttcctggtttttcactgctcttagttctcttttcttccactgagtggccatagcacttagtgcctctgccttcattcgtaatcaatctcacactgctttgtgacatttcttgtgcaggagagagcagttacttatcttttttattgttatttaatgtttcctgtatttacggcttatttcaccaattatattgtcagttcttttagaacggggtgatatcttatacttcttaaattgccaagtcaaaagattttacagtgttctgatttgttgacttattgatagaatgtctaaaaacagatatatctacaaatgttctggttcatattaccttggaccttgtaagaatactcttaataatgaactccagtcccaaaagaaataaacacatacatgaaaaaatgtttaaatgtatgcaataaaaatttcaatgtatttatagattttttaaaatagtaggctcaccctctcttcttgtatcttcctttcttgttagaaacataattacaaagtgtcttttatggattaagcactgtgccagataccaagagttaaaagactcagcgtttgcaggaataatttaagagacacctgaatttaagtgacacctttagctaaagaagctcaataggcattatggaatttgtttccttaaacatccgtaagacagttcagagtgctgatgatggcagcaaggatagatgttaagaaaacagccttatgttggagatactgctcagtggcaggttgtgcctacagtctttgattccctaccttcttgacaggtgttctgtatatagtgcttttttgtatacagtgctctcctggccatcgtgataagcacaggaaaggaaaattacatgatggaagaaagtaaaactgtccgattgatgccacatgatgagacagcttttgggaaactggctactctatttataaacagcctgtaaattaccaccacaagaacctgggagattaaatgactgtgtttccttttccttcagataagacttccatcttgtatttttaattgtttcagcaaagggaaacattttgttaggcagtgttcttgtaagtttttgaatatccatagcatttaaacatgcagtagaaatggtccaattaagattaagtagctgacaactaaagcaaattgtgttaaaatgaattttgtatattgatgattaatgaatattagaactcagttatctctctacacaagttttatgaattaaaaaatatgttgaaaccaaagacttttgaaatgcttgggagtaattttcatttatgtgtgtatgtatcattgagtttctgttgtaattaaaactctgtcaaggtgctttggaagtgataaagggaagaaagcaatagctgtcctctctttcgcttctcatatccagttttatcagcaaaccctgacagttatcagtacacccagtcaggccacttggtaacactctcacaatattagcatcttagcccaagacagtgtcattttttttcttcttgctgtcttcttccactcatgactccttgcagtctgctttccatatggtagtcagagtaaagttttctggtattaaaaagtaatttaaatatgcatgaattacataaacaaaagaaatataagagattaatacagagaagatttcaaaactttatggacatgagtataaaaatcatgccctagttggagatattatgacttaccatatcatgaagcgtaataaaaaatcataccttttagaaataatttttaacatggcaaaacaacatggtgttaaaagcaagaaatgaaagtatgcaataatgtatttctgttacaaagtggaaagaataaaataaaatatacctaatgtacatataagattttgtcacttccctgcttaaaatccttccagctcttcctattgttcttaccacaaaaccaagattattttcatgtcttacctttgaatcttcacccttatttttggccactctcccattggctccaacctccttggtcttcgttcagttcctcaacctgtcattcttcttcttgcctcagctactttgttttccattttatgtctgtaatttagcatagtgccttgcaaataataggtgctcagcacatgcttagagcaccaaaatgcaaatagtagctatctctctttggaatagttatgggtgatattcactttatttgtattttttgtgcttaaaacattttccatagtgaatgtgtattttctaattctcagaaggaaaagaaaaaataatgccattccagaactggagagctgggtaggtgaaattcatctaggcaggaggaacatggaaattaggttatcacaagcgggtcaagggtctgttcaggaaaatcagttaagcaggtaattgtattcaggaaacatgggtgtcaggttagggaaagctggttcatccagaactgtgctttccaatacagtagccactaaccacatatggctagtcgatttaaatttaaatttaatcaaattaaatttaaaagttagttcctcaggagtactagctacatttcaagtgctcgatagccatatgtagctagtcatatgtggacagtacagatatagaacattttcatcatcatagaaaatactgcatcacagaaaatacaggatcctagagagtagatatcaaggaacaggaatgcatgagagggaagaaaagaaccaaggcttaggtaatgagtcttagcaacatgaatctagaccaggagtttaggtattgagcaaagtgacacagctagaagaatttactcttttgtcaaaggcctcctgaagccatgcaagaaattgtgtatgagtggtaacacagcccaaactggtgtctgtgttaaattgtatacactatctcattatgtcataaatagcttcaggagaggagaggggcctactgaaaagatttcatggggcaagagtgaggtgacctagcccatgaagaatcattactaaaatgtatgggcagtggctggaatattgaatgcctgccttctgttactcatttcacttcccttctgtaccatttaagatataaaagtgtgcatcttaatggtaatggtcacactactactgcccttaggtatatttcagcttttctttttacatattaagtaaatagggtaaaaggcaaacaactgatttatttaaattgagcagaaaataataaaatctttaatctcgaatttcattgtgtttaactgtttcggattctttaaacatatatgacttgaaatgtagatacaatgtgtattggaaacaatcgaaacgtgtacaggtccttttcccaaatacatggaatggtgttaatgtgcttgcagcatagagccgttttggttagatgattatagtagcagcttacttgtacttttggtgaaatggtaagctaatgatgtagctgttaatttgaatttagcagacattttaaatataggtttctcttacagagacaaaagttgcaatttaaagctctttggtggtctaaaaacagcttaattctgtagtagcatggtaataagtactaatccagcttatacagtgattgtagtatgtcatgtttgtgaaagattgctcaactgctttctctgggttttatgttaatttaaaaatattaaacataaaaccttataacatcttcatgctgagataaactgttcaatttaacttgtgctcaagcagcagctgtcaggaattatcttgttcctagtggtttttgctatcaccttgtgtcctttcctgctagagacacactgtgggatgataaaatgcaccttgttaggatttattggttaaataatacctgaggcaggatgagcatttgtagcccagggattagctgctgatcaagtgatgtcattcattgtattattatcaatttttaaaaattgatagtagggagcagagtaaaaattgcctatggatcacctgcattccttttgtgggcatattcattacttctttttgggtgttgttgagctaaatatttgagaaattgcttattgaccactttaccgttttacgagcaagaaaagcaaagagatgatggagataatttccactatttaaaactagtgagggctatttcaagattaattatacaaatacagtgaattttcttttaatgattaaacaaactgaaagaagtgttggcgtgggcagtctcaaatggggaatattatgaaaattattgttgtttctcatatgaatatattgccttcttttatttgggaggttttctttggaaggctgaactttagggttgaattctttggttacggataagctggtgggtagggggacatgtggtagaaatagagtgaagggctcctttcggttaaacattagctatagatagtccaccctgaggataatcctcatgtagaaattaacagttggaatatggctagaaatacagatatgatgggtttattgtttatggaatatagaattttttcttctacttactgccatttaatgcctgttacttcaaatgtatagttttataaatgtataacttacccaaaatttgcagtacgacaatgccttgctccatgaaatctgtttgatagactctccccatcccctgaagctatgaattactacacacctgttcacatagattaatcaactgttaatgtgtttgcacattttttatttttctctctctgtaaatatatacatattaatatttattattagtagtagcatttggctgaactatttaataatttattgcagacatcatggcatttcacatctaaataatttgacatgaatctcctaacaataggaatattctcctacataactgcaataaaattattgtatttaagaaattaaagattgataaaaacttgcagtcttataattagcccatattcaaatttttcctattgtcctaataatgtccttaataggtgttcttttcccttccagtgtccactaaaggatcatatactggattttgttttgagtgtctttatttcctttagtctagatttttttcttttatgacatgacatttttggagatccagcaaattattttgcagaatatttgtctggttattccttaccaaattcagcttaggcatttttggcaggaatactatactgatgatttgtatctttctcagtgtatcacatttggaaatacataatatcactttgtcccattattggtcacagtaagtttgatcacttgattacattggtttctaccagatttccccatcataaaaggtatattttttgtaattaataactcatatgaaggctacttttaatgcatttttctgccttgtgtgtgaaaaacattatgcttgcccaggtgataatgattaagaatgggcgtcattgcttgcaatagtatgtatggtcagggatgggcatagtaagaaagaatagaaggagaggaggattacgcaataactagacctagaagttgccatgtattcccttttaaggaaaatattgtttgaaattaatattttgttgtttcctctgctaaagatcagatttttaggtaaacaaatatcttcatgtttcagaattttcagtgtaagttttagagaggcttatatgtggtagtggtgtggggaatatgtttggacaaaatggggcattgtttggtcataattttttttttatttgggtatagacagacaggtttaaaaaataagtgcatctccttggtaagattttttttttttaaccttaaagagataaattataacattaatatagcaatgtaggtttgaagagggattgctggcttttggtcttgtgtgcctcttttagcccgtgaagaagacacttgaattcctacttgtgatatatgcacttattatgtaatccttcttatgtgaaaggctagtgcggcagatcatataaacacctgaagttagccatttggcttgtcagcaagggaggatttatagtagttgtaatcatggtaataacaaggatgatattttgtatttattaagtacagaaaaaagcacttgcaatgtaagtggtctgcaaccaattcatatctgtggtgtaatgaaaagcagtttgagcccttagaagaccagcagtctctctgctttgcaactttctaccagtgtgatcctagaaaaactcttaaccttcttgaacctgattttttagaaagggaattaaagccataaaggtaaaatgatgttacattatgttataaaggtggcattctatcaaaattgtgtcatctaaatgtcctcagctgctcaagtcctgtactttgtccctcttttgtgtccgtatgtaataggcaccttattagggaaacatttccaggttgtcccagacaattagtattgctttctgtttgtttctctaatgttttgtgtatgtctctattacaggcagcatttatcctgctgagctgtcttgttcatcttttctgttcttcctggttagaccctggcacatagtaggcatttagtaaatgtatgtggaatgagagagtaaattgacacttttttcatttataaacatggataggcaagctttcagtttccctttttcccttaaaaatgaggaatcagcctttcataaaatttttatatttgtgctttttaagggattttacagatgatgcatctggtaccattagcagtccagtaatggagaagaaaagatgtttttaaaaatacaagtattgtaagatactttacaagtgaggggagggtaagaaaacatgccaagagaaaaagaccatactagataagtctattgcataaatcaaaagagtttatgtcataacatgaacatgtgccattcctgctcatacattgaatttcagtagttggttgcataaagaaggaaagtgtaatgaaactggcaagcaaagtattccgcagtcagtcttatctttgttccatttgtccttcagatagagcttttcttgcctttttcaataaaatccatccggctttttttttttttttttttttttttttttttttttaacatttctcagtaactgcactgagaagaccagtgagattcggggactttatagttctaagcagctgctttttaagagatcaaaacttagaatgctgctacatggtattaagcctcaactattgatgtgtccctataggggatgtgtttttcttggggtgggaagaggaaagaggagagaagagcaaagcatgatcccttcaaacatacttgggacagtaaaccccaattttcttgtttcctaggaccctctttgcaagttcagtgcttaacctgaccgaactggctgcccttcggcctgaccttgggaaactgaaaaagattctgtattttcacgagaaccagttgatatatcctgtcaagaaatgtcaggagagggatttccaatatggatacaaccaaattctttcatggtaggtatggattgtatcattatatttggccctttgctacctttttctttgtaggtggttacgttttaaatctggagacctactattgtacacctttttttaaaacaccataaggtaggtgcaaatatttaaacaattcttccttctgcagtatatgtaagatcacaactaatcattttataaaaatacatatatgtaacaatctaattatatgttgagctaattatctatttttcacaacattcaaaatagaattaaaaggttggcagggaccttcaccccttgatttcatgatctattgcttaaggcatttagaaagtgcagttagtcaactcttacttattaatcacgatcactgtattcagctaaaatcaaaatagagttttacagagaagtaaaaattaaagcataatggagcaacttggggttttgtctcccccgccttttttttttttttttttttaaattgtaagacagagaagactatggacaatgaatccttaggtagtgttttcttttttccttcgttgagtcttctgaaatggcacagccttaaaataccatgacattttaaaggtgatggtcctctattgttacttcgacaaagtgtatctcctgaagcttagttaatgaaagaagttaataacaattctgaaatggctttgctattggatcctattcacataactgcaacagtcaaacggaatctgtttgtcagtgattttgtacattttatttatctttattaacagctattagcaactgggtttgatgatgtatttgaacagacccgcaattcttgcaagaatgtttcatagtttagttgacatagaaaaatggctatatagtaataattctgtgttgtgtgcattttgtgaatgttttcctacaatcatttttacaagctgcttcaattgtgaagtagcagtgctatcaaaatagagtgcaactgcttcacgtcaaatgtctcataaaaaaagcagccgttttaaaatttcataataaaattaaaatactttatattgaaacagagaaggaaaatatgttttaaaaatgaaaataaaatcattttgtgctttatcaatatggaaaacatttgtaatattcttttgatttcttgaattagcatcattcttttcctcagatagtgtgtttattacccctgagaaatcattgggaaaaaaactaagtctattttttcctttatgggtggctttaaagttaatggaagttacatccactcatatcagggaggaaatgtaccaaaaaggatatttctgtaaactatcttggatctttaatttagcatagactggatttttaagaatgtaagtcattgggtcacatgccgtttgagggaagctatctaaaaacaattcagctctcgattcctcctcactttcataaaacattgtttttgctgatagggaatgagactataaaagttttgtacatgatttttcagcattgcttttctcaagagggtaaacttatagacaagcttggagagagagaagtgtacttcatcatcagttggcttcttaatggggaaaaaatggttcacagttgtccagaggaaaaataagagtgtcaaaaggcagtcctgttcagattctctttgaaaagtatgactcctgcttcctcaaatgtttctttagttttcttgctgacttctgctttttttggcactgtcagatttctttctggactgtgtggcagttaaggactttaaagatgactgacataagcactcaccttaaacagtgatttcactaaccctctgacttatgaacacatgtcacaactatatattatgacctgtaggtcactattacaatatgtgacatatggtgaaaacaagactagctgtaaaacatccttcaacttttggtatattattatattagcttccttattgcttagtgttgtgtcagcacttctgtgacattcctttgtattgttcgtgttgtaatcacccacaccccccaaatttgcactaggtagcaactaataaacaatacttgtatagaaaatcagtttttttcaagggatgcacggaagtagcaggccaacactctttttgttcattttttattctgctagatattaacattgtaatagtaaatttggctgtctcagcaaatatgacttaaactaaactgacgtttggctacggcattcctattctataagctctacttattctgtggtgttctgcagtcctgtggacataacatgtcttctttccagtagtattgatctatcatttttagggtggaataaaaccaattgctttatccctttaatcttgtatacagatgttcctcaacttacgataggattacagcctggtaaacccattattgtgagttgagaatatgataagttgaaatgcatttaatacaactaacctatcagacatcatagcttagcctaacctaccttcaacatattcagaatacttacattagcctacagttgggcaaaatcatctggcagcacaggccactgtagagtattggttgtttacccttgtgatcatgtggctgactgagatttgtgcctcactgctgctgcctagcatcgtgagagaatattgtgcacataccattagcccaggaaaagatcaaaattcagtattcgaagtatggtttcaattgaatatatattacattttcaccattgtgaaatttaaaaaatcttaagtttgaaccattgttgttgcggactggtattaccacatttatttcattgaattcgaagatcatggtgttgcggcgctttataatttatatgtacctttatgtaatcagttaggacctagtgatctggatttccggatgcatttctaccagtttcttctatttctctggctagcccaatataatataatatgatagtgaaacaagttattttgggataccataatcctttctgtgtagtcccagaacttttaaaaacttaacacagtttcttgaagtaaaagctacagcaagaagtagactttaaccaaatagtgccgaaggtatcgtgccttagtatgaaagtagttttatctgaattagtcttcttgaagttagtgagaagtgtgacagatgctctgttctcggtagtatggtgtaaaatgatgcacatcactgacagaaattcaacatgggtagctgggccacgaagaaaaaggaattgctgtacgtagtgttgttgataatatagaaagttcctggcattgtggaaaaatatgctttggtttggagtctcatgcgatcccattaaatcattctatttccctgttgcctttcaaatctgatgccaccaatcaactccctgtgatataacactaatgaaaccaacttagctcttagagacattttggtagatactgatatgaagtgaagagttctttgcaaacctaaggtgtagtataaactctgattaatccatagaggtcttaggttgataaaaattactctgaatgagtctgggctcatcatttgcatttgtcttttacctttacagcctggtggctgatgtggttgtattcaactcagtttttaatatggaatcatttctcacttccatgggaaaatttatgaagctgattcctgatcacagacccaaggatctggaaagcatcatcagacccaagtgccaagttatttactttcccatcaggtttcctgatgtgagcaggtcagtatgtttgactctgttctcaatattgtgtcataaattattcctcaaatgtataaaaattgatgttcttcatgccagttttaactttttagcataagtatggttagttagagaattaagttctatctcaccatgctgtgatttacaaagattttaaatcatcatgtgtctaacccatcactagttagttcagatattgagtccttcttttcttttcttttcttttatttatttgtttgccaaagcagcccggtgttttgtttctttctttctttcttttttttttttttgttacagaagtcattgtcaagcatatttctcaacctttgcattcagcttatgcccattgatttatatatacaataagaactggtctagataagtcaatgttaagtctcactgcttggattagttcatttctcatgctattttcttttattttttctttatttttaattatttatattatcttaataaagagttaagtcttctatattggtttacaaatgtacctaattgccatttctctttcttagttactaaggacattttttttattacccttgctgctgggcccaccttgaattagcaatggatgatgtggctcaaagggaacattctggaattccttttcacttttgattaaacctagcaaaactgtttttactaccactaggaatatttctcccttgtgaacagaaagtgtacttcagtgggactcacactagcaggagacgctgctgttttttactgactgctttcttaaaagagttcaggaacagctgtttcttcctcatccctgaaatgaaggcaggaaatgatttaatatccatacatgctatgcaagaggtcagcattaacttctgtgttctacacttactgagttcacccatattttgctgtagaaacggtagtcctcatctgcaccccattgctgatttatttgagtgtcttatttgttaatatttcatcgaagaaaaatctgccccatacaaaatcaagttagtgaatcataaaatttaagttagaccatcttgcccaatctttatataaagtgcagaaaacagaggcccagagaagtagagactggcttgtattcaccttgtcgttgtcacagactggattaatatttaggccttatgacttctgatttcaatttctacttaccattcaagcatcctgtcattacaggtcatttgtcaaaaacagttaatgatttatttgctgttttgaaaactataaagctaagtggagccacgatcacaaagcaattttcagaatatatatgtaattacgtatattatctatgtatttgtagacatagttttcttatgtgtgatgagagaactacaacttttgaaaaatgtgatagttatactttgcctgtgattaactagaacagttatatatctgaatttttcaaaatatgaaccttatattttgacgttttaagtttttttaatatcacatataggcaaaatgtatatctctaagtgagtagatggttatagctcctcttaattattactgctatagaattctaaataaatgttttaaaattcatttacatccgatgtatttctgcaacatcatatgtttaatatacctgtggcagttgagtagtttattaatttggatgatattaccataaaggaatctagctaaatagaaaaaggttaagaaatattgtggccaagataacattcataagcaaggtcttagcctagaatgttatttgaattattttcaaatggtaatttgctttatgcaacccaaactcatatagtgtaagtaagtgattatttgcatgaatgacaatcattctaacgcctgcagtttcaaaactgtattattttgttgagatgttgaaaagtatttagtaattccaaaggcaaaataaccaaggtgattaaaaaatatttttgaatgcttgtatctttctcccaatccaaatattatttggtcatgggaaaaatgaatttaactgaaaacaaagcagaagatacagttaaattattagtcattgcgctatataatataatggatattaattagggaggggagaaaagccatatttccaacaaaataaatgaagatttttagagtttctatctgttaaaactcagagcatgtctgtcacctcagcagtttcgctaatattagactcacagcacctactgctacctcttgccttcctcacttatctcctgcctcactcgcaatgaccagataaatagtagcatgagagtgtattctcttgaaaacatttcattatatgtattgaatattttgggatgggaaagctcttagacgccgtagtcatgtatacatgtatttgagttttgaccaccacttactagttctgtgatctgtacttgtggaatgaccttgcacttaagtttgttaatggttgtgattaaaccatctcatagggatgatgcagtgattaaatgaaataatgtataccatgtacctaggatagtgcttagcatacagtagacccacaacaaaaggttattttatcttgttacccgccccgctcccattaatttataacctagcatatttattggcatctgaatatagaggactatcttccctctgcctctcacagtcctataatcgacacatgaaaatagagaactactctcctaaaagctgaatctaatataaataaggagattggttttatttatttactttatcaccttgagtcaaacaatcctttggccttaccagaccctaccatccattgattgagccaacttaatttcactcttgtcctattttctctttctttgtccagcttaactttcttattccgtcattatgtttactctcttgcatatcctctcaaatcatttacaccttttgtttcatatttgattggcaaaacccctcgtctgtttaaatctatttgttcatatactgtcttcctataatcatggactaaacataactggagaaaagcatgtcatacttattagcatgttctaaatgtgtgattcataagattcagatgggccctttgactacctggcaagcatttcccttcttctagataattatgccttctcctttttttagaacactccaataccaaatcttctatcttcattctcagctgatgagtgaggaaataggagcaatcagaagacaactttaatttattgatactaccaggtccacccaattatgtgcttcttctgggtgcatattctccatcttctcacctgttactggggatgaacaaccttgcttctgtgtaaggccccatctacacttcttttccagaactcatccatcccacatactcaaggactattgtcctaacaattttttctggtctattctacatcatcaattttcctttcttctgaattattcctattttccttttatctgaattatttctattaacataaaaaaattatttcttacatcttaaaatttttttttctccttattccacttcccccttctactacctcatttctctccttctcttagtagcaaaaccttaaaagagttgtttatacttgttccttctaagttccttcctcctgttctgagttaaaactattccactgaaatagttttagtcagggtcaccactgcctctaaatcctgtggtcagttcgtagtccacatcttatttaccatagcagcagcatttgacacaccatgacacattcttcagttgtctagggcacatagtcccctgattttcacacagactgctgcttctcaggctcctttgctgggttcctcatcatcatcctgaccttttaacattggagccactttggcattcttgacacttaaggggttggtggaggaagagcccaagattgaagtgagaagacaaagtaagagtcaggaggtcaacactgagataattatcctgtggaacaaaggggagagagttctaaggagataatcattagtgaattcacagcagcgaggttaagtaaagtgatgactaaaaagcgtccttgaatttgaccattaaaaggtcagtggcatccaccctgcattctattaagtcacaaaaaagtttcatgtgtattgtcatagccaaagaaacttaggattcaggtctggatgagatctctctctgtctgtctctgacgcgcatgtactctctctctctctttctctctctcctcttcttattttatggataaaggcgccaaggcccagagaagttatatgtcttctggtaatcacacagctagatataggcagagcaggaactagaactggtatctcaaaatcttcatccagtgttcagcccaccacttattgtaaatgcaatttcggaagtcttgattatctgatttttcagctgacagcagattagcagcatcaaattgggggtgtgataaaggcagtctcactgacagcagtaaaaagtgacagctgactgacagcttgacaacaggggaggagagagataaaccattttgaaaaaaatatatgggaagttaaaaaaaaaagaaacatagcagcctggagccattctatggcagggcaggcaactctgcacatcaaataacccctgcagacatttctccatgattgtacagcttgtacatcaaaaggatgactgtgatttattaagagagattaaatggtaatcagtaagtttcattttaagaatgtaggaaaatgcataatccacttttggcagaagttataaatgacagcaaatggaattaaacattataccttactttaagatgtgcatgagctgtgttcccctaaaggaagacaataaacatctaaagcctttcttgtgcagttgtaatatccttcagttttcagtgaccaggagacatgttattaagctatctttttaaaatctccctgattacagctttgccattgaccaaatttcccatttctgctgggttgcaaacactggctccttccatactgaaggcttccaggcctgcaagatgattggtggtcaacaaaacagattttgtaatattaataccagaagataaatatgatcctgagacttggtgagatgagaattactactggaatgtattgcaaaagactattttgtgttaaaggatatagattagattgaaaagtcaagcaattttgcagtgtgtttcaagaagacagatttcccgtggaactccatggtgctgagtatgtgatggagaggcagagaaaaaagggagtaatcttgcaacctactaaactagatgctaaaggaagccaatattttcatactttaggtcatgtaattgtcataaaggcaaggcctagcagaagtagggaaattttaaatatccagacctttctgcaagtctcagtcttatgaaatccaaacatctgaagaattacatcttcctttcccgtctcttttcctttctcttttctcttttctcctttctccttcctcctttctcctttcctttcttttcctttcctttcctttcctttcctttcctttcctttccttttccttttccttttccttttccttttccttttctctgttccctcccctccgctcccctcccctcccctcttttgacagggtctctctctgtcgcccaggctggagtgcaatgatgtgatcatgacccatttcatccttgacctcctgggctcaagtgactctcccatcttaccctactgatagctgggactgcaggtgggtatctccacatccagctaattttttaatttttttgtagagatggcgtttcaccatgttgcccaggctggtttccaactcctgggctcaagcagtctgcccaccttgacctcccaaagtgctgggtttacaaccatgagccaccttgcctggcctcacatcttgctttctgacagtgtcatctttagatggtagaactagccataacaactaacccttattgattattactctatgctctgtattgtactaaatgcatttatcatacatatcttatcatttaatatctttacaactctgaaagacatttcttgttgaagaaactcaggcatagaaaacgtaagtaactttttgccagtgatcacacatatagatagtaaaggtatacctggaaaccagatactttttaatactgttttagaacccaaactcttaacaattttgttgtaactacctgtctcacaaagagaaactctggtctctagtacttgactttgaccagtaaagaacaaatgatttataaaaatgaactgacagaaaatttgaatgaaagtgagtatgtcatggtaacattataagagaaagcgctcaaggcttttgaaagcatatttttaaaaggttgaagttctgaaaaagaagatacatcaacaggaatgagaaattttaagaaagaattttgatagaaaaaatgaaaatggtcctaaagaagcagaataggaggaatacttcaaagaaacagctgtgggctcaggctgtgatttcatgtgtaagaaaacatcttttttttaattttatttctgaagttatgtctcatttatacaaactctcttgcctcacaacttagcttatagcatgaaacatgtcttatagggcagtgcccagcccatcacattagatgttaaggatggagcaggctgcatctgcgcagcatccaacttcttccgtctgtccccctacaagattctctactgaaggagtatccatgattttcatgtcagtagattgtcttcacttccaacaaattggatcatataagaatgtgttatagacttacagcaaattacaaagtagcatttctcatccttgaaaaagaccaactcctcccaaggaattccatgagggagtcatgaatagagtgtatcaaaatgggtatcatcttcttcaaatcatattcagctggattaaacgtgaagcgagacaaatgctcaggttgtcaggctgatatttgtatatatttatcaattgtctgctttctctgtcccattatggaaaaagttaaaatttttttcattatggttgcatataattaatataaaaagatcaaatgtttatgtttcctgtggagatcttaaaaaaacacccacttgtttattttttaatgaggagatgaatggatgctatatccttaggagtttaagtttagattttgagtaaattaaagcaaatatactttagattcagaaatatatactttatctgggtttcaggtccaacttagttgtcacagagtatatccaatgtcaaccttgctatgatcactacaacagaatttcatatattttcacgatcatttcactgtctgttcctatttcccaccacattggattgtcagagttgccacagagtaaacaacagtgggtttttcctgtgaatttcctcaatttgtagtagattttacatccctggaatagggattatataaagagcatttctgctttcctacttcctacatttttgacattgaagagggaaaaaggatgttggtcatttggggtaatctcatttatcaaaaccttacaaatttctctgcacatttctcttcatcatttctatgtagctgaaatgagaacccaaaacagaggtttgtggactttgcctaactaatttagaaacagaaatagggaattttaaaaacagtgtgaaaactttaaatgaaaactcccaggctgtgcaaacaaaggcgaggcgcctaagggctttttgaagaattcttattaaaaaaaaacactattttacattgcaaagcagatgtgtcagaaaacaacagcagatttgtaattcgagaatttgtggattgataggacagaaggcagcccccgtggctccccacggaaaactttttgttttctgccatcaagagttctgcttttagggaagttgccggaaaacaccttaatcttcttaccacatgtggtcatacttctcagatattttgagacagtattaatgttggacatactagtaaaactactgcctttgctctgtgaaataatgaaatgggcactgtcttcttgaatattaatctgaagctaaagtagaagaaaagctttaactttacaaatttaaacttaaccatatttgctaacaattattttggctcttcagaataattgcaaaaacgtgtttcttttgaatgtcattaaaaaatttatagaattattgtgtaaaaaaacttttgatagattattctaatgtataacactactcactgtcaagaaatctcctttatatctaatataaatctttcatgctgtgttaggttgtaaccattttcctcttaattatctttgttaaaagagagtttggttgtcagtcatatatatatatatttgtatttatatttatttttattataatatttatatttatatctttatatctttatatatatttatttatatatattatgtatatatattatataatatatattttatatattatataatatataatatatattatatattatatattatatattatatattatatatattatatataatatattatatttatataatatatattatattattattatatattatattatatatatacatatataatatatatttatatatgtatatatacatatatatttatatgaacatatatatttatatatgtatatataaatatatatttatatatatttatatatatttatatataaatataaatatatatttatatatgtatatataaatatatatatataaatttatattatatatatttatatatatattatattatattatatatatatatatatatatatatatatatatattaccagtcattccattttgggtaatgctgtattaaaagatgtaaatcagtagtacagtatacagggtttccagtttgcgttctacctctaactaccactgttcagcctagggcaaatcactaaaccttccagagcctcagttttctcatttgtaaactgaaaattgaatattgaatttgtaaactgaaaattgaaatagcagccccccaccttaggtgtgttatgaggattgagatgatttttgtaatgtgctgactacaacctacaactttttggcagattttagtagctttattagtactttcattatcaccatttttgttatctattgatcggctttttggcaagtttgtccattcaacatgactccaacctgaaaagcaaaggggaacaaaattctgaaaactctagtaattctgtagatctaaagtttatcactaattcaagtaaataaaaagatagagactgtcttatattctaccaacccatatgacggcagccaaatgttgtaacttagcaatgtgagtactgtgtcatgtgacatgaaaggtcacatgtacagctgttctgtgacatctgcccagcggctatgatattcatacattccacatgggtgatgaatgatgatgagtggattgatcagtacagaagtaattctagttgtttagtattctattttagaatgctgggaaatgttctgtgaagttttccattaaaaaataaacaatttggaacataccattgaaaagtaagctaccagaataatctcttagccagagtggctcattccctaataaattcctgataaaagattttgttatgtagaaaattcttttaaaatatgcctcaaaaaattaggtgtaatgaaatttacttcccagtaatttaattctttgaggttttatatatgcccttgttcacccaacatctattaaaagtttgttatttatgtgctaaatacaagatattctgggatataaggataaataagacagagtttttaatcttcaggttaagatctttgtagaaataataggcatattcaggtgaatattcacctgaatatattcacctgaatattcaggcatgttcagatagtaaaaacgatgtgatttttatggcatttgagctgggcactaagactcaccaagctttgggcataatcataatggatatcctttatcaagtgccttttctgggcacacactttatgtacattacttttcatctttaccaatcccctggaagctaggtagtattaacctcattttgcaagtgaggaaaccgaggttcagaaggttaagcttgcctgaaattgcttagctacccaaactgtcttactctaatacttacttctattaatgccatgttatttcttgctgttagggaatggaggtgagttagagtgagtgagagggcacattatgaagacagaatataggtacacagaattgtgaaagtaaatggtcattggatctagagaagattaattatctttgacttagttgtgtgaggaggtggtaagactatagatgggattaagactaaggaatttagactttggcctatagtcatttggtagccactgttacactacagcatggataacttggtatccatgagtagaatattgatggaaaaggagataagaaacagagaaacaagtgaaaaaactactagaataggttattggagatgaactggagaactggcataacaatgaaaaggaggaagcacacaaataaactggtcatacacttggcaagttgatgtgacaacttgatggaggagtgtccgggagatttcgaagtattgattatagtgactgggggaagatctgtgctattggaattgagaaacagatttgctgatataaagatggtgaattcaacgttgtatatattgagtcagagatgagtcagagcctcgtttagatggagctgacctgcaggaagtgtgatttgttatattgacctgcatttgcagaaggtttggttggatttgccctttcgtttgacatacttgatactgctcaaattatttttttcaaataaatataattgtttcttatcatttattactgattgataaaaactgagtgcaaaatttgtaaaaccatcagatcttttcaactctttatttctgggtaagcaggagtatattgaattactcttctctttgtcttctcagagttcaataacataattgcttttggtcactttggatagagaatcatgagatgaagtactgtatgttgataagacagtgtggtgtagtgcctaagaaaactgactttgatgtcagacagagctgtttcaataccatgtcttctgataaccagtggctgctgttaataaagttgcttgacctttgccacctcatttttttctcttactggtcaagtagggggagtaatttcagtcatgttacattgttgtgagaattaaatgaggtattgtgtgtaagatacttggcaaaattcttgagctatagtaagcactaaataaatgattgttgttattatttttaatttgtgtgttcacaaaatgatattgttctttcattaacctatatgtaatgtctttaattttctgtagagccagagctctgccacaaattgtaatccagctcaacttcagtatttttaggagtatcatatgatgtttactttatgtcaacttagtgttttgtgttttttgattaacagttgctttctctagtactaactaccttactatgctgtactgagtgccaaaattcttcttagaaacattgctaagaatattagatccaagtacttttctatgtgtgcacttctgttgtatgttttgagggtcttctgcacttttggcctaataggaggtgaattacagaactttcttacctctgtaaggtttatatcattaccagctatctatagaggtgcttctgtgagtgattagaaaagataggctttcccctgtgggggtggctgggaaaagtgtaaattactattacaggtttattctttttttttttttttttccagaaattagtcagccctgtatcatgagattcaaaaaattaactttgaagatattgaaaaagaaagccttcctactatgttatttttcaataaatgatgtctcaaatccatttacaaaaagaaatgatatgctttccttaagtttggttgttttgttcttactatatttgactcaatgttgtctacgaatttatttttattagtaagtgttctcatgaaactagttataaaatatttttctctgtgtttggaagatttctgtttatcagtactattaaatgtggtactttaaaacattttgtaaaaataacagtgagaacttcatataggatatctagttataattctttttaattaaggtgagctcactagctgcacaaatgatattcatacattccacatgggtgatgaatgatggtaagtggattgatcagtacagaattaattctgattgtttagtgttgtattttagaatgctgggaaatgtttaaatacttggccctccttcagtaaattcatattttcttgcctgttgttccaaactggaatcttggtcctgtttcttaaatagccatgaaatgaaaattgtagaagttcttccttatttcttccttggtcacacactaaaatttacctataattagtgggcatcaagagaagaaataacattttagcacctcttctctcctgtatattttcatgtgtccatggaaatatagtcctcatttgaaattcagtccctagttgggaatgtgcttcctgttcctgtcatcagctcttgagttcatgagtctggcctgtacctctaaatttatttacatttagagagctgatttatctgttttggacacccacctatttcaaatccagtgcaaatctgccttattgactaactactgacaccttgagcagaccaagtcatctatgagtaaaagatgggtctattcaaagctactatatttcatttttataatatcaaaacttattttataatacggaatccttaagtgcatattataattattttccattaattgaagagggaacttctgtctcatgctgtgagaatggaattaaaagagacagtgggacagtagaatgcccaggattgagtgataaattctgttggaaacaaaagacaaggagaagacaaggggtggggggtgagtgaactcaaaacaattcataagtttttgaaaattcttgtattattaactaaaatagaaaaatcagacaaaaatgtcaactacatttccactgtagacaggttcattctcttttcagttttagacagtcgattttgttttaatgaaagaatagaattagaacttttcagaactggaagggtatctatgaaataaaaactttagaaatcttcccatccaaatctgttatctgatagctggggaaactacagtagagaggtgtttacctgagattgttagagcactatggcagcagaatcagaatttagaagcaaagagaaaaaacttcatgaaattgttagaaatgtggtactagagtcattcactgcattagtagttagtagaataggattagtcaacattgacaaaatagatccatttcttcaggaatagatggtattcagaaatttcttagaagagtctcaaatatttcagttgcatcacaacttgtggctatttttcactgaaaataattttatttctctgatctgtaactcattttgagatgaaaatgcatatgactcagtgaactccacttgctgatagcgtattttgttcttccagtaaacactgggctactcatataaaacttatttgaagagtgaggaataagagtttccagcatttgaaactcagaacctgtaagttattttcttgtctctcttttctgagatttgataccacagatcctgagtgaatcagtattatgtacaaccatcaaaatttttaatgctttctctttgcaagttttatataaattatttatcttttatgaataaatttttttcctaagctctccctccaggtttgtcttcagagcctatttaaattttccattgcagggtggctgtagcaacactcctgttctgcctcttcctgtggctatcaggtgaatccttctttttatccctgagtcctgttgggatagctggctgacgtcatgaggcgtgggctgatgttctggtcagttcagagtatgggatagggtaagggagagtttcatgtgttataatgtggtacagggggaagaacataaacttaggagtcagacttgggttccagtcttagccactttctagatgtgtatcttggtcaacttatgtcacctgttcagactcttagattctctaacattaagtcctagagatcaagtgaggatcatgtgagagagaacataggtaaagtgtggaatatattccctgcacatctctctgcccttcccatgtataaggtcacacctactcctctgtttcactttatcaactttaatcgccactcacaggcatctaaactgacctctttttgttgctacctcaatttctgatgctttgagggattattaaagtatatgactcaatttgctattgtatggataatccacataccactaccatgttttgtcagtgtgttcttccatctcttccctcatgactaacttaattcaattcaataactttttacaatgtaagtcctagtcattttcagcaactttttgcaatgtaagtctagtccttttatagaacttgggatactcatgaccctttcctgctgcttatgggtaggtttcacctgctctgttttgtttacattttttttgtgtgtgtttgttatgttttatttagtggctgttattcagcattagcactgtggaagagggctgttatgatcaataacaatcagctattcatatcattatatgtaatctttgagtacttgactctgattgaaaacctgtttctcttcatgcttgtaagtatttcttttatatgtcctgaatgtgcgggttgggttgagggtgcattacttctaactgtaggtagatgattaatatgcaggtaagcgttaatgtgttaatagattttttgtgtgtgttctaaaaagagagagtatgtcttagatgtatttgtcagaaaaaaagttagtataagattttacagtttagcacaaataatatacccagagctaacttgtgtcgggttcaaaaagccttctagttattaccaaaaagattacattagaattttgacccttcaaaaatatagtccttaggtgatagagcctttctcctcccagttgatgaagtatcactccacgaaacatgcctttggggtctagttgtgtggcctgtattaatgaagtacagtaaacccccacttaacattatcagtaggttcttggaaactgtgactttaagtgaaacaacatacagctggtcctcaaataataccattttattcaatgttgttttgttttaaagttgatgagggaaaaaaatgattttgtgtattgtttcacttaaaattgtactttccaagaacctattgaagccgttaagtgaggacttagtgtatgactgtatgcatcccctcaaatacatactgtgattggtttttctgccttaagtaaaagccagtcaaaccacaatcataaccaggttggtaaaatatagctcatagcagtggtttttctatgttaagtggacatcataatcacctggagagctttaaaaagtcctgatctctgagtctgttaagtcagaatatctggggttggaaccaggtgtttgtttgtttgtttcttgttgttattgtttttttttttaagttcacaagttattctactgtgaaaccaaggttgagagccactgactgaaagcagttctaccaaattacaaactgtggaaggtccacataccttcagtagcctctcttggttgcatcatgacaccattttcagtattgccaaaattatattcctgtctgcaagtgtcctcaggcaatctatagtaaaaaattatgtctccaagaaaatgaatttgtataattttctggctatcctgatgaaaaataagaaaatgttaaaaattgtatttatccttgatctctttctccatacgtgttggcattcctccatttcccattgacttaacgttcaatttttctcttcactgtttttcttgggtgacattgggaatttttaccatctgataaggcagatgtattttcaaataaaaatgtcttaagcatttgttcttcctactattcctttctttggcagaatattcatatagttgataaatagtttgctttctttaaataccttttcatataatctttgtagcatgtttcatgggtattttaacctagttttatggtttttcatgaaataaggtattttctaaatatgttatgctgaatttaactgaaataagcagttgtactgtatgtctttaaaatgatgatgatatcttgcattttagggtaacactttcatcctgaaagattccaaagcacactgagaatggttacaaattatacagtgcagcacagtcaccattgtagagtgaagcatggcagctgtttaacagctcatcacaacactacacagcaggttagggtacgaagtgaaggataatagtggattcacttgaaaaaattgctagggggttgaggtaagcagaatgtaattacctaagttggaatttatccaggacataaggctaacacctccagtcttagaagagaagctctgattctttaataaccatgtattacatgctatgtaactaaaatgtaagggtgcttctagcctcttcaaatcataaatgtatgctcagtgttccagttgagacttaaaaagaaaaaaaaaagccttcttttaaaaaaactcacatgttcatactaactcggggatgataggcttctatttgcatggcatttttggctcttaatggctggagcttgtcgaggattctaagatgttcagaattaaaaacgaattctatgatagattagtaatgtctgccatgggcatggcaaaagtagtgcttatacctgtgctatattttctagctccaagacttggctgctagtttcctgggatgacttagcaatactctgaattcttttcaaacctttggattaattttaattactcttccagacatatgtaagttttcctaagaaaagtttaggggaaaagaacattgaccgttttttagtaactgtcattgttggggttagagataaaaagatataaccttatgtcaaaaatttcaatgcaaaaatgtctagcaaaggaagcaaatggtgtcagattgggttttcatttggaaaaataaatcaacatctgagagaagcaaatggtaattaagtttaggaacacaaggtagcagaaacctgttactaaatcaaggtgagaactgaacaccggaatttggtttgtttgaggaataaactttggtacatagaataatagggccctggctctgaaacctgcaccagggatagctcccagtgatggtggcttctccatggctcttcagttctttcccattcagactgaccctctatctagagcttccactctgtggcttagtaatgcctataaaatcaggaaaatggaccctttcatcctgctaatgttaatattagaaataagtttataagcgaggtactgtaaaattcattttgcatatcttatttaattcgtatgacctaatatgttaggtattataactcacatttacatatgagaagataaagttaagtaatttgcctgtagtcccatttcaaatgaatgatgacaccataagttaaactttgatgtgtctggcttcaaagcgtgtgttcttaataactgtaccacaaagttacatgagactgagatcactggtatggcacttgcttcttataaactaaagtggctataggaacattctgggggtttaaagcatagttgaggaggaaatttagaacgcttctactagcagtctagggtgtggataatttgtatgttcttctgtcttccagaatcattatggatagagttgttagaactcagagacagtttcttgtagtccttttgataggatccaagttatttgactagaaaacaatgttttagtttgtttagagggaattcctgtattcttacaagtttggttaaagtaatctgtaaattactttaaacttgtgatattttgattctagatcctatatctttgtcttattccctattttatttcctcttattacgcactggtatcaatgggtgtaaaagatcttcttgcactctaatttagagaatatgaaaccataagcttgcttttagttggatctatgactctaagattaaaaagacaaggactgaaaaattatggatcatatttcaatctatagtgctgtgttcttacttttctgagaagttggttttccttatattcttagatatatccaaagaggaactctaaaccaaaaaagattagttgtccgacttaaaacagccttggtctaagtaatcatctaaagttctaagtaggatgataaaatcatcttttcatttgatgatgggccatgtggaaaaaacaaactttatttagttatctgtgttataaaataattttcatacctatatatcaggaatagatactcaagtttacacctgtggtctggtaagtcaagtttatgcctgaagcacgctcaaatgttcaggttataagactccaaaaaatgccttagagtgaaaaaggactgacagacttttaatcatggtaatgctactgtcacttttgaagtctgtgtaagttatctattactgtacctttatgacagaaaaagtaatattctaagaacaatatgtgataatatgattgggaaaatttggtatagtatggtatggtgagtagctggacactgtttttccatggcttgtagttaagatataatgatagtgtatcaaattctacttatatggcttttaaatccttatagataggtaatttaacaatttttaaaaagtaattgataagtaatctaattatatggtgtgtaaaaagacatataaatcatttattatgcaggtcatatttgtctttcttttataggatattattgttaagaggggtgcgtgtgtgtatgtgtgtgtccatgtgtctgcacgtgtgtgcaccttcattttgggtactttgaggcagttctattgcctttcacattgggcttgcaaccccagctgcatatgagaatcttgtggaagtttcaaaaatctttatgcccaggtagcaacctagacaaaataaatctgaatttccaataatagaactgagatatcaatacatctttaagcttcccaggttaaggaccactgataaaatacgtgaatacttagtaaagtatttacagcttgtacacatgtagataattgcatggagaagatgaacgaaaattttccttctcctaatacagaggagagttttttggagggttgtggtaggttgcttattgaaataggatgaccagatagaacataatactgtaaaactttaggctgaaagagactttcatttagtatcctttccattagcagtgacttaagtgaaacacctgaagaaagatgtaaaacacccgcaattcacctggccatttgtgcagtgttttttcttgactccagctgctagccaacttatgacctgaatcttgatgattaatagctcttataatattttcttagctagtgtaacttcaatagcaatactttttcttctaatgtcttacccttataaaatagcactaaactatttttctcaataaattctactgacacatggtcccatagattaattataaattgcatagaagtactgccctttgtcagttttaaatgtgtagctttatcttctctttctccttgtctttccaagctaaatggaattagaagcttaaagaaacctgatttacatggaatctatttctgttctcttattttaaacaatagtgccattaattttaattctaggctctttggttcctctactattttcattattattgtaattaaaaaagagtcatctctatttttacaaatccctttattttacaacactgtataaacatatttttagggaataattttttcctcaaatgctgttattttttacctactgggctctctccataaattgaattaggaataccaaataacttttattcatcaccatcatcttttttttaaaggtgaagatgaagggggaatgagtatcaaaaaggacttagacaattatggaaataaatattgggcctctttggcatgggtatttgaaaacaccccaaagtagatggaatgagtaactttagggcttcatgctggcacagccccgcaaatatttccttacaggattttatagacatttcacaataaatgtattttgttaaaatggtcttaggtcctataaagcagagtctgtattctaggaggaattcttttggagttatttaatagtattcctttcacagtgcctcccttcttcatacttttgttcccattgcaatggtagtgtctttgaccagagggtagtgtatggtagatgcacctgacagcaacaacttaagcataccctgagaatgactgtatggcagacatactgaatgtgttcagcgttctgagctaaggagtctgggagtggccaacccagaaattcattccttatcagtgaagaacatctgagcccctggtctgtccctcatgtacaggggatcaaggccctttgtcttgggttaaatgaagtttgccaggtggaggtagttagtgggaagatgctaaatgaaaatgctatataaactgcatactgtgcgagggtagtgattctcctgaccagtgtgccgccaccagaccagtgcttctcctgcccagtccactatccctagactctcccctctgtatgtaagcccctggtaaaaccccatgtctcattcaatggctctgagtctcttcttcaaccccttgaacatagtgccatccccattggccttgataggggtttggcacaacaggtaaagacagcttacactgagtcttagctgttccctttaaatgattgaaaggaaagaaaatatggtcttcaatggttatatttaaatatggaaactattattactgagatgctgatcccgttaccctttgaaacagggcaaggtagtatcagaaaatgtagagaaagtgagttggtttggatgtaacgaagatgaaacactattataatcaataaaaggcagagccagttttgtttgtttttttgttttgttttgttttcggtttaggcagctcttgaaatggtatgatttaaggggtagctcagaagtttcaaactctcctccaagcatctccctaatacttcctgaagttctgtcaccagttaagaagcagttcttaccgaaatccctttttatagttgaaggttgccagataactcctgaaattatatataaaatttcgtgggaatgtgtgtaaatgtgtgtgctttttgagaagattcataactgtcatcatagctttatgtatccataaagatattcttaaaagcagatgtccatcatataattttagcttataatttattcatagttatttccttctggttatcttacaaagatgaggaattaacctctagatccaaaactataacttggatgttctgacccccaaatcttttgttctttcccaggaacccagaaggtgagggagtttagagtaaagggtaatacagatattggggcagttggacttgagtgaggcactacagattttaagtacctacctagaggctagcatgatggtagtaggtatggaaggctcagcaagtgaggtgggtcagaagatagaaaaggtgacgtgcataagaaggttgaaaggcagcaaagtcttaagatatttttcacaacttttagatcatctcatactaggggaaattggaattgcattcccaatagatatttattatataccacaaatctcatattttttcttttgcattctttcataaaatttctgaagatttatcatgacttctttccaacccttcactatctctgctctctaatatcctaatgatatataataacagtaactttgtcacattactgcctttaaaactattcaataccacttcagtttatgaattaattttatattttaacactgtagtttctagggcaggtgttagttttttttgttttttgttttgttttgttttgtttttaatatgggcaaacgcagggtgcttatattctagaggcacaggatctagtgaagaaaaaagaagagaagagtatgaacagcaagagcactcagctttagacagtagactccttatatttgtgattttctttgtttcttgagacagccccatgaagcaggtactctgtcttattttacagtagaaaatccaaagtgtagaaatcctaagcaccttgccagaggtcctacaggcagtcagatggcaaggctggcctctggccttggcccttggattggagaaccttcacatttcaccagtcttctggttttgcttccctggtcattgtaccatgtaatgtgcacaatctgtatgaggtacaccagaagtagagttaggacagggattgcagagaagacgacattggagctgtgccttggaggatggaaaagagttcctttgcctatctaacaggagcaggaaggtattttcatctcagggaatactctaagacatggcctgacttgtattttagaaaggcaatagttcctcatagcagtagcttggggtgtgactatctcagggtttgtgcacatggttagtgcaaagttagaaatcagattcacgtaatctgaattccttgctgcctctcaatacctcttaattttaattctttgtagttatgtaaacaaatgaactctgggaattaatcctgcattaattaggaattaattttcttcctgaaccctaaacctaacccatagttcctactattcatctatctggtctcttgcccagacattaccagccctgtatttaaacattaagattcttacctagtgtataattgcaaggattaatctgtgaaacctttatttgggccaacaaggcatccagaccctgagtaagttctggggacccaaagttgctgagtcctttgctacccaggaattttcacgatccatatttttaaattttatttatttatttatttattttgagatgaagtcttgctctgtcgcccaggctggagtgcagtggtgcgatctcggctcactgcaagcttcgcctcccaggttcacaccattctcctgcctcagcctcccaagtagctgggactacaggcatccgccaccatgcccggctaattttttgtatttttagcagagacggggtttccatgttagccaggatggtcttgatctcgtgacctcgtgatccacccacctcggcctcccaaagtgctgggattacaggcgtgagccactgcgcctggcccacaatccgtatttctatggctaatgcaaattcaacatcatagagcatagtttttgccaaacttgaaaaattgatatttgtgtttttatgaatgtttgtttacagccggaactggtataagacatatcctgtgttttaaaaatatttttagtttttaatctcggtaatagccagagagatacttagctttttggaatatggataaatctttacattcaacagttcatagttgaattttaaggtggaactcataaggggaactgattgatgtagtagttgcttactgtaacttttcagatgccatggcatttttatagcatgctacagagttgaagacagatgagaaaatattagttgatactacttgctgatacaaatgttgaaagacaataacacatttcaagtcatatgaaataccagattgttaggagacaggtgttgttttaaaaatgttagtgtactgcacggtggctcatgcttgtaatcccagcactttgggaggccgaggtgggcagatcacaaggtcaggagattgagaccatcctggctaacacgttgaaaccccctctctactaaaaatacaaaaaaattagccgggcgtggtggcgggcacctgtagtcccagctacttgggaggctgaggcaggagaatggtgtgaacccaggaggtggagcttatagcgagccaagagggcgccactgcactccagcctgggcaacagagtgagactctgtctcaaaaataaataaataaataaatgaataaataaattagtatactataggttttagataaatctcaagtactttaaaatacttcacattatatatgcattaacattttatgtatatgcatggaaaattgacatttgaaactcacattttacacagaaaacactaacttatcaacctgtcaaataaaaactcagctcacactgacctatttaaaagtcaaagtcagttatttatcataaggcaaacaagacactagcaaaagaattacaatgtttatcactcaaactttagtattttatgctatttaatgatgtaattatttattattgttagaaacttaatgtgcttagaaaattatgcattgccgtgttaatttcggagtctgaaagtttttatgttttataattttttcctagaggagttatatgggctgagttatgaagattaaaaaataagaaaagggactcacagataagagagctaggaaatggctagagttgacagactgaggaagtggaaatggaaaaatgaggtattgatgatttcacttggtgcttctgtgaggttgaatttgaaaaaaggagaggatatgagctgtgtggatcaggtgctagctgattacatgaaagtggaaaatgctaatctactgtcagcgtgaaaacagtgcagatcggagtgaagaacatttgctggagagtcaggataggtaggccctgctcacctgttaaatatatagaaggaaggaatgggcatttattactgactgtcaggtggtatgcggggtgctgtccataggagaacttcttttaaatagagaccggtattcaccaggcttcacttttttgacatttactcactgactgcttcacatgagatcttgaaaactattctagagtgtgctggtagtccctagagtgacaaaaccccaaaaacccaggaccctcaatagcatagaccatttgggaataaactttgaaggcagccctgaatctcaagtaagacctgagctcttgttctgactcgctgctctaaactacagttgggctcccttttcttatctgtaaaacggaaacaataatgttttccctattagcctcatgggattgtaatttgtatgaaagggatttaaaaattatgaagaaatgcacaatctacagtgatatgaagatacaaaaaatcaggagtagattgctcgagtatatttctcttgcatgtgctctctctctcaggttgagtggaacagctgaaatggttctgttttagctcatttgaacccacttcatagacatagggtatggcagtccactggtccttgaaggcattgtgtacgggagttctatttttgtaatctattgcctgtgaataagccccacattttaagatgtgcacagattacataaatttactaatggaaaaacatttttagaagggtagaaacaaaccatgatctggaactacatctgaatggtggaattaggatgattaaaaaatgtgttttctaccacacacacacacacatgcacacacacacacccctcacataaatctactcccccccacccccccaccccaacacacacataaaaatctcatatggaaactttattttggcaactcacagtttgccttacttgctgggttaaggttgactaatatataagcaaatacagatttttttttaaatttactagtagataaaacacttggcagaaattgctgacaccatagaatgttatggtgtacatatttatgtaaagagctgtgttttgcatggatatattttactaattcaacgtactactcatacaacttattactcactctccctggacagttactcaggagatttctgctcttccctgcttggtagtagcaactagaagaaacagacttgcagggtaatacattttatctccctgcctgtgagttactgcagttcctgatttcttttgccctgccctggagcagtttgccctgccatctctagtgaaagaatttctctgaataccatttgcttgcatttattattaaacttttgctcaactttgaccatgtagtattgtaacacacaaatcctggagaaagacatgatagccactcagttatgacctgtgtataacagagaagacaaataagacaaaagtgctgcagaaaggaatggcacaggtaagaaattattggtcccatgtttctgttgttttcattattttttccagtgacattgccaccaagcactttgaatgaacaaaaaagtgcttggagaaaacaaaaatagtgataatgaccaaaacataggtgtgtgaaaccacagggagcgatgtcctggtggatcatcactcttccaactgccaaactggcccttgcctacatttagtagtaagtgtgaaagaagtagaaacaaatgatgccacagttaattttttgggaggcaacctcactaggaaagaggagccttgaatggttttacagagaatcaagattggccaactttcatataaatttgtatgcaattttggctgtacaaaaccttgcttaaacttagccagagcattcttactttgaatcactaagaaagagacaaccaccgtagagatttcagtttttgttgttgttgttgttgttgttgttgttgtttttagacagggtctcgctctgtcacccaggctggagttccgtggtgtgatctcggcttactgcaacctccgcctcctgggttcaagcaattcttgtgcctcagcctccagagtagctgggagtacagttgtgtgccaccacagctggctaatttttttgtatttttagtagagagggggtttcacaatgttggccaggctagtctcaaactcctgacttaaagtgatccacccaccttgacctcccaaagtgctgggattacaatcatgagtcaccatgcctggcctgaattttcagatttttaaaactgctgtgaattccaatgattgattctgccttaacatatgcctgcagtatgttctggtgtattttgattcagagacctctgggatacaaatgccattttattaacctatcttctagttgctcatctaagctttgttctaataacaagtccgttatacaatatctcagaaggatatttaagctgaaatctaagtgcaacctcttgttttgttttgttttgttttgttttgttttgttttgtagtgtgggcactactcatgtgcatacaacacactcccataaaactcaaattttgtatttatagggaaatttctcctgagagttaaggtcttgtaaaacacgctcttgttctacagcatgagcaaattattatactcaagggcattgaaagtgaagtgtactgaagaaaagaattttttcattaaattacagtttatattgataaaacagattactagcatttgatgaaatgtgtaacttggagcaccccatatcactaaatcgccagtaggtttattttggcaagtggagccagcatgtatgtgacatataaggggccagacagtatacctgatagcactgcattagattaaattgtcttttggtaaagtcgtttaaaaacggaaaaaaagtatggtgtctgtgccttgacaagcaggctgtagtaactaagattattagaaaataaaagctgttgtgttatcagttttggcacagtcatttatcaatcagtattttaaacattgacaagtggtaatttaatagggaatgacccagttggcaggaagttctaatgacagatgatgcaaactcatttatcattaaggggctctgctgagcttcttacctttctctgtatcacagctcatattttctaagtctgggatgtgagaagccacaaagggcaaatcctgtggcaccaagcctgaaaccctctcccaagtagagaagaacattaacactttaggggcactcatctttgaaaatactactccacattgatgtttttcaatttaaaacataggtgagaactatgtgttgtggtctactatttacctagatttttatttaaagaaaaagtgaggcagataaaattttgaatgaagtgcagacagaggtgctttagaaattattaaggcaatgaaaaaggcaaacagattctgatgagaaatccactgttcaaactgttttcctctctgcagttaataaatcttgtctctgcctgctttcaagaatttttctgtctttagttttcagaagtctgaatatgatgtgtgttggcatggattctgggggatttacctggtttagagttttctcagtttcttcaatctacagatcttggcttttgccaaatttgggaaattttcagccagcatttctttgaatattttttcatcatcaccttcttctgttcttctgggagtgtaatgacacaaatgttagagcttttgttatagtcccatacatttctgaaacattggtcatttttcccccatctttttttttttccactgttgttcaaattggctaatttttcttgttctctgttcagggtcaccgattctttttgttatctcctccattctacagttgagctcattcattgtgtatattctactttttagttctaaaatttctatttggtttgtctttacttatcctttcttattttttttccctctttttttctgaaactttctgtttcacttgtttcagatatgtttatttcttgaatcattttatgttggctgcttgaattcgttgtgattctctcatctaggtaatcttagttggcatctgtcgattgccttttctaattcagtttggtattgtggttcttcgtatgatgagtgattgtctattgaaatctggacatttgggatcttatgttatgagactctggatcctacttaaatcttgggttttgagggtttttttacaggcctcctttgatatgtattgctctgatgtgtgaagggggtgctgccttattattgtgagatgggggtggacgtctgagttcttctgtaggcctttactgaccagagtcaaggggttggctccttgggaacttattaccactgagctatggtaaaagtctcaactctccattaagtcctctctgacatcgcccactggaaaaagggagggatacctcattactgcctggttggaatggaagtcccagttctcagtctgtgccttctttggcactggtgggggtggagaaataccttgatacagcacggcaaagctggaaatctaggttctctgcttaggcctttgctggaagggttagggcgtggttttcgccatggtgttgggcagagtagaagtgtttagataataactaaagctttctgtcttgctgttaccatccctttgcttgtcctttggctagagagaatagatttttctaggggctgttctttggctttgcccattgatgtttccaggttgctgacttctttaatatccagcctgggctgtatcagtcagaaagaaagccagggaactaattactgtatcattccttaggttcaaagttctctagctaatctgccttcttgtctccacttattagaattttctcatgtttgatttttatagataatgtccagtgtttttcgttgttacttagtgggagaaagagagacaagtacatctgtattatttccctcagttagattctgtagttggagctcttggtacttgtgtctcaaaatatagcagactttctagatattttgtgtcatttgttaaattgcttaactattttgaactggaaagctttgtgcaagaatcctagggattattcttttcaacctagtgcaatattataccaatgtaatactttctaggaataaagaaccaattaggttattcttcatttaaacataattgacaaatagtaagcttttcatgtgttgacctctttaagatggaaagtgtattaacaaacccgagtaaaatacttcactccttagtgatgaatatttgggtagtttagaagatatccatcatgattattttgcttattggtacttatcattttgaaaacatttcattgttttttaagcaggccgagcatctgaattccagtagaattaatagaaactatataagagcggttcctctgtccagtattatatagcagggatccaactgtataacatgctgagaactcttaatgttggaagagagtcaggagagagagcaagaaagagatttaaagataacaaatgctggcctgcccagagaatgtctggcagtctgaatcaccagcttccggagatgtagggaactcacatctgatcaggcactctgtctgaagctggacagatgcagttataaggcttccaagtgtcagtgttcagaccagtggagtctagcagagttcccataggtctgtgtcagaaggaaattcagtcctaggaaaggggtctcaaaagatccatatgtgaacatcagtgctatcactaccttacctatgttttagagcccaatttactgctatagttgtatttggaaatgagttggagccagagatccatggaaaaggcctgttgggtggaatggccccagaggtgtgaacccggtgaaataagggtacaggggaagaaacagcagttaggatggttatagccagggcttctcatggacatgctctagatgtgggaatcaaagcctaccttcttaccttattcacttcacagatatatctcacttgggctctccatgggcctgccgtggttttgggtatgacaggctctcagtacgaagctgtagatgagccaggccatagagggtgcaaatttatgccaagaatcaatttggtacataacacagtagggtgaagaaactgctcttggctgattttctttggattttttgcacttttcctatattaatagagtcaaaagacaactgggaattttagggaattttcttaatgtaggaaatagttcccctaggaatccaagcaattgtattcacaataatgcgagtgcactggaaaggccctgatgtgagaatcagagacttaagatcaggtgccagagggagactgcaggcaagtgtccctacttcatctaagtaagatgggaaagatgatatcactcctgctgccttacatgatggttttgaatggaaataagttgcaaagagtttaaaagtgctacataatttcgtaatgtaagatttcattatatatttgcacaaggttttttttttttgggggggggtcgatttttctcttctgttatgtggagaagaatagtccttccttattaggaaactgaatataggagaacaagtccatgaatattgggacagtcctattatgtagttttatattatttatttatttattttttattttttataacactttaagttctagggtgcatgtgcacaacgtgcaggtttgttacatatgtatacatgtgccatgttggtgtgctgcacctattaactcgccatttacattaggtatatctcctaatgctatccttcccccctcccctcaccctatgacaggccccattgtgtgatgttccccttcctgtgtccaagtgttctcattgttcagttcccacctatgagtgagaacatgcggtgttcggttttttgtccttgcaatagtttgctgagaatgatggtttccagcttcatccatgtccctacaaaggacatgaactcatccttttttatggctgcatagtattccatggtatatatgtgccacattttcttaatccagtctatcattgttggacatctgggttggttccaagtctttgctattgtgaatagtgcctcaataaacatacgtgtgcatgtgtctttatagcagcgtgatttataatcctctgggtatatacccagtaatgggatggctgggtcaaatgctatttctagttctagatccttgaggaatcgccacactgtcttccacaatggttgaactagtttacagtcccaccaacagtgtaaaagtgttcctatttctccacatcctctccagcaccagttgtttcctgaccttttaatgatcaccattctaactggtgtgagatggtatctcactgtggttttgatttgcatttctctgatggccagtgatgatgatcattttttcatgtgtcttttggctgcataaatgtcttcttttgagaagtgtctgttcatatcctttgcctactttttggtggggttgttttttttttcttgtaaatttgagttattgtagattctggatattagccctttgtcagatgagtagattgcaaaaattttctcccattctgtaggttgcctgttcactctgatggtgatttcttttgctgtgcagaagctctttagtttaattagatcccatttgtcaattttggcttttgttgccattgcttttggtgttctgaacatgaagtccttgcccatgcctatgtcctgaatggtattgcctaggttttcttctagggtttttatggtttttaggtctaacatttaagtctttaatccatcttgaattaatttttgtgtaaggtataaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctattacattggtctatttctctgttttggtaccagtaccatgctgttttggttactgtagccttgtagtatagtttgaagtcaggtagcatgatgcctccagatttgttcttttggcataggattgtcttttggttccatacgaactttaaagtagttttttccaattctgtgaagaaagtcattggtagcttgatggggatggcattgaatctataaattaccttgggcagtacgaccattttcatgatgttgattcttcctatccatgagcatggaatgttcttccattagtttttgtcctcttttatttctttgagtagtggtttgtagtttttcttgaagaggtccttcacatcccttgtaagttggattcctaggtattttattctctttgaagcaattgtgaataggagttcactcatgatttggctctctgttagtctgttattggtgtataagcatgcttgtgatttttgcacattgattttgtatcctgagactttgctgaagttgcttatcagcttaaggagattttcggctgagatgatggggttttcttttttttttttttaattgagacagagtcttgctctgtcgcccaggctggagggcagtggcgagatctcggctcactccaagctccgcctcccaggttcatgctattctcctgcctcagcctctccagtagctgggactacaggcacctgccaccactctggctaattttttgtatttttagtagagacagggtttcaccatgttagccaaggtggtctccatttcctgacctcgggatctgcccgccttggtctcccaaagtgctgggattacaggcatgagcaactgtgcctggccggggttttctaaatatacaatcatgtcatctgcaaacaggaacaatttgacttcctcttttcctaattgaataccctttatttctttctcctgcctgattgccctggccagaacttccaacactatgttgaataggagtggtgagagagggtatccctatcttgtgccagttttcaaagggaatgcttccagtttttgcccattcagtatgatattggctgtgggtttgtcataaatagctcttatgattttgatatacatcccgtcaatacctaatttatcgagagtttttagcatgaagggctgttgaattttgtcaaaggccttttctgcatctattgagataatcatgtggtttgtgtctttggttctgtttatatgctggattacgtttattgatttgcgtatgttgaaccagctttgcatcccagggatgaagcccacttgatcatgggggataagacttttgatgtgctgctggattcggtttgccagtattttattgaggatttttgcatcaatgttcatcagggatattgacctaaaattctctttttttgttgtgtctctgtcaggctttggtatcaggatgatgctggcctcataaaatgagttagggaggaatacctctttttctattgcttagaatagtttcagaaggaatggtaccagctcctccttgtacctctggtagaattcggctgtgaatccatctggtcctggacttttttgggttggtaagctatgaattattgcctcaatttcagagcctgttattggtctattcagagattcaacttcttctggtttagtcttgagggggtgtatgtgtccaggaatttatccatttcttctagattttctagtttattttcatagagttgtttgtagtattctctgatggtagtttgtatttctgtgggatcggtggtgatatcccctttatcattttttattgtgtctatttgattcttctctcttcttctttattagtcttgctagcagtatatcaattttgttgatgttttcaaaaaaccatctcctgcattcattgattttttgaagggttttttgtgtctctatttccttcagttctgctctgatcttagttatttcttgccttctgccagcttttgaacgtgtttgctcttgcttctctcgttattttaattgtgatgttagggtgtcaattttagatctttcctgctttctcttgtgggcatttagtgctataagtttccctttacacactgctttaaatgtgtcccagagattctggtatgttgtgtctttgttctcattggtttcaaagaacatctttatttctgccttcattttgttatgtacccagtagtcattcaggagcaggttgttcagtttccatgtagtagagaggttttgagtgagtttcttaatcctgatttctagtttgattgcactgtggtctgagagacagtttgttataatttctgttcttttacatttgctgaggagagctttacttccaactctgtggtcaattttggaataagtgtgatatggtgctgagaagaatgtatattctgttgatttggggtggagagttctgtagatgtctattaggtccacttggtgcagagctgagttcaattgctggatatccttgttaactttctgtctcgttgatctgtctaatgttgacagtggggtgttaatgtcttccattattattgtgtgggagtctaagtctctttgtaggtctgtaaggatttgctttatgaatctgggtgctcctgtattgggtgcatatatgtttaggatagttagctcttcttgttgaattgatccctttaccattatgtaatagccttctttgtctcttttgatctttgtaggtttaaagtctgttttatcagagactaggattgcaacccctgcctttttttgttttccatttgcttggtagatcttcctccatccctttattttgagcctatgtgtgtctctgcatgtgagatgggtctcctgaatgcagcacactgatgggtcttgactctttgtccgatttgccagtctgtgtcttttaattggagcatttagcccatttacatttaaggttaatattgttatgtgtgaatttgatcctgtcattatgatgttagctggtgattttgcttgttagttgatgcagtttcttcctagcatcgatggtctttacaatttggcatgtttttgcagtggctgataccggttgttcctttccatgtatagtgcttccttcaggagctcttttagggcaggcctggtggtgacaaaatctctcagcatttgcttgtctgtaaaggattttatttctccttcacttatgaagcttagtttggctggatatgaaattctgggttgaaaattattttctttaaaaatgttgaatattggccccccactctcttctggattgtagagtttctgccaagagattcactgttagtctaatgggcttccctttgtggttaacctgacctttctctctggctgcccttaacattttttccttcatttcaactttggtgaatctgacaattatgtgtcttggagttactcttctcgaggagtatctttgtggcattctctatatttcctgaatttgaatgttgccctgtcttgctagattggggaagttctcctggataatatcctgcagagtgttttccaacttggttccattctccctgtcacttccaggtacaccaatcagatgtcgatttggtcttttcacatagtcttatatttcttggaggctttgctcatttcttttgattcatttttctctgaacttctcttctctcttcatttcattcatttgatcttcaatcactgataccctttcttccagttgattgaatcggctactgaaacgtgtgcattcatcacgtagttctcgtgccatggtttttagctgcatcaggtcatttaaggacttctctacactggttattctagttagccattcgtctaatcttttttcaagtttttagcttctttgcaatgggtttgaacttcctcctttagctcggagaagtttgatcatctgaagccttcttctctcagctcttcaaagtcattctccgtccagctttgctctgttgctggcgaggagctgcgttcctttggagggggagaggcgctctgatttttagaattttcagcttttctgctctgtttttcccatctctgtggttttatctaccttcgatctttgatgatggtaatgtacaggtggtgttttgctgtggatgtcctttctgtttgttagttttccttctaacagtcaggaccctcagctgcaggtcggttggagtttgctggaggtccactccagactctgtttgccttggtatcagcagtggaggctgcagagcagcgaatattgctgaacagcaaaggttgctgcctgatcgttcccctggaagcttcgtctcagagggttacctggccatgtgaggtgtcagtctgcccctactggggggtgcctcccagttaggctactcggggatcagggacccacttgaggaggcagtctgtccgttctcagatctcaaactccatggttggagaaccactactctcttcaaagctgttagacagggacatttatgtctgcagaggtttcttctgccttttgtttggctatgccctgcccccagaggtggagtctacagaggcaggcaggcctccttgagctgccttgggctccacccagttcgagcttcctggctgctttgtttaccttgtcaagcctcagcaattgtgggcgcccctcccccagcctcactgccaccttacagtttgatctcagactgctgtgctagcaatgagcaaggctccgtgagcgtgggaccctccaagccaggcgcaggatataatctcctggtgtgccgtttgctaagacctttggaaaagtgcagcgttagggtgggagtgacccgattttccaggtgccatccatcaccgcttcccttggctaggaaagggaattccctgaccccttgcacttcccaggtgaggggatgcctcgccctgcttcggctcatgcttggtgggctgcacccactgttctgcccccactgtccgacaagccccagttagatgaacccagtacctcagttggaaatgcagaaatcacccatcttctgcattgctcacgctgggagctgtagactggacctattcctatttggccatcttggaaccgccaccgcccctcccccggctttatttatttattttttgagatggagtcttgctctgttgcccagactggagtgcagtggtgctgtcttggctcactgcaacccctgcttcccaggttcaagcatttctcgtgcctcagcctcctgagtcactgggattacaggtgtgcaccaccacacctggctaattttttaatttttagtagagacagggttttgccatgttggccaggctgctcttgagctcctgacctcaagtgatccacccacctccacctcccaaagtgctgggattacaggtgtgagccaccctgcctggccctattatgtagttttaataagacctaactgtatattaatagaatttttggacagtgacaaaatttgtatttttgatattttccttcagattaccatttctaaattgtttctacaaattgagtatcagcatttcaaggttttattttattttgttttattttattttattttaattttggtagctataaataccatttactgataatgatgtccttacaactaagggaacttagaaaaattactgtagccctcactaaccagtttttactgtagcagtgtggctagaattctaaaaattgttatgtaaatagagttggtctgtgatacatttcattctccttttcctcttgctgcacctcagatgttctattagaaggtaagctctatgcagggcacctagaaggcactccagaattatttgttgcatgaatgcatgaacagatgaacagatactcactgtcctttgagtcagtttcacatggcgatcctccctcttgtgctccagtggcccccggcctccagttttacatagcattgtattccccacgtctccatctactaacaaaatggcagccagttatctaatacactagtttgtgtaaacctgttatgtccaatggggaacctatcaaaaatgtgttagtaaggggtttctatattagccttatggtaagcattcagtaaatgctagttgttattattgtcatcatcttcatcatcaccaccatccaatatattcccctataacgactggttttcagattttcttccaaaggatcattaggactctcagaattttctcaggtgatagtgaaagtttggtggggtttggggaaaagtggtgggagggagggacagatatggagagataatgaagctgcactcccctcatggttttccttacctcttttgccaaataagctgtgcctttatttgttttatatatttgtatttcgggtaaattttattttcaaaaggattctactgcttaattttgtttttcgaaagaaacactgtaagcaatgtgctgggtgctagagagtacaagatgaatatagctcttttcttgtaaatgcacagatgacagtgacaaggaaaagaagagaaaaatcactgaccacatttcagagtgtattcttaagcagataatttgtacagtccttaaaatgaatgtgctgctgtctggaagccagcatatccaacagtgcacatgtcatgacatgtcaaagcaacctcagcatcctttgtaacagagctgctaggttagtggatagggtggggctggatcacttaccagctatttgacctggaacagtcacttgagtgctgtgggcgtcagtgtcctcagctgtaaaacgtcaaaagtaaaacaaccccataaagttacttaaataaaactttttttaaacacaaaatgcctagtatacctgtaagcctcaaacatgcatatacactgtatctatttactttatagaaagtatttgatgacatcagcagggcatttcacaaaccaacttcgtaatagccttacaacgaagatgggtaggtagatttgtaattagctaaccatctttcccggactgataggtactcaggaattgcttttatcctaaagacagatcccatattgtaatggaaaaaacatagctctggattcagagaaactttatttaaagaccaagctctgtcatttaccagaccattgagccagttactcagttgtttaagtctcacttagtattgtttatttcctcagttataaactaggtgatcacaaggggttttgtgagaattaaattatgggaaacagtaagtgtgaggtactaatcaaggtgcttcacatatggtagatgctcaagaaactttccttctttcagtctggtggggtgccataaacaaaaacctgaagcaaatgtcctagaattttgaatgacacagaacaaaagatgattgaaagaataatgagtgataagcatgacatttcaaaaccaaaatgtttattttgacagaccaaggtagtggctgaaatgtataaaatggtatttgacagaataatgttaatttttacattcaaaaagggaatatatatataacatttattgatattatatatatttatttatatgtgtaaaacaaaacttctaaacatacttgaagagtcttgaggtacttaacctggagaattctgtggggaggcagaatagctgtattcacattatagaatcatagaaccttggagtttgaaagattgttatgtgccagtgtgagtataaatgtgtggtcttgttcccaagtaaagaatcctaacatgaacatgagaagcgtggggtaagcatatcatttcactataaggctatctttttaacaattagatacatttcacagtaaagtagtgtgtgtgtgtgtgtgtgtgagagagagatagacatgatttgaataaatatgttggatattactgatcaagttgtagagattcttgtgtcagaggtggctaaggtacaaaggtccatgggatttagaggtgggggagatgtcacatttcacctgatttggcaactcctgaataaaactttggaaaatgtcttgaactcccctgttgcaaatattctttgcaccctttcacagaaagaagactaaatgggccgggcacggtggctcaagcctgtaatcccagcactgtgggaggccaaggcgggcggatcacgaggtcaggagatcgagaccatcctggctaacatggtgaaaccccatctgtactaaaaatacaaaaaattagccagcgtggtggcaggtgcctgtagtcccagctactggggaggctgaggcaggagaatggcatcaacccgggaggcggagcttgcagtgagctgagattgtgccactgcagtccagcctgggcgacagagcaggactccatctcaaaaaaaaaaaaaaaaaaaaaaaaaaaagaaagaaagactaaatgaaagtgaattagcaatcagtatgtgaaatattgtagccaagtcttttcaaggaattcctgaatagatgagacattaagcaagttaatttctaagttcatgtctaattaattctctgatagcctacctgtataagtaagtcaacacgatgtgcatatagaaatcagtaagattaatactggatgtctccaagtataaattcagaatatattgataacattggatattatcctgtttctaaaatgtgtattttagaggaggaggaatttcaggaacttcctgtataaggaagaaaatttaagttccaatggttattttagccccaattcaattcaattattagttgaataacagccaaagtgatttggtgatgtatatgacttacaagaatcaagaataaatcatttttctatgcttattctagtgttacttaatttactgtgaacagggctgtatttaatctttcttatttgagtggcatacacaagcaagaaaacttggtgagtcatttgaataatctggctggtgtaactgtgaatattcttgggaatgatggaaaggttaaatgctttgaaacacgtgtattctgaggggagcactgagctgctgctctctagtttcactgagagcagaacttgggccagaagtactagctgtgttttatagagcttaatacactcccatttcaaggtgattgccagttattatgtgatcatgagaagatagactttaatttcagggagcattagcgtcatcagcaacaagcctttttgcatgtggtgtaccaggtgctgcataaaatatgttaaactcgcattccacttgctctctacacacgacgttaagagtgagacagactattttagatataagcaactctgaagggtaaagtgactaataacagcagctgagtcacggcttacacttgtataccatgttctagtttacaaagctcttaagagagcagaacattcctacctgtaggtgatagattctgtgaggcagaaatgtttctggtaccagtttccttgaagggaattgagtctatttttattgaagaatcataagatgcagcttaaaagatgtggtcacagaagtgtaccccaaccagagaggaaattccaactggaaataaggagctagaccattttggtgagttttgatgtggaaagggcttgaggaagatcaaggtacaggatacatggaagatttaatgaagcatacaatgtggaaagaaggagacgtacacaattacggcttgaaatgcagtctgccaagtttattcaggtgtccagtgcgttatcagtagtggaaaaaacaacccacatttccttgcttgaatacttgtttttccctcataccctagtcctttcgttactctggacagagagtacatgactctcctttttgattataagactttgcatcttttatccctgttgttttccaactctcttcctacttagatctagaataacattctgtcttctatttactacatttgcatctttaagaaaaacagtacttactggtttttgaaaagtaccatactcttcaaaaagtgttgtgaataatatcacttgtattagactactgagtcatttattttatatgatacattgtggtgagatactgtctttgttttatgtctccattgcttactttactgctgtcccagacagatgtataggggaagcttttaaattaaatatagaattataaatgcagatgcatatgtcatgtatatgcatgcctattgtcagttgacttatgtatattcagccatttgattgttaggtgcttatatatggagattctgtctttgatgcctttttaacactctacagcatcaacatcactcctttcttgattttcagtaaatattattagggagcaagcaatgtgtaaaacactggaaagggaaatcagtgcggagctgtagcaccatcactaagcttggcttagcactcagcttaagtcagtttttttttttttttctaagagaaataggttgtaatttctcctcatcatctatcttgtttatgttaagtgccgtttaccttagggaataatttctctaaagtgagaaagtcagagttacattttgactccttacttttttttttttttgagacagagtcttgctctgttgcccaggctggagtgcagtggtgcgatctcggctcactgcaacgtccgcctcccaggttcaagcgattctcctgcctcagcctcccgagtagctgggactacaggtgcatgccgccacatctggctaattttttgtattttagtagagatggggtttcaccgtgttgcccaggctggtctcgaatttctgagcttagacaatctgcccgcctcggcctcccaaaatgctaggattacaggcatgagccactgcacccggccttgactccttactgttaaaggaactttaaaaaacagttggcaaatgtatggttagattgaacctggatagaatcagcgtccttctatgtactttactcacattgttgagctatgttagcacattaacaaatgaggtttatctcttcgaaaggtgacatggaagtattgggtgtggcttatgtaattactgtctaaacttttgaaaacctagcttggacccttaactgaaaattttgacgtattggttgtgagccttgcttacagaatgcctcagaataaacttggaacttgaaggtcagtgtagaaactcattgtcaattcagtgtggagaagcttacatagcacctccgcagccaggtctggctcacattagtgctactagagcctcagccttgtgagtgctgcagcttcttgtcagagaggaaggaaactgaagtgcagagagacagagtatacagatgacaaggcaagccttcagaccgcatggaggacttagagatgcttgagagaaaactagagagtcttgaaatataagcttcagtgtaaacatccccaaagaccaagtggatgaaattgaaggaaaagatgaggaacttggaagaggtagacagacaaatttgaaacaagtgtttctgtgactggaggagcaagcataaagtggtttaaaagcattgctgaggaagccagatatgtcaaaatcagagtttcttgacagaggacttaaagctgggggcagtggggagagtatttttaaaaccagaaggaagttgcactcatcaccctattgagagtattcagcacctatattattgcagtggttgcacatgtgtatgacatcaagatcgttccctccccttcccaccctccagccctcagtgatgggaggaattccgaataggtttgaaaacaagtgcgtgagttggaacttcaaactcaaacagacacactggggacaagaaaccacagagacagttaagcagaaagagggtgatgaagtgaaaacccccactgagtggtcagtaactgcagtagctgaacctgtcaactcctcatggagtaggagtcaagtatttctatggttaaagaataccagaggtcaagtgaagagaatctgtagaagaacaagggtggatgaatgggaataaatatttttgaaatgctttaagtagtaagtaatttgagtattggaattcgaagtaaatgtgttagcagatagaacataatactgtgaacagagaaaggaaaatcctgtgagcatagaattaggaatcattgcattagaaatctcaagtaatgtgtggattgtatgtgtgtatagggctaaaataagaacaagtggcatatttccttatcaattcacacttaaaagcatgtaaaaggtaattcatattcctaggataaaataatacaactttagatgttggctgtattggaaattatatagatgattatgtatctgtatgaacaaaactgattttgaattcgtttattctctctaaagaaacttactattctctgcacatcacttcattttggctgacaataagtccaactcagtcagtgcactgctgtggaatgttttaaactgaaatgtgcattggaatctgtttgtttacagcagatgatttgactaagctttgatgcgcagtcactctctgacatttgtgtatttcagcagtgaacaatgtaaactcattttctgagcactttgattgcttgcacatagcagtgcccatggcatgtgacagagaagagcactctctccactaatcagatagatatgcttcaagcgtatttacacaaaataatgaaaacagctgttagatacctttaaacttgagtgtgttttgttattaatctactagcctgtacacatgacactataattcttcactcactcaagttgcctttaatgacacagtaataaaactgagagggatgaaagtaatggaattgtagaatgtaatgcctcaattgttctacagtgtcttcctttttgccaaaataaaccacaattaggtccatatggtgttttgaagttttcaagcaatgaccctaataaaaagtaatgaatttctgacaaaagaaagcgtggctctcttttaagtggatatcttcactattgatctagatatgattgtagaccaatatgctaatagaagaaaaaggattcagtgtgcttagtacaagtactttcatttgtggtttgttttactcataagaaattcaaattttaaaggtagaaatattataatccattagttatgactcctctgttcaaaagatctgttatttaaagcaaagaaatattcttcaagaatgggaaattttacaaacatctataataatggagtttgtcacaaagaaagggctgagagagtttgttttagagagtatcttgttcttgtgtagattgagcttttgaggttctggttttgcttgtataagatttttatgtatttcagactgcttcaagggagagtgacattttattccaagtacttctaccacattctgaaacttgtgtatgtaacacaagttatttggttggagattggtttaaaaatatcagagtaggcaaaatccttagactatctttaatattaataaagcattataggtagcctagaatcttgaaaatagattaaattagaaaaaccataaaaccgagcaatagattgatttcataattgcaatgctggcggaagtgggagggaaagaaattaaaaggaaaatatataaggaatcagatttaagatctttttaaccaggaatacctagatttgaatctatgctcaaaagcataccagcgttttccctctgggtattatacctaatttttctgagtcttgatttcctcattttcaagagataggagttatgacaaggattaaaatgatgtcatgatgcatctaacagattgtgtggcaggtgctaggcactcaataaatatggtttaactttattattgtttattattattgagaccaacctcctaaagtagctcattagaatgacttagagtgtgctgtgtgtgagaatataggtgtgcaaataagtatgtgttgaattcagttagacaattcagtgcatacttacagagtccctactatgtgccaagaatgttcatggtattataaaaaatgcaatactaaataaaattctgttttaagaatttctaatgtaatggacatataaaagtgagactgggcaagacaagtgtagagaaacaaacaagtttcattggaaatataggagaaggtgaaaataattcaccctgagtaggacatgggaaagctagatagggaaggataggggagaatgacaagcatctgaagtaaaggggctggggcttttaaaaaggagtttaacttttgggagtatggaaggtagtgttgtgggagagtggggaaagccacatgcacagcatcattggatgactgttgtgctgtgtcatactaggtgctaggtttacaaagtgaataagatgtgatcctgtcctcaagggtaaaaaatttccaccaaaatattatgagaacgagactgccccactatgtctcatgcacccagttcatcttgccaaggggcaactttgactcttaaaattatgaataattcattgacattctgtttgctgttcatttgtttcgatatatactttgggttaatatggtgaatgatatggtttggctgtgtgtccccacccaaatctcaccttgaactgtaatctccataatcttcacatgtcaagggcaggaccaggtgaagatcattgaatcacgggggtggtttcactcatgctgttcttgtgataatgagtgagtttcatgagatctgatggttatatatgtgtctggtatttcccctgcttgcacttattctccctcctgctgtgctgtgaagaagtgccttctgccatgattataagtttcctgaggcctccccggttaagtggaactgtgagtcaattaaacctcttcttaaaagaaattactcagtcttggatatttcttcgtagcagtatgagaacggactaataccagtgagtgaatgaatgacaaatatatttgcttagtattttcccattttaatgtaaataccgagaagataaatttcaacctattatcaggctacattatctgaaattccaaattagttaactgaatttgtaatgtttaattgtttgattattgatcaaaaagtatttccttacttgcaaagctcttctcacttctctaatattttcttaatctgttttttgaaaaactaaaccaaaatcacatcttgacatttaatgcgcagtttattgtataattgatcaaaagttaccattgtacagtcccgatgtttcttaactcattgagatatgaattacaacgtagatcatcaccatttcttactaacattttaggatattttgagagattatggctctacacttgaaatgggaaacatcctttaaaccttgtttggagattggtcatgccttctcaaataagataattacattgcattctaaaataatatcctgcttataaatgtgtatatatattcaccatttcaaagattagtagagtgtaggttgtgtaccaagcactgggtagggtactggatataaaggatggacagtaacacacacaccaacatatccacataaatattgcttcccttagagcaatccactgactttcttcatccatgataacaactcccctgacccttctgcagctcttgtttactaactactttcaggtccatgtaacttatttttatgtcagtagttattagcagaactttgttctttaaaaagtatatttaattttgagaattagccaaatataccatgtgtagccaagttttggattctgaaggacaggatattctacgattataatacagtcgtatgatttgtttgtttgtttgttttttaactttagttattacttggttgcacttaacttggtagtgaagcccattttggaaacaataagaacaccaattcccaagatgattgattgctttgcaaatgtcagcccttcatggggtatacaccttcaagtttgctacctttttaaaaaagttcatttgattttaaaaatttgctactcttttatgtcacagcaggtgtattcatgtcaagagtatttgtgggtatctcggctttagccaggcagttccctttgctgctcttgattgtatgcattattccttcatcttagaactttagaactctttctaaagtaatcatatagataaaaatcatctctgaaaacacgagatttcagagtcctgtaaatccattatgaccagcatgctttctcatcaatctcttcatgttgtctagtgttgaatgtgttaaagaaaaatgcggtcatgtaattttttccaccatataaataacttgatttttttccttgctgtcccaaataatttttcttcactttatgtccaatagctactagaataggactttcatatgttgtttattcctggtggttttccccagatactcagtgtttcctacacacacacacacacacacacacacacacacacacacaccccaaaagtttatttattcaacttgtcttttatttatagatagtgttctttaagtaccataaagccctatgatatataatatgtttgtgataagaatttgtatgacctatgagtggctaaaattaggatcttgtggcagatatgggttttggttaggaaactactacctcaagatcacttagactcccttctccttccccagtatatggttagttgtgtgaaaaataacttgtactctcaacttttctgtttttccaacagttcaaaatgactaaaactattgcttttgttaacctcatacaatgtaaaaccacattcttttgttagattatgtttttaacagctttattgaggtaaattggtagacagtaaactacatataagatgtacagttttggccaggcgtggtggctcatgcctgtaatcccagcactttgggaggccgaggtgggcggatcacaaggtcaggagatcaagaccatcctggttaacacagtgaaaccctgtctctactaaaagtacaaaaaattagccaggcacggtggtgggcgcctgtagtcccagctacttgagaggctgaggcaggagaatggcgtgaacctgggaggcggagcttgcagtgagccgagatcatgccactgcactccagcctgggtgacagagtaagactctgtctcagaaaaaaaaaaaaaagatgtacaattttataaatgttgacgtatgtatacacctgtgtaaccatcaccacagacaagataatgaacatatccatcactctaaaagcttccttatgattcctgtaattgttctccatcaatcctcacttccctacttctatcccaattcacattctctggcactgctgataagctttctgtcactatcagttagttttttttatatataacttcatctaaacaaaaacatatagtatgcacttctttttatctgacttctttcactcagcataattattttagatccagttttgtttggtgtctaatagtccattcttttttttattgctgattagtatgtcgttgtatggatataccacaatttgtttatccacgtgttgatgagcatttgagtcagttttagtttttaaatattaccaattaagttactgtgaacatttgcatgcaagtctttgtatggtcataatgccttcattccccttgggtaaatacctaggagtggaatagcgggatcatatggtagatttgtgtctttattttttaaataaatcaccaaagtctgccaaagcagttctattactttgcattcccacctgcagtacatgagagttctagtttctccacatcctcaccagcacttgataaggtcaatcttttctaattttagatagatgtgtataacattttcctctattctttgccttgtctttaatagtaccttttgaagaaaataagttcttaattctgatgaagttcaattcattcattcattttattttatacatcacattattgtatctgagtaacctttatataacccaaggccatacacattttctcccaggtttttcctagatgttttacatttagattttcacaatttagaattaggttttacatttagatttaggttttacaatttagaattaggttttacatttagatttatgatccattttgaattcatttttatatatggtgggaggtatgaatccaaatttttttttttaacatatagatatccaattgttccagcaccatatgttggaacaaaactatattttctcaggctagtcgcctctacttaattacctttagaactttgttgaaaatcaatggagtgtgtgtgtgtgtgtctgtttctcaactctttattctgttccgttgatctatttgtcttttttgatgtcaatactacactgatgatgattattctagttataataagtcttgaaggcaggtagtgtgagtcccccaaattttttctttttaactttgctttggctattctaagttctttgcatttccagctgaattttagaataaggttgtcagtttcctaggggaaaaaaaagccctctgagattttgaatgggattggtttgaaatggtaactcaattgaagagacacgacgtattaacagtattgaatcttctgatccatgaatatactatatatttccattaacatatacatcaatatatacaaaagatgtataagatatatttaatacatcttttgtttgatgtatacttcaatatttacctttttttgatgctgttatggtttcctttgatactttcagtttctgactgttccttgcccggacagggaaatacaattaacttttatatttttatcttgtatccatcagtttcgcatttttaaagtaacttaaaaataacttttttttgtagattttatcagattttctacatagttaataatgtcatgccaaaatagaaatagttttacttcttcctttccaatatcaatgccttttatttattttaattttcttattacatggggtaattcctctagtatcacgttgaatagaaatagtaagagcagacgtttttgccttttcctgattttagagggaaagcatttagtctttcactgttaagcatgacattagggcttagatttttcttatgtgtcccttaccggattgaggaaattcccttttatgcctagtgcactgagagttttatcaggagtggatattggatgtcatcaaatccttttttttgcatctagagataatcttacctttgcttgtttgtttctctattagatggtgatgatggtggattacatcgattgcttttttaatgttaactatcctttcattcccgaaataagtcacacttggacatatattttttaaattttttatttgtacaaatttacggggtatatgtgaaattttgttacatgtatatactgcgtagtgatcaagtcattgtatttagtgtgtccatgaactgactacagtatattcttgttaagtatatagccctactctggtttcaaacattgaatttattccttctatcttaccatatgtttgtactctgtaacccacttctgttcatcctcccctctcccccactctcccttcccagtctttgttatctttcaactgtccacctccatgtgatcaaactttttacttcccacatataagtaaaaacatgcaatatttgtctttttgtgcctggagagagacctccagttccatgtatgttgttgcaaatgacatattctttttttatgaccaaatagtatctcattgtgaatatacaccacattttctttatatattcatctcttgatgaacacttaagttgactccgtatctttgccatggtgaagtagtgctgcaataaacctgccagtacagttattgctttgatattgagtttttactctaggtagatacctagtagtgggaatgctcaattaaatggtaattctatgtttagttttttgagaaatctccatagggctttctttagtggctgtactagtttacattcctaccaatagtgtataggagttcccttttctctgcttccttgccaacttcacttattttttgtctttttaataatagccattctgactggggtaggtagctttttgcattcctctgatgcttgatgatgttcatcatttttcacatacctgttgacctgttgcatgtcttcttttgagaaatgtctactcatgtcctttgcctactttttaataggattattacttttttcctgttgagttgcttgagttccttgtatattctggatattagtctcctgtcagatgaataggttgcagatattttctctcattcaacaggttgtctcttcacactgttgaatatttcttttgctgtgtagaagttttttagtttaagtaagtcctatttttgttttaattgcttgtgctttttaggtcttagccataaatttttgccttggccagtgtccaggagagtttttcctaggcttactcctaatatttttatagtttcaggtcttatgtttaaatctttaatccattttgtcttgatttttgtgtatgttgagagatagtcatctagttttatttttctgcctgtagctatccagttttctcagcatcatttattgaagagaatgtcctttccccaatgtaagttcttgtcagctttgttgaagaccagttggctatgaatatgtggctttatttctgggttctcaattctattccattgatctatatgccaatttttataccaataccatgctgttctgtttactgtagacttgtaatatgtattgaaatcagatagtgtgatgccaccagctttattgtttttgcctaggaatgttttggctatttaggctcttttttagttccatataaatttagaattgttttttctaattctgtgaagaatgacattggtatttggatagggattgcatttaatatgtagactgctttgggctatgtggtcattttatcaatattaattcttccaatccataagtgtgggatgtttttccatctgtctgttttatcttcacacctcttttatcagtgttttgtagttatccttgtagagatctttcacttccttggtcaaatagttaaatttattcttagggttttttgtttgtttgtttgtttttgtagcagttataaatgggattgctttcttgattttttttcttggctagataattcttggtgtaaagaaagactactaattttggtacattgattttgtgtcctgcaactttactgaattcatttatctaatagaggtttttggtaaagtctttaggttttctacacataagatcatatcagcaaagagggacaatttcactgcctctttctggtttggatgccttttattttttcctattgtctgactgctctggctggaacttccaggactagtactatgttgaataagaatggagaaattgggtgtccttgtcttgttccagttattaaaggaaaggctttctttcagcttttctctattcactatgaagtgagctgtggatttgttgtatatgactttattattttgggggtatgtcccttctatgcctagattggtgagtttttataatgaaaggactttgaattttattaaatgtatcttctgcgtctgtcgaggtgattatatagttttttgttgttgttgatgtgatatatgatgtttattgatttctggtataaatccttcttgattgtataaatccttcttgaaggtataaatcctttttgatgtgctgttggattcagtttgctagtattttgttgaggatttttgcatctatctgtgttcatcagggatattgtcctgtagtttttttgttgttgtcattgtgtctttgtctggttttggtatcatggggatgctggcctcatagaatgagttaggaagtttcctttctcttcagttttgtggaagagtttgtatagaattgttattatttatcccttaaatgtttgatagaattaacagttaaactatctaggcctaatgatttatttgtgggaatgtttttaactacaaactaattttgaatattggatattcaagtgttgcttgctgagtaagctttgagttggtttttctcaagaaatttgtctacttcatttcagtcattacatttatggaaagctgttcatagtatttcctcattgtcctttagtttgttttgcatttgaggttataatgactcattcttgatactcataatttggtacttctctcttttttactactcatactcagtaaaattttatcaattttattgatcttattaaagaaccagcttttatgttataaggttactgttgtcacttaatgatttaaatgataggatctcaaattaggatggtttattagaacaaatagaaatgaaagtgatctggtgcttcctggagagcacagacacagggagattctgggaatcagggaattttcccatagatatagtgtctgggtagataaaaggactccaaaaaggagaaaaggaacaaatgaggaaccaagaagcattctttctattccaccatttgaatgactgttcccacagtgtttgaatccagtcttatcttgatgtttgataatctgaacaacaaattatttcagtaaagaaaatgtatgaataaatttcaaatcctattttatccagctgacttctttactcaaaatgagcctcgtagtagtttggaaactttgagtttttcttggaagtcagtatggtaaggtaaaattgggcctttgaaatgagagggttcttaatttaaacccaagaattatggctgtcaggcaacttactcagcttcactgaatcaaggtccttacctgtaaaatggaaatatcaatactcatattgtgagaatttgaatgaagtagcatacataaaattattgagggtgggaatggtgtctcacacttgtaatcacgacacttgccaaggcgggaagattacttgagccccagagttcgagaccagcctgagtaacacagcgagaccctatctcaaaaaataaaacattaaaaaattattggtacatagtagactctcatccaattccagctacatctccattaccactcaccctgtcattcctactccctggctgccctgtactcaaaatgctaagagcaaaatgttagccagtggcaggagaagcaaagagaactaggagctctttaacctcagctctgctatagttctttttttaacagcaagaaaaccaataaacttgcatgcctgttgaggtgatttttagcaaaaatatatagagttatggggcctttgtaaatgtatgtgatgctcagtcaataaataatatatagtagagccacaaattatgttggaaattaggttctcaagtcaatgaatttgagttggaaatctcatggtattaaattacttgtgaaaacccccattggaaggtactgaaatggagacttcttaggtccttttatctaatacatctcaaaaactagttgttttccttcagttttgaaattatttttctctgagcacctgaagatgtagctgtcttgagttaaaaactggtgtcatacaaaatttataagtgtgtctttaagtactaggctccgattcaaagcctcactgaataagaaacacctgagaactgagccattctggagcagtacctggttcacatccccctcatctcttgggtgtattggatgaaatggttggtggaagtgttctcactgtctagattctcaattttccctctagtaggacatgtatagttgaattacataacaagattataagctactccacttttggattctctgaacaaaagtgctgcttcttccttttcttaccctctaagctaagccttgaaggtcaaaataaaagctcacatctaccactctcccatttagcactcttgttgatgttactgactagcaaaagcacactattccaaagagcctggttgtgacttcagtctacttgtcatcccgtttgacaaggcatccagtaccaatgaatcttattatgctgcttacataataaaactgacttttagtgcatgtcctaggacagagttcggaaaactatggccaggggctggccacttgttttttgtaaataacattttattgaaacacagccacacccatttattttctgtaaatgctttcacactacaaagaaagagttgagtagttacaatacagaacctttgactcacaagtctaaaatatttataatctagttctttacagaaaaagtttgctgacccctgttctcagccttttaagctttagagcagaaactcaaagagcggtcaaatgttcatacaggtcaaaattcactaaggagattgtttaaaaatgtagattcctggaggctaccagggacccacttagtcaaaatctcttgggatggaacctgagaatctgaatgtttaacacatgttttaggtgatgtttaatgcacactaaagttttgcttccaatggcttagtgaaaagaaaaattgacctgaaagcaatactatgtataaatgtcatgtttaccacaaataaactagccttatgtcccatctagaaaatagagtgccaagagaagaaactttatgtttgcttttcttgtttaatgcttcaaattttttgtaagacaatatgttactgtcatgtaggaagttatcatttacttgggggagacataggatgtttgaagaacaattaaaaaggtgaattccagagaaatagttgtaaaatctgagaaggagatgacttttgcggacaagcatcatgggttctgattcattcctgagtcttgaactgtatttggtgagtcacaaccaacatttaggaggaataaaaacaaactattttaaatttttataaaataatgcataaatgtacatacatggtaagtgtctattttccagatccactgtgaggaattaaaggaattccataattctgtattggaagagccttcaaaactattgcttttacttcccaattttataagaagggaaactcagatgaaaaatagttaaacaatttgcttaaggtcacatggctaaccaaagcaaaagaaagatagcttaagagagctagcttctggatgatatcctggatataccagctggttgcccatgggctgaacctttctggttctcaggaatgttagaagatcaaagaatactggtcctcgtggcacatggcataagttggctttgaggtcagtgttgtttggacctttgactggaataagttctctctagttcacacaatttcccgctgctctattttgacccttgaattgttttgcgattctcttatagttgagaaatatttctcttcacatgtattattatcagaagtaaaaaataaaagcataacaagcagaccacatgtttattcaaaggtagaaattatatttctatgtgaaattgaaaaatatgcttatgagttttgtgttttaaaattgtttgaaataccacataagcttctctcttacttcagtcttttcactcattttgccttttgtgcctgtatagaaacttcgggctgggtgaggcgaggttccttgatgtatccagagtacacagctcaccagtggcggaaccatagcttccatcatctgatgtccacctgggataggcacaatgtcttcaatgttggaaaaagatttcagaatcatcattattatattgttggtagctctcctttatggatcactgcatacattttcatttaatccttcctatcctcctccagtaatatttcttcagttttacagctgagaaaattaaggctttgttctattgcataacaaactactccaaaattgagtgttcttaaacaattatatttttatacttcaggaattctgtgagtcaagaatttgggtaggactggctgagtgactcttccctgtggcactggcagtggtgactcagtgctcctcagctggtggatgaggaggtctggagagtcccagaggctcttcttacatggctggtccctcagcaggaatggctaaagtctaggcatagctgggactgttagccagaatacttttttacatgatggcttaagatcccaaagaaggtatttcaagagaggcagatggaagctgcgtggccttttctaaccaagccagtaggcaaccagtctttgggtccatgtccgcagaccacattcctagttgggtctgtggggataggtcttgccattcttgtcatttagtcaggttctgtgtgtagatccaagcctaaggcattattctacacttctttttacctagtgcttactttgtaaggcaactgccggcctctagagagggagagtgagaacttcccaccttctttgccaatccatacttagaaactccttaaaaaccaaaggcaaacatagctgtctccaacctgaggagtgtgatcatgtgcctgtgcatgtgtgtgtgtgtgtgtgtgcgtgtgtattttaattccttttagatgataacccctcaagcttgatgaatgtcatagaaaattcagataaaaatgttttgtgactaaaggttagatggcacagtctacagagcccgtgactgagagcaagaaacctgggttcagttccctactctgccacttccttgctatgtgacatcattggcaggtcaatttatctgagccttaatttcttcatctgtaacataagagggttatacaaaatcactgctaagggctatggtatatgtgcctataatcatcattttttttttaactatatgggtatgttcaacctttttgtacttctgctttactttctaccaccctgaaaccaagaaaatggtagagatagaggaaggattcagtgtggttagaaatcttaacaaaatggtatacacccccttccccccagtgctttgattttaatacagttcttcagagcaaatatttgctgatttacctaatggcagtgttagtattgctttttgtttactacctttctttgaatgacatcaggcttttggtagccaaatgttgtgctgggctaagaatgcatccacacgagcactgagctcccttatatgtttgctcttttttctttgtaagtcttcttccataaagaaatataatatcagcagaaggggctttttgttgtgttttaaaaatccatctttggctgagtgagtgactcacgcctgtaatcccagcattttgggaggccaaggcagtgatgggagggatcctaagcccaggagttcaagaccagcccaggcaacatggcaaaacctcgtccttacaaaaaattttctaaaaaattagcgaggtgtggtgatgtgagcctctagttccaggtactcgggaggctgaggtgggagaatcaccagagcctaggaagtcaaggctgcagtgagcccagattgtgccactgcactttagcctgggtgacaggagtgagactctgtcttaaaaaaaaatccatctttgaataacccctaaagtatgttaacagtatatacccgtaaatgatagtgataggctctctctggacctcttgaatccccagtcaagaataatgttgccacaatgacccaggcttctttcagagaaattgttttgcgaaggtatggagatgtgtgacaagaacagattcccaacagtagctgtctccctcctgttccccgcaggtcttccctcttccctttccctcctctttcctccccaccttcccttttcctttccccacttcgtccttcccttttccttcaaggtttattagggggaggagagaggtagaggctgagtatttccatagtgtacaagccctgtgaactgttctgtgtttttccctgaaggttttctccagcgctcctgtcagatttccctagtttcaacctaacccaacaaaatgcagctgtactcaagtcagctactgccttttccagaacttatttggacctttttgatgccctgccaaatcatacagttaactttggactcttgtggaagaaggagaaaaagttaagcaattgccacagaattaggtgttggaaaaagctttgtttccccacctatatttctgatttttgttcctttcccccttcccacgccttaccttatcttaaccctcaggacaacctctctagaaagctcaacttttccttcagtacccacctgaaagatggaagaaatgggaagaaatgcactcacagatactcccctctgcagattttacaaaagcctgacttgatagagaaggagactaaatgaatattaaacataattggcaatagtaagcagttaaaggtttttcaatagaggtattttttcttttaaagcaaaatatttagtaatttcagtaacttgaggctgcaaaatttgctaacaacaggcaatcccctgataaatatgaggttgtaaaattagagtaaatttgtttatatgtgggacaaaaatattttcagttgtaacagaaaattatttttgaaaaagaggtgatactgcttagtgtttgatccaacatgacaattttccttcaagattcttatgaaagtttctctgccagaatttcacacatatatattcagagataaatgtttttaaaaggaagagcttcctttaacagaatcacagcatcactttactcaaattaagtactggtgacttgcaaaaagtagtttttagtctatgttcacccacaaatctgaaatcagtatgcatttttatatatttttctccaaatagatttctttaattcagtgagcaacattttaatctgtgtgaggctttgattgttctattttgaaaccttacggagacataataacaatgctgataaagtatacatatggtttagttaacattgttatgttattactttaaaaatgaatatgatgttatatattgctgaagctccaggtaatagacagccatggtatatagctaatctgagagattgctcaggttctcagaggacagaattaatggatcttctttggagttatgcctcctaaaatacacttttaaactgtgcttaaacgcattcatggaaatacccctttcttaaaatgttaaggatgtcattctttccagaaatgtgtatttaattgtacactctaaaaatatagagacattttgcttgtgttttttcagtagaggagattgtttggtaattagagattattgttaaagaggcaaattattttgaaaatatacatttattgagaggagatctgggaatgtaaactagacagagaggttacatctaaaattgtgtattaccaatacagcagcagtttagtaaattggtatataaacaagcatctgttgcaggaatgtaagaatgacatcataaaggatgtatggaaaattttaattgagaaagagtgatgcacaattgaagcatgactttaagtctaaattgattttgccaacagagtaaaagtggaattcttttaaaacattccaataatgtaaagtatttaaaatgtaatgtcctgttaatgtacctaaaaattagactctaggtcatccaataagagtactgcttacagtaatacagtctatgtaatatgcaattatcttgaccatagttttatttttcaacaattttgtcataaaacagcagtaagatacaatgaacttgattcatttttttgtgtgaatcatttaataggccattacatctactatattagactccattctcctttcagagcttttcattataaggctgtctttaatggaaagaagtttaacctttcctcccagatagagtgaaccccataacagtgtaaacattctcattataaaataaaatccccttccccaagggcagtgctataattatgttgcagagcattgtaggaatgtttttcttcagaaatgctgtctcattcttgctctcaagtttttatcattttcaaacaatctataatatttttaaattatagtttaataaaatgcatatgatctagtttaacatattttgaagttattttaatcaactttgcaaagaaatcatcagtaaaattgctgttgatttataaataggataattagaggctttcctcctaagtactgttcactggcattgtggctgtttttattgcctagtcaaacctcttcattcaattttaaaattgccttttgaatgaactgcactatgtgcttgccaaataatgtcaccgttaatactttgcctcctctatttcattgtccagtctgcaaatgcacaataaattgtttgataagggggtcaatgaggtttgctagttttttaagtgaattataaccaaacagttcagattatgtcacactcttattgttatggtagagctgtgtttaaaagatagcagtacagtactttggttcactttgcactgttacatcaagaatatatcctgtacaaatcaggatagtgtggttcttcaacaaatcgccaatctttatatcgagaaaaaagaaaaatgccactttgagatgtatagacttcaccccttgggaagggggttgctgaaattgacaggttcttggtttgcagagacagcctggtttctatgtaaatgtgttagaacaaagatttaataggattatttcaagataatatttttatgaagatgccaaaggaagtattcattggaaggcctaaggactatatgttgttagtatgaaaatgctcagctggtcaatattatctgttccatagatagcaattatatttccctaggtgtgtggactcattggctatttactatgaattgtaagaggtggtttttctaccctttgacttgcagataaaatcataatgtctttttgggtttactttcatgagaaggaagttgagattttcttaaatgcatatctttctgcttatgcagaattgctgagtgtttttgagaaatttaaaaggcaaaagtaagaaactttgtgcttgttgcatctaaaagcaagtctgtttgtgtgtgtctctccctttgtaacagaaggaatgtttcttatgtttctgtcttcagacagttggcacacatttcatctcagcagctgctttctcttaaagtgcagtagagtgtaggactatagtgacaccagcattaatacttcacattctgctatcatatgctgtcactgggaaatatggatctaggttacatgtgtttgcagactttgtactgctgaattatgaaagctgactctgttggtggattgtgttgtattcagagactgtgaactgaacaataaatgaatgcagtaggctgtttagagtgctatagcatgctttcctttcagggactaattgagcctgagctttaaaatttaaagtgccaaattgtgctggaaaataccttaaaataaacattaaataatttttgtcaaatggcatttttatatgctatctttgactttaaaaattttttagatcctcattttttctactgttgcataaatccttgcacttcagatacgtaaaacaataagcatattgcagacgatcaaagaaaacttttttcccattcagataaaaatttgcaaagaaaatcattgttaaaattgcttactatggttgtaaaaattaaaataatgtttcagactttgtgtctttttataaacagtttaaaatacaacagccaggacagagctagtaagataacaatcattcttttgcctttgtgtctgagctatgcctacacacacaacacacaggcacatacatatatatttgtgtagatagacacaaccatacatatatattaattttttagttaatacaatttctgaaaaagcaattgctgatttataaacagaatgaggatagcacataggataatataatatcaaaataatagagcatgaaatgtgcacatgggagaaatgtttaggtaaaaacagatttatagatcagtatctggaggtatagataatggatgctaagtggctagtagcctgttataaaggatggatggtgagtattttcatgtcttttgcattttaccacagatgaaatttatgtggcttatttgtaagtttgatttgggtctatctaacttttggagtttaattgaaattttattgtaaactttgctttgcaatgtgcagaatgggtactgggacagagactttttctgacctatattttttcagttgaaaactgccttgggagtcattgtgtatcacaaaagccacccacttatttccatcttgccctacatggcactggtttgaagtagtgaaatacatttagtgaggtaacataaaggtctcaagttgtgaaagtgcaaatttgtaaatatataggattcttaatctctcttttttttttttttggctttttgaattctaagattcttagttttttaatctattgtttatattacctggtttttattttattttatttttgtagtttattatttttttttaatagaccgagtctcaccttgctgcccaggttggtcttgaactcctcggcccaagtgatcctcctgcctcagcatctcaaagtgctgggattagtggcctgagccactgtgcccggcctgtggttttgctatgtgagaaagaaaaaacttcctaccttgatagcacagtataaaacagtggttgtgacagtgctgctaacttgtataaagtttaggattatgattggttttaaattttataattcctgtttttctctttttctaagaattggtgtcaaaaaagatacacttttttccccaaagtaatgtgaaaaatttgcattgtcccgtgttgttttcacctattaagtgagcagactgtttgcctttacccagaggggttctgaacactctcgagtctgcagaaatcatgttggtagcctggaatgatattaataattttctgtctgtcctgtggcatcaatttatcattccatatgtccttaatgtgaccaggtatgtggcatttgcttgctctttttccttgtggaagtttatttctaagtgacccatttaaaaatcccttcagtttgggactgtgcacctcaggtgaacaccacttgcctatctcaagaaggcacagcctaggagtttgttttccagtgcagtgatttgtgtagtgccctgatgtggtgttcataaggcattctttcttttcttttttcttttgaggtggagtctcactctgttgcccagcctggagtgcagtggcgcaatcttggctcactgcaacctccacctcccaggttcaagcgattctcctgcctcagcctcccaagtagctgggactacaggcacgcgccaccacgcccagctaatttttgtatttttagtagagacggggtttcaccatgttggccaggatggtcttgatctcctgacctcgtgatccacccgcctcatcctcccaaagtgctgggattacaggcgtgagccactgcacccggcatacataagacattcaattgaacagtgcattatttgacagagcagttgcctatcatttatgttcaagaagtgcacacaatatattcaggactgacacaactgtccagtagcacttcatttctggttctgtctcaaatcactgctacctatggacatttggctatgtttgttgaaaagatgagctcttgccgaaaacagtactgtctgaggttggaaatctaaaatgctgctgttagctgattgcaaaaacataaaacacatcaacagttttggcagtagaattaaatgtgtgaatgaattgaataaaaggtgaaaacagcacttctctcttagccatggttctatgcaattggggccattaaacacagtttatagagtcctatcactacttctttgtaagggctacagtgacctcaagttccctttgtgtttctctttcttttccacaaacatctatattaaaaaaggaatccattaaataaaacttctgaaagtgccttataagatcaaaacacatccaaggagccaatacttgagaccttgaaaagaaattaaacattaaatttgggttattcccatgcttaattaaagtagaatgagttggatatagaagtatatcttgtcatgtaatcagaaaaagtgacgcttttaacatgtgagtgcgtgttacgacccagattagctatgtagcattctcttaaaaattcaccctttcttattctcgatttctcctaatatgtacacatgttctgacttcccatacatccagcatctttggtgacttcatttcccgtaaactttattacctttcacaagtttcatgtagaattttttctgcttagatgagtaaggtagaatcagtgagaaagctctagattgtaactatcaattataatactaattacaaaacttattccgtattgcttacctcctcaaaagttaattgcgctttccaacctcaaatgttggcaaaacttgagcttttcactctttgcaacatagcatatgtcaaaaatagctgtacttcaaggaggaaactaaggcagaagtgattggataatttagttgtgtcacagagagttaaacgtcttttttattgaggtaatgatcatcatttatgatggctggttctgtgctcatctgtagcctctgacacatttttggagaacattactaatactctggatataatctaaagtgtttgctatagtgaaaagatctccagcctggtggttggagttgcagcagtgttactaactgtctgcgtgtggtcaagcccctcatttaaccttttacggccttagtgtctgaatctgtaaaatgaaatcattgagctggattatatctcaagttcctctaagtttcaaaattctgtcattttatatttctaattagaagcttggctttatcacagttacgcaagattagaaaatatatgaagtccaaaagttattgtttatctttaatcatcccaagtagtaaagctcaaatatttttcagttttagaaaaatgatttttaaatgagcttggaaagtgctctgtgttctttagtttgcatagctagaacagaagagagaggaaagtagatttaataaaatcagtcacaggttaatatgatttttaacttttgcttttcaaaaaatcttcatgtaaattacatatttcagtgtgttattatgtaacattagttttgtaattagttatctgtagccaaaattaaaaataggtgtgacccctccttctcaaccctgctcctaaattcttaaaatcaatcatgtcagtattttaactcatgcaattttataattgtttatatttacattgaaataagagattcatatccccttttggctcataattcatcattgtgtggttggttgttcaacaaatcaaataggagcatgttctctttattgctatttggtatactcaagagtgagtcctggactaggtggcagggacctggttacttcccagctctgctattaactacccatgtgactggataaagtatttaatcagtaatggagcttcagcctcctcatttgtagaatgggatgatataccctcttcctgcatagggcacaatgccttgcggagtccatgagtttaataaatgtacgtttcactcaacacaactgagttgtggaatttttgtcctaagttctccccatcaaggttgggagttgggggatatgattcgaaggaaataattgtttggcagtcttttttgtatgttaactttaatttctccctccaaataagatggtagcttttgaaccgttatttagctaagcaaacattttttcaaacgttatgttatcagaagtagagctgattttgttggagcaggaggggagaccctaccaggttgctttctcctgcccactcatgtctttctgtaaacccagaaagggctatgcagaacttcttgggctctgtaaacaaactttttgaaaacgatcgtggatccataattgcacaaaattatttgttcaaaaggacataatgaatatttagaatgactcccttgaagttgatccaaaacttcttgtcatgatatgacttgggctggaatataattccattgcatcacctttctttcacaggagagtaaaacagattgcttgccaaatctatgttaatcagcatttttgttataattgccaggatattcagtttacagaaataaataaatatatatgatatatatataaatatataaaatatatatatgtttaatccttaaaggtcttagttcacatttttatagtgagtgagaagtatgttgggtgacaatatatagctgtccattttgattggctatgttgttatcaagttgcaatttccaattagcttaaaaagatcagataatttatgcatacagtgctgtttgacgtgaataaaggttatccctctcacagacctcacccagggaaatcagttttaatggctactcatttgagtctaagcaaaggtagagaaatatggccacagagcaaaacttgtaacataaaatccccctgtgtctgcttcaagatgtcccaactaagttttaagctccttaggagtcaagatctttgcaggaataataaagtgtaagtgtagtctatgctcactaaatttaagtcttgtctttaactcttttaaactctacgaaagtattttctagaatgaaaagcctgttattaagccagacaaagaccctaagcctgtcatgtacatgctgagcactctcaagttaaaggaaccttgtgaaggcgtttggcctggctctctgttgtctgattctgtgttgtggatttctgtcaaggttttgaggacaggcccctttctcaaggagtggtgcaattcctgcttagcttctaaacagacttgcttcttgctgccctgcctgacttagaactgtgttctgccttgcagttgacatcaactggttgaatgaccttggacaagtcaagttactaaaactctctgagtcttagtaaatgagaagacggactaagtgctcgaatctagttttaaaattctgtgagtcttcaagatagcctatgtaactgaaaatatgtatcctatcttttgaattgtgctggtaagaaagtaagattgtctttacacagacacatacactctgacactcctttacactgggatttgctacagtgaaaccaaaaaaattagagatataagttatagggaaaatgtgaaatacacctcttttctgctttttttctgggcatcggattcctatttttcctccacataaaactgactgagcataagcaaagtaaatactaagtctcattcttgatcattcacagcttgaacttggattgaagttgcttgctctctgatccagagtttttggatgcatggcttttcgtgtgagcaaagaaataaacatactaaaaaggttgtagaaaattgtagatttagtagaatctctgagatgatttactctggggctaggtttagaatggcaaacagatgcaaagctttttctggccttaatttttgagttggctttattcttgtctacaagaggcctagattcttgctgttctcctcacccctcccttttttgtgcacttctaagatttaagagtgtgatatgtctgaaaaagatttgtttgattagaagaaagtatgcccagagaatattgccatattatcttgtatgattcattttattaacttgccaccatccaaggcaggaggacagagtatagaatttgacataggcaacattcagcctcccagaaatttagagaagatgttgggcctttcatctccgctagatggccattgagatgaaggcttttcctgggaggaggtccaaaatcatctcagatgtgtaggttttggagatgattcaaaagggctgcttcgtggaacgtgagacattcccaaggtcaaatcagtttatttaggcatgattatcagtaaactacatgaaaagaaaagcgagtatccatttctgttaactttagccttttctgaaaccatgtgcccaatctaaaaaagggtagtggttgtgaaatataaaattccatgtgtttttgcataatcgggattaattttaaataattcatcacataatttacacaataaaaaaaccaagttttcttttaaaaattagcgtattgttgagataaacatccccaacccctatccccctcgaaactctattttgttcctaagactgatattccttcaaagggcaaaatgttcccatgttatttattccaatggagtaagaaaaaaaaaaaaaacagtggcagtatgtttattttagtaaggttttttaaagcattttatgtccttttaacaatgttttatttgttttattgtagatttttgatcctctgtcccatacctgctattaaatgaaactatatagctttaagctaagcactttcacaaagccctgtaaataacaaccctcttttctcatttaaagccagcaggacatcccatcatgactacctcttaattagatgatattttgatctgtgttcctattcattaatgctttgttttctagtgtcatgtcatggtacggtttactcactaatacagttttgtgacatattcctacaagagctggaccagaggagtcccggtttggctcagggtttctgatatattgcttgacataatttccagattgatatatgggttaaattacataatactggaaacgtataattttaagaaataatctttaacaaaagtcatgttatatagtagaaaaagattgactttaatacattgattatctaacttccaaaacatttttactccatttgctctccctgagatggtctattgtgttaacacagctcactgtgctgctggttctgcagttttgtgcttggtatttttttgctaatatttaatgcagtgcattttatgttcttccttttatttcattttatgttgtattgtgttatgtatttcactgctggatctaaattggggaagggaatcctgctttgtccttgtactataatgaagatagagtttgttaatataaatgtaaactgctgtcttaggtgcatcatcacatgaagactgtttcataattgaatatgttggtactagatacatttagaaaattagagtccctaaacacctactcacagagagagatgaacttaatggtttgttgtatacagtttcatttaaaaatattttagaagaatgacttatttgtaagaatatgtagagtgcaaagtaatgatggtaacagtggaacagttaaaggaaaaatatatgtagcaattacattcaacatttattaggatctttgttcttagaaagttagatatttttgagaatttcaaaatatgggtggtaaaattagattagattgagagggagaaataagtttccagaagcacgttaaggacacattacctactttagtaaacataactataaagtgtattgctttttattaaattatctgccttcacagagcaataatattttttaatgtatagcgttaaaaatgatgggatgacagcaatttcaaatccattttcctcatttttctaagtgaaatggggaaatatatatgaatatatcttcaattaagaatggaaaagattattttaaataatgcagctgcaaaaaataagtgtccaatgagaaatgtgtgcaaaatgctaatgattaatgctgtgttgctgaagttcttatttgtcaatatctaaatgtttaacgttggaaagaatatttcaaaagcatgaaatatttggagcataaaggtactgtacccaaatatcttcttataatcatttcaaaatttatttgagcagctctggcttcttcaggcttgaaaaaaggaaatcagtcacatttgcacaaaaacagtatgatcaaacctgttattcttaatgtttttctgacataaatgtgttatgtgatcactcatggatatttcatcaagaacaaagctttgagattatttttttccctaggatatgacataatgtgactgggatttttaggtcacactatttctttttcaaaaaatgaccctgtttcttcatctctgcaagatatacatttcagaaatgtatttatttcagaaaatagagatgtgtttgagaatggagaagtcattggttagaaggaagttgtaggtgttttttttttttttttgtaaaagattcccataagactgaccacaaatttaagaaaccaaatcctgtcgaaggtaagcatatgccctttttaaaacagtgttcccgcagccagtttttcttcagaaaaattttgtcatcagtaccatctatgcaataacaggagaaaagaaagaggaaagaattggatgtcaggatgtgttgagcatttctatacttaaactgtggtggtcacttggattttagccgtactttccatatttaaaacttgtgaaaaagaggggttaaaaaggctgaatatctttgtaccctaatgagagaacggttgcagtaacagtatcaaagataaaccgctatattaggaatactaaatgataaagggcgataatatgccattcttgagacttcttggctcttacctaacacatcagaaagtgattgttgaattttaaatagccatacaaatggatgacatagaaatttaactttgctttgaccttattctaattcacaagatgactgcaaaatgactttgttgcatctgaatgtatgctggatgctaaatcactccagagtataaaatctttgttttggcataatgttgatgcataaacatttgtaccccatactaaccctataaacatcacaatccatcagtacaattacaaaaaagattgtttgttttcacacttaaagcagacatgaaatagagtgtccttaacttaatcaccaccttgatttaccacatttgcatatatttgcatattaattggactacagattaaaattggttttgtaattttaattaagtgtccacaaaggtaaatgattagaactgtttaaaatacattctgacataaatagcagtaaaagcttttgtgatgatgtttttgtggaattacattcagaaagtggcctttttatgatagtaattttaatcttaaatagaattatacagtcaaacagaactgtggattcataatcatttttttcaagtttcatttaatattttgctgatttgcagcacttgatgaaaatgtactgtaggtttagctgattgcaaaattaggcctttagagctgataaagtgagggtttaaacccgcagtctttagatgcctgtcatacatacttgaagtagatgtctcatttcatgtgtgcgtgcacaagtatgtgtgtgtgtatgtgtgtatgttttagtggaatcaactcatataacccttttaatgatataccctttaaaaagagaatcatcttaagggaccatcatattcccagtttaaattagggaacatataaaatgtttaaaggtctctttggcatattatcctggtacccagaagaactgtcctaatgttgacataggccaaaatgtgctgacttaataacaggtcatcctccctggtgctttccctttgggggtggcactcaccacatgaacaagataattgttggggaaaaagcacttcccccacctcaaaacctgagatactaacgtgtggcatgtgctttctgttataccagacagaaaattggttttaccagaaggttactggatgcctagcacccccttcttccagctggcattttcctgtttgaatcattttaaatgttggatgctgaaaccctccccactcccagctgccaccttcttctctggcggtaccctagacacagctccctaatgcttccttgcacccagctgcttctctgcctggctcctggctatttataatgtgatgggataaataatcctttttctactagtcacctccaaacaactcttaattggatttcttttatatgctatgatgtccctaagtgtgcagtgagtggcataaccatcaaatttcttattgtcctcgctaaatgctatagaagtatgtgtgcatgcacacacctccttgtaaagcttatgaagagcaaaccaggtaaaccttttgattctcctaaatcagatgaggggaaataatttcttagaaacaaatcattatatattaatttttaagagccaatttaaaaaaccttaaattttgtcctgatgtactgtattagaaatagcaaaagcttggaatttgccaggcatagttttaaatcctagtccttccatttcctaagcatgccattttggcaagatattatgtctttctgaagcctcagtttcctcatctgttaaatggagattaaaaagaccatcaagaggttgtgagacataaataaaataatgagtgtaaaagcatctagccaaggtggtagcagtggaattagtgaaaagtggtcgaattcaggatatattttgaaggtagaacagaccgaatatgctgatgaattagttgtggggtgtgagaaaataaataggcgtcaaagacgagagccaaagttttggcctgagcaacttgaaggatagagaagaccatggtagaaacagatttggagggattggattcaggcatactgagtttaaagtactttttagacatagagaaagcagtttgctctgattggaaactattttgtgcagtcacctaggctggagtgcagtggcgagatctcagctcactgcaacttccgcctcccaggttcaagcaattctcctgcctcagcctcccaagtagctggaattacaggcatgtgccaccacacctggctcatttttgtatttttagtacagacagggtttcattatgttgaccaggctggtctcgaactcctgacctcaggtggtccacccacctcggcctcccaaagtgctgggattacaggcgtaagccgctgcgcctggccagtgcttggtcatttcttaggcaggctagatggactcagaattcccaaattgcatttgaagaataggggacaccattttgaagtgctgaaaaattggctaaatgtaatgttttgttgctgacattactttaaaggtttgtggaggagagatttaaatgtattttattatcctcagtgtttctagttctgttttcaggttcatttcactagttgaagcaaagtttttatatgaacatttttattgagcaatatgatatcctagtatgtagtccagaaagtacagtaaaaagcagaaaggaagtaccaaacacttcccctagctttattggttcaaagatcctgaatgaaatgcttataataaaaaaagaaaaaaaaagaaaaggaagaaagaatgagaggaaagaaaaagggaaaaaaagaaccttgaaaggagtctacaagaatccacagcatgcagaagatatttttttcaacttttaagattaccattacccaatactcttcccagaacttacctcccctaactttaaacttgagaaatcatgcattagagaagctggtcttctcaacaccctgctctcatggccaccgccttttaagctttggttatctttgattcctgggacatctcaaccactacccactctgacatgtctctctttctggattggagtctaatggacagtattattttataccactcttgaatattcacactacacactagtattttaaggactctgagaagtcttgcaaaaaaaaaaaaaaaaagttattttcttttacccaatgtcagagacatggcaagaaacatacagcacacttaaacttataacttgaggaaactttaataggaggacttcttacaaagatatgggcaaagtttaaggaaggtaccaagggatagtacaatgctctggatctagtaacagtgttaccacccctgggtctgaaagggcaagtggaaggagtggctactagaacttaaagagagccaactgagtatgcccattgttagaaagatacagccaacttatttgcaagaaggagcagcagaatgaatacctaaaaaatctcctacatgtatctgcagttggctgaaaccaaccagaaccagaggacaagggagccctttaatgcagtccatttgggtcaacctgctagggcacagagcagggccaagaaaggtagagagtgaatctatagaggcagacagaagatactccagtgtactttatgtttcccaaatgtttttctcattagacctcacttttggtttgtttgtaggtttgtttggtcttgatttgatttgacacctgagaacatcttcagggacattagtgttcggtagagcacaggtcataaaatgggggccactgcagctattgtgcttgcctagccaagcagttttgcttttctaaaaattaagctttgaatgcctttggatgggacataagctcccagctttggccttagcccaccacattctgatatgttcggccatcatgtcagtgcattcttgttatcttcctcaccccaaggtcatttcatgtgttggcccttgctctggactctgcccccctctcctcctcagtcccttatcacatttgatctattctgggctcccattttcataggagccagttttccttgagggaatgtagtcaatctatgttgttaggaaaatgattgttaaaggcttaatgtgtcattttccttggggtaacatagtaacatggtagaattttaaaagaatctttatggaatttttgccacagttctctctgcccctgacaaatttcaaatgatatgactttgttttttgcctctcaaacaacatacatggcattttttatataaagcttgccctaatcatttctatttggccattgctgtgagcattccctacttctatattgctaaataaagagaatatgttcatcttcccagagcacagcacactttgagttctcctcaaacgcaggttcctgtggataactagccagaagagaagagaaacggcaggcagagctcacaggtgaaatcccagtacagggacctccagggaggctgtatattatcttataatactcaaatgtcattctagagagtaattttctaaataagtttaagacacaataataatttgaaagaaatattctttccatgcagattgaatgtaatcaatctgacttctaatgtacagaccacagcccctgagcttctcagaatgtaggtaatgtagaatgaatgaaatcgaatgcttccaccatttctcctttatcttttgccagaatcagctagatctactgcttttattctttcttctataaaatgtgtctgtttttattttcttgccttcctgttcactgtggctttggaatttggtttccttcttaactagtcagtgactttgcattgcttcttatgcttcaatgaaaaatcaggtgctgatttttcctttattatttatgctcgaagactgaaaaagggactcttttactgaattagtaatgaaaaattatttctataataaggtcaacaaagcattattactgtaggtcattgaccaggactcagaaacgttttaattatagtatttttcttacaacaataatgacacttggcctgtgttaaatttcccattagcttctctgcctgattttcattaggcacacccagaatttggagcttagatgctaattttcatggcacttgaatgttttattcagattactaaagcacactgattctcttccttgaagaattttgttgttagggagtggtgagttcaagggattttttgaaagtatagaaatagtttcaactcctcaagaactgtcaagtatttttctttgttttattttgttacttagcttctaaaatagcagttctttagcttttgatgggcctttaaagcaaaaatgacctactcttagatatttttaatattcagaaacaattttttaagcaacataaattgtacacttactcatcttagacataagaattccattgataaaattccaaagaactttattaatccatgttttctcttgataagtcaagttgatttttaagtaattgaggcatttgttatataatgtttttaaaaacacaaagaccatgaagaaaaataacaagagtctttgatgatagaaagttgcaagtgacagaaacctaatttcaactgactcaatcagttgaatcagttgactcaatcaattgactcagatcaatcgaatttttaagtggagggagctgtaatttatgatatgagctacctagggttatcattgggtcatacatagctggattaagggacttaatccagccctgtcatcagaactgtgtttctccatttctctcagggttagtttttctgcatgctagacaagatggcctcttgttccagtcttacatcgtaacagcagggtagcctcataaatagagagttttttcccatagacctgcctgacaaaaatatctcaaaatgactctaattggccaaacatctctgaatcaattactctagcctggggctggatggttacttgtttggcctcacatgacctttctgagcctttctcatccccttcttgaaggggagggtacaggaactggttctggtcaggtagtcctgagccacaaagaatgaatttctcgtacaaaggagagattctgttattaagagtagaaccatgaaaaagttactcagctttcttctaacttcaggtcttctatggaaattgaggctactgatctctacctatctcaaaacgaaaaataatacctagttattgcattgaaatgtaattttttcatggtagttataataaataaagtctgttgttaataaagtcgacagaatgataccatagtagtttatatttcggtttcatagagacaaattagaaagcccttagtaaaatgcaggttttttgtgatctaatggtagaattgatgagtaagcttagaaacagcgtaatagctgctaacattaagaactcacccatgtcaggctctattttaaaagcttctcatgtatttattcacttactaaaggtaatatttatgagcaagggttctagagtcacactgcctgggtttggacccagacctgagacctagggcaactacttaacccctttatgcctcagtttcctcatctgtccaatggcagtgagacaggagaattccctggacctctttgtgggtattgtgatgggtgtcttgtttactcggccactgtgtgctcaaacgccttacgggaaggggagcacacagatgaacaggtgcaggaggcggggtgagtgcttttgggctccagccccatggcagggtctaggggtgttacagtgctcttttagtcctaacatctggggatggcttaagtgttaaacagctagtgaagagtcagtgtgacagcctttttgggttcctccacctagtgcatcccaaattcttgtctggcatccaggaagaatcaggtcacatggacttcaaggatggtgaacgcggggattttactgaatgatggaggtggctctcagcaggatggaaagctggagaggggatggggtgggaagataatcttcccctggagttcggcaatcccgcagccaatctcctctctaactgtccccagtcgaactcctctcgatgttcagacgcttcctctcttccctccttctctgctctgccactctgccactcttctgctcttggagcctggggtttggggtttatatgggcacaggatggggggtgtggcaggccaaatggtaacatttgggcacaaaaacaggaatgcctgttctcatttagggccacgggtccaggcttgagggtggggtttagccaggagcccagcccttctgtatcagcagcattaatagtacctacttcatacaatttactttacagtgaaggtaaaacatgtcagcacctaggtcataagtactcaataaatgttagtagaggaggaagagtttttgttacatattattatcttcatcagccattattacctgctaataaagtcaacagagtgatgccacagtaatttatatttaggtttcaattatatatagttttacaaattggagacttattttccatgctatctaattaataaagcaattcaaagaaaatgcaataatggagggaacttgtaagctgtaaaagtagctttgcccagaagagaaccacagtgaatgttcagtcaaattttcatacattgatggaaatcttattccttatcaaatattaattataagaggagaggagagttcctggacaaaataaatattttgttttctcgaacttccaagctataaaaaaatgaagtcatgatttcagaagatattttggtcctgttttttcaggttacacaaatatttatttgtgtttattttccctacttttcctgagccatagactacaaatatttaaattcaaaatattcatacttaacaaggacactgtattgggaactataatttcaaggtgataaaaagaacagttcactaaaaaaaaaattatatgatgacatgattctctaaaattatttttccataatgatttacctaaagttagttcagaccattattaaaatgaaaaaaggaaactcgatattcatacttttagaaagaagtaggctttatgtttataaacatttggagggctgtgaaatggtaattgttaatttctgtttacatgcttggacattaacagttattttggagtcagtatttttgaaagcttaattttcaataattttctttgaagacaagtcatacaatttctccatgcagatatatgcatttgagaatgatgtaaaaattatagcctagcaaaatagctcctgcctacaagaggagactacaaattttggttgtagagaaagccatgattatgaggatataaagatctgatagcagtttatccttttgtttaagattaagatgcttgggctgggcacgatgtctcacacctgtaattttagcactttggttggccgaggtgagtggatcacctgaggtcaggagtttgagaccagcctggccaacatggcgaaaccctgtctctactaaaaatacaaaaattagctgggcgtggtgccaggcgcctataatcccagctactcaggaggctgaggcaggagaatcgcttgaaccagggaggcggaggttgcagtgagccgagatcgtgccattgcactctagcctgggcgaaagagcaaaactcggtctcaaaaaaaagaaaaaaaaaaattaagatgcttggattaggttatcctacataggatagattatgtaggttaacctacataatctgtatttgtatggtacatatattcattgtactcagacttttttttttagtggagccaaactctatacatcaaaagtttgatgggattctttcctagaacttcttaagaactgaccagagaaggtagatattattccaggaaaaacaaagacaagcacagagaggtgaatgaaatttacattctggtggtggagactgcaaataagttaaaataatttcagatatagttaagagctgtgaagtaaagaagataaggtaatgaaaaaagaggggtgagtaggaggaaggtggtgtggtagctagatgaggtgacctgggaaggcgtccctgagagatgaaattttggctaacacctgattgacaagaagtgaaggccaatagggggacgagcattccagcagaagtaacatgtggcacattctaagagtggaaataagcccagggaagaaggggagaggtataggaggcaaagctgttaaggtggggatggccttgtcttagtgatgagtttgcatttgttcattctgagttcaataggaagccattggagggttggataggggtgaggcatgatttgattaattcgtagactaggtagaaggctctggcagtagtctataccagagatcattcaaatccaaatccctcatttctttctttcttttccccaactgtgcattctttcttctgaaaacccacagctcactcatcctttatttaacagatatttatgaagccaacacagtgtgccagatggtgtactaaatgctctgttataaggatgaatgatgctatccttttcctatccttaatgattagtctgtgtttgcttgggtacagttgtattcaaaagagagcctaaatcttcacagggaagaaaggaatggcttgaactgaggcttaaaggatgtgtaggagttgactgtatggagaaggggactagcatgagagtatatcaggcaaagagaagagaaaatataaaaaactagaggcacaaaaactatggcatgttctggaataaaacaagtagttctgcaaagctatgatatatgtttggaatgagtggagatgaggctggatgagcagtcagaggccagaatctgagggctatgcttgctgcactaaagaggcaaatgttatcctgtaggatactgggagccagcaaagacatttgagcagagtagaaacaataccagctttccttgttatatatttaactgtgatggagttcataacattaaattggagaaaactatcaggttattgtaatcattgaaatgaggcactaattgtctggactgaatgagctaaagggacaaggacaaggaattgaggagactctttgaaacttgggggttgattagatggggatggctaagaagaagggaagaaggcagaacccagtgtaacagatggtaccattcaacaggataaaaaagtccagagaaatgagcaggattataggacacagttttgagctcaagaattggaactaggagtttggagcgtccctggatatatcctgttggaagtttaatacatgtctctagaactcctgagagtgttagatctaaagataaagattttaaacttgatacagtataaattagaagccagaaattggtattccttaggctatatcagtctctaaaatttgcttcatttattttgctttttaaaaaattcatggattttatataataacctattaatagacctagtgatattatgcctaaattccaagaaagtgacaatatgctgggttaagaaaaaggcagtaccaatagattgggcactcttaaatttattttattttattttttgccagagtaccaaccaactcacttcatctgcttatattacttagttcctattgatatttgagtttgcagcccttagcagaatgcatagagtgaaagcagaaaaggatcaagccttgtggaacatcagagttcaaggaaagattggacaggggaagaggaaaatcccaaagagaaagagagaaagcacatctccaaaagtttctttgtgtgtgtgtgtgtgtgtgtgtgtgtgtgtgtgtgtttagcggggtgggggaggggggttctttctttcttttttttttccttctggtttttctctgcagactttttgcaatcttcgcaatgacttttgttaccttgctttctctggactaaccaatctatgttgtttatgttagaaaagttctcccatatagccagctgtggtgatgcacaactgtagtcccagcagctacttgggagactgaggtgggaagatttgagcccaggagttcaaggccagcctgtgcaacataagtgagacccttactctgaaaagtgaaaaagaaaagatctttctaaaccctggatcctggttattcataccatggtccgtggataatgtttccatgtgggagtttcttcacattatttcttgggaaatttggaggtttttcaaatactgaatcttgaaaaaagagattcagttgagaaatcataaatacttggaagaggtattataattctcctgcaataattaaagctttaaaaatcaacatagacacatgattagaagaaacccactatggtcaaattgaaaatcagagcaggaaacattagcacacatagttgaaggtcagattgccatttctggggaccgagaccaggtcatatgagagataagtggtcaggatcatcatgattttttgaggatttatttaatgattggtacccataagagactgggagcttcatgaaggcaagaattgcatgtcttcacctttagcactttacctcttgcatatatatcttggtctctcagtaacttgataaataacaagtttaaaccatcaaggatagtagttttgagagcatataatggatgaataaatggatggttggatggaaggagatagagttgttcaagaaagttttccaatgtattaaaagtgagttttataatttattattgtctaccagcttagttgccatggagccaattaatttgccttaagtgacaacatacacacattttatctttttctggtcatacagggaagttcaacgtcttggccaccttgatatttcaaaataatttgtaggcagtgtgggtactttagagccattattagaaattaactctgattgcctttgttcaggtattacacaaaggtgcaattttggatggatctccaaatggaagtaaaattatcttaatatacagagattcacactgtcaaaaattttttgagagagatagttttgctatcgcaaaatgttttattggaatacatttgtgatagttttgttaagtatttcgaaaagttcttggattcttcagcaccactacctcttggacattttacttggcttgttttttatagattctcaaagccaggttcacggagctccttccagaaaagcttcgattcactctagtccccaacatgtagacttcactctccttattcttgtgtgactcagtctgctagaaggaagggatttgtgtagactggggcagtcctagaaggagagagtgaagattgagtatgactattcattcagcaccttttgagtgtttactgtatcccatgccctgttctgggatataggaatatcgcagtatgcaaaacaaaaatctttgcccccaagaagcttcattcttgtgtggtgattggagggaggaaagacagatgacaaacaagtacagtgtgtgtcagatggtgagaagtgctggagcaaagaatgaagcaagagaggggctcgtgaccctgaagttttagtcaaaggtttgattgccacaatcataaacttcaaccttcagggtgcattcatcctgcagacatgttttgttcagaccacacatagttctttaaaaataaaccagacctgagttagttcatttaatttagtcatgacatttcacatttaaaagtcttgacatttcacataaattctcaatttctagattttactgaaaaacctaaatatgtggcagcattccagcattggctaaagtttagtactggctgcttctttaaatatgacatcataaagctagagtacagtaaagtatacctatatatagtaaaatatagcatagctcactgtgtatcagaagtcatactaagaacttgacatgtattagctaatataatcttcaaaataaccatccgaagcaggtgctacattgagtcacagagaggtgaggtaaggtcaccaaggtcacaaaactagtaagtggtgcggccaatatttaatcctagaaggtctaggttccaagtccaattctaaccattgtatatataccttcttccactttgccgcttgatgaacttcatttgtttctacctgatggtcaggttctaggtctctgtcatgatccaggcatgactgccccaggatctagagggagcctaaacttgtagatggaccttcttagtggatccttctctggaactcgaggggacagggaaatagggtacttgccacctcccactattgtgcccttctagctgcactcagtgactcctgccccctctagctaaatccatttctgtaatgctgcccacccgtgtgagcagttctggtggatgcctcagttctgcctcctctttccttctttgcaccacgcgattaccttcatgccttcacaaatcctgagataagaacaaaaagcctcaaaaaaccatgcatttgactgaattgaatattcatcatagggtgaaatatgaaggctaatgatcttttccttcttccttttttaattacctaaaaaaaaaaactccacttgaatccgttttagaaggtaaaactctcagaggggtgtgtgtgtgtgtgtgtgtgtgtgtgtgtgtgtctgtgtgtctgtgtgtgtgtgtgttccatttcagggaggtgaatacttgtcaccacttaagtggtggtatttgacttcaaaggacaaaaagtaatccattacctgaatattaacagcaataaaacttagcaacaataaatatttaggagtgcatgagtctccttcaactcatttacagactgattggaaggtttttccagctcaagggactgaaatttggcatctactccgctagcctaagttcattttttatcttcttcttccttttcaaaaattgtttcttagttacagagcatcaaacataagttggatgtgctttcaagcttttaggggccaattttggattttgcaatcttattaaacaacagcccccagagtcagatacatattataaaaccatatctttaaagtgcatattattttcaacctgtttgatcagtggatatcacacttgtcaacattaggagctaatgaaagaattttgcttcagaaaaaagccaagcaaggaaggggaaaagaaaggcattactagcattatagtaaggagttgcattctgtctctggagggcatctcgggcagggattaggagtgctgatcccagaacagttggcctcagagcagtgctggtgggcaggagtcaggcctagttgaagttcaaaggctatgtcagccccatcatccaggccaggtcaggggttcatcatccttcatgtaacccaaggcagaacccttacaaccaactcctttttgacactaaatcacatctctttaacatttcttgagtaaactgtgatttatctaaaaatatacatgttaacaagattttgtctttaggggttctgctactcatgtgacttcaggctcacccacttaacctctgtgggcttccgttacctcttctacaaatgagaagctgggctaaatgatccgcaaggtatctaccagctcttacattctgggggctacagaggtctatgggaaagtagaattctgtttgtagttctctttttataatcatttttattagagtgagcaaagaacctttgttgtgctgtcttcagattattattcagtctttctcttttgttctaaggacctgaacctgtgtgggaaggttttgtttttttggtttttaaatttttttttgagacagagtctcactctgtcgcccaggctagagtgcagtggctcaatctctgctcactgccagctccgcctcccaggttcgagccattctcctgcctcagcctcccgagtagctgggactacaggcgcccaccaccccgcccggctaattttttgtattttttagtagagacggggtttcaccgtgttagccaggatgatctcgatctcctgacctcatgatctgcctgcctcggcctcccaaagtgctgggattacaggcgtgagccaccacgcccggccaggttttgttttaacattgttttttggtggagtggctagggtacagatctgcctaacattgtttgtttgtttctaattccttgatgcagagtggggtgacttaaggctcctgaatatgctgaaaggcgaaatgtttgtagaccctcaatctggccttggctaaatgacgtccagaagcagcaggtctgctgtgctggaaggaggagagtggagttggaggcagaaactctggtttcaagtcctgtctctgccactctgaaccacaaatgatttattctgagaataagcatggaaacaatatcaggatgttataaggatgtgatttgtgaagtacttgataaactcactgatgcttcattcaggtagaaggtactgttactaagtttctaagcgttcaacaaaacatgcttattattgtcatagcagctgaggatataataatatactgaataataaaaagtgtgtgtatataggtttgtgccattattttaccaaacctaagagtatcttatgattttatgttctagtcctctacccctttgcagataaccagctaaatttttatttttacataagattggcaatagatgatctggcacagtgactttcaaagtttgtttttttactccaacccacagtacatttaacactgtgatctggtacatatatgtacatttatctgaaacaaaagtttcatgaaatagtactatgggtagttctttttaatgttttcttttcctcttatttatttcatttctttttaaaatgctgatcatgactcactaaattgattttatgatccattaattggtcatgaaaacactgacctagcacatgcttgatcattttcttttttcttgggaataccagtttggacatcgatatgtatgtggagtatcagtgcatgaccaggatcacctcctgtgtatccataacccaaaatattcctttaaaataggccgggcgtggtggctcacgcctgtaatcccagcactttgggaggccaaggtggatggatcacctgaggtctggagtttgagaccagcctgaccaatggagaaaccctgtctctactaaaaatataaaattagtcgggtgtggtggcgcatgcctgtaatcccagctacttaggagattgagacaggagaatcgcttgaacccaggaggcagaggttgcggtgagctaagatcgtgccaccgcactccagtctgggcaacaaaagcgaaactccatctcaaaaaaataaaaaataaataaatgaaggaaagcacacagactttacagacacagaatcaaaaatgattcctgctggatgatttactagctatgtggctttaggtgagttacttaacctttctgtgtctcagtttcctcattttaaaaactggaatgataatacctatctcacaagactaaataaatgtatgtgcagtacttgttacaaagcaagcacatattaaggactaatttatgctaactactattagtcaattagttaccaggtctttttgctcgtctcttcacttagttttcttaaccccgcaatattgcagtaatctccttgctggccttctggttttgccagtagattacttcatcctgcatagcacaaccagactaaattctcacaaacacccttgtatttcatcacctcacagccccagttttatcctgttatcatttccaagtttccatataaattccataaatccagactctttaacatttctgactcctgagcgtcctcagaataacattcatttcttcagcaaaccctttactgggggcctacaatgtgctggcactgttcggtttctggagttacagcagtgaacaagacaactcagtcgccccatttggggcagtaagaacacaggcaataaacaaggaaatgtgtacccatataatgtataagtataattatataatttggggttaattaaaagtgatctgaagaaaaataaagcaatgtaagagagagtaaagttgaacctgtttctcctacttccatcttccactttagcaaaactgctctagcaccagcatggtagccattccttcccatctagactgcccctccgccttttctttgcccttcagtgtcttgcccattcttgtagtttcgttcagatccttcctgctctcccaaatctgcagccatttcagctcacagtgctttctacttcttcatgaagcattttctctctcaattcgactcttactctgctttgtatcatccaccctctttttatgtgtatttttaatctcatcaactggattatcaggagtaacgtatgttctcttttgcaactctcatgctctattcgtgataccttgtacatagtagcgatcaggaaaatgcaaagttgttgttgttattgttgttagagacaaagtctcactgtcactcaggctggagtttagtagcatgatcatcgttcactacagccttgaactcctgggctcaagccatccagagtagctggtagtaaagatgcgtacaaccatacctggcttatttaaaaaaaaaaatgtttgtagagatgaggtctcaccataatgaccaggttggtctcaaactcttggcctcaagtagtcctcctactttggcctcccgaagtgctagggttataggtatgagccaacacacctggctacaaagcttatatatatgtgcatacacacacacacacacaccccaaaaactatataaaccgtatgtaagtaatatgcatatatatcttaactattagatcaataaaataataagagcaataacacctaatgttggtaaggtcatgaggaaataaatgggtattttcatactcaatataatgatacaactatcattggacaactaggcagcttctaacaaaatttgtaatgtgcatgttctacaacttaataatcacatttacagttgactttcctaaagatatagttaaccctttatatttgtgtgttctgcattcatgattcaaccaactacagatcaaaaatattccattaaaaaagtgcgtctgtactgaacatgtacagacttttttcttgtcataattccctaaaaaatatagtataacaactatttacatagcaataaatgtgtgtgtgtgtgtgtgtgtgctgactgaaaggaaaataaaccaacttcaccaacacagctgactactgacaaaaggtttaaatctatttttggaaagacttacagatttctataagaattaggtaaactgttaagcctcagttattgtcatttaaaacaagaatgaaggaaaaaatgaatttagaaaaaaatcaattgccctttttgtgtctgatttcaaattgtatgccttataaatctgttaccattactgttatcattattgctaacatttaatccattgtatcataaaagcaactcctctcaactcttttaatactctctacaccagccccaccaagtagatgcccagctaaaacttgcctcatttagtagttggaaactcattacctagtaaggcagctgatttatttttgggcaactctgattattagaattcatttttccctggagccaaaatctctctttttattgttttttttttcaccgttcctgccgctgccctttggcaacatataggacatttttcttttgacatcccatctaaaatttcaaggtagttgtcatgctctaacaatttaccttattgtctacatagagttaatttaatgaaagatctcttagttctgttttgtcagcagagaaacaaaaatacgacaatggaagaaatacaaagcctttggaattaatttgtattaattttgaggaggacttaatttgaaatctaggtattattatttgataataaaatatatagatttgttgttctatgtaaatgctctagattgtgggcttccggaagacagaaatttgttttataactctttatttcttccttctttcccacgtctgcaataccaattataaacttactatgtgcctgctatatctttactaaataggtggcttaattatatctagaaatgtaaacataatagatttatcttagtaaaactaatatagtatttagctcagacattccaaatctaagaaatattggtctctgatgtttacatgagacattattaggctgctgacattatgtatgactctattctgaatgggaaccccgcaataattcttcagcctaacaaaaaagagccattttgacaagtaatgggtttgtatagactatgtctattagtactaggaagcaaagtttaaaatctcagaaagttgctgttgaatgtgtatgtaaagtttttcaaagacatgccaagtttggattttgctcactaaaggttagggttctattagtagataatgctcattattttattccatttccttatttttaccaattatttacatatctttttctggccattgcattttattgataatagtgaaaattaaaataaatatattgctctaaaagtagtttccacaactcgtatcagtaacttcagtttttgttctatttttaagctgcttgccacaatattgacaggcatccgattgtgtgaggcttagttctaattatagatataggctacttcacatggagttagatatttctatgagactaaacaaaacgtgtaatgctgtgaacaaggaaaacagcagcatgtttttggtgtaaattgacttgtcataaacagtaattatcaacacagtattggtatcatgatactgttttgggcctcatcattcaaactatttctctttgtattgtatagtgatttttttaggggagaaaaacccaacaactgtcaatctaatcattatattcagcatacattaccaagcaaaacatatttacagctagatctacactgtttttacaagtttattaaaaacatgtgttgcccaatgccaggaatagctacagcaaatgctatcaccagtaggcaaactgtctctccactttcttctgaagatttagctacctcatcactttaactatgagctataccatagatgttcctatgtgaaaatgtttatcacagataagacctctgtgtgtgtgtgtgtgtgtgtgtatgcatgtgtgtgcgcacacaagcatgtgcatgcgggggagcagggttggtgggggttggggagataaggtagtgggagggagtagatgaagggagttcagggccgtggcactcctttgtaccactgatctaggatcataggtcgatacctaatgaagtaaagttaaatcatagtaggacttttcaaccatttggtttattttataggagcatgatgttatccatgatatatacattaaagctgcattttttctctctacaaatgtgatactctttttatataatctcaattttaataatttatttgtgtaattattgttttaatcaccatccacacagccccaccactctctgatagcctatagacactgtagagacctttctacctgttttacctctgctcctagcttgtagtatgatctcagtaaatatttgttaagtgggtgaatatctgaaagaaaaaggacagaggaaagcctgttttctacatttggcatgtaattgtcacgagctactccatcctacattgttctttcccttctctgaattcctatagtccatgtatattaattgctgagctgatcacttggctgtattatgtataatgttactccctagttgtttgaggtatgggcatctagctccacatgaatttgttgaccacccccaccctgggtcctctgtattatttcttttcagcagctaatctggtgaggcaatccactggacacttagtacgtactttgtgtcttcactctgttaaaacagatttcaaaccaatgtgagaaatagcattctatcatctggtttggaacactagcctatttctttcttcaaagactcagtgagcttcccagcaattaatcaaatggcaaagaatgatttggtaatttcttcaatagttaaataataactttttgcaagttacaattgctttacattgttgtgtggttgataatgggttgtttttccatctcttgatggcacatcaggttaacttcaacaatgtgaagtatgttttcaaaatgaaaagcaaatgtcaatttccttataattgtctctttctaaccataatagtaatgtactggtaagaatagataagaataataaactcttgaagggcgctaccataaaatatgattagatagcagcaaatatccacttgcacgtgttgctgtcatagttaatagttactttagaaagcatgttaatctggtctgactgcttgatttctcatctgaattagagaggtaggtaggtaggtagagagagcttcatttaggtatacacagagatagggtcagctgtacagtatatatgcaaaaggaatcctgatgccttgtcactaaaattttctaagttaaccaagaactacaattttcagttaagtagttaacttttttctttttatcttattactttcatgttgtgttttgagtaaaaggattagatgccttaccgtgtctctaccaagaaagttagtttgggacaaatagatggatagcttcacaaatggcgaatagtctttttttatttttttatctcttttgagatggagccttactctgtcacccaggctggaggacagtggtgcaatctcagctcactgcaacctccacctcttgggctcaagcaattctcctgcctcagcctcctgagtagctgggattacaggcacacaccaccgtgcctggctaatttttgtatttttagtagagatagggttttgccatgttggccaggctggtttggaactcccaacctcaggtgaagtccctgcctcagactcccaaagtgctgggattacaggtgtgagccaccacgcccggtccaaaatcttaatctatatagggtgacagaaagccactttagtgttcaattagctaatgtgatatgcataagcaagatgagtccagattatccaatactccacatgtggttttctgaacaaattatcctttcttcataagtaccgttaatcttcataatgaaataaatattaaatatttgacaaaaaataatgctggaaattatgtgagatcatagaatattttgttagaaatgtaaagagacaacaatgacactagttatcagaaaactgctctactcaatgtggaattaagtagtcactgaacttgttttagatgacttcttaaaatcatactgtatcatattatataatcttaatatacttatttagaaaaatggttttatgttgtatctcatttaatagtgctgcagaagtagatgtagatttttgatacaatagtggatcctatatgagccagccatggtggcatgcgcccatagttccagctattcaagaggattgcttgagcccaggggtttgaggctgcagtgagctctgatcacaccactgcgcttatggtctgtatgacagaacaaagccccatctcaaacaaaaacaaaatagtggatcatatctaaccttttattaaaaacaataatgaaaaacataacaaaaaagtccttagtttattaacctttactatttcttatttagctatttccttttgtccaaatatgaaactgtcatctctctgtaaaattaacgtggccttttgatctgataatattagcatcatttctcattattcaatatcaaatctattcatcctgagtcttaaatgttgttatttgatagtgttagtaagttgcctgtttatttatgttcctgcagagagcctgatagtagaaattggttatgattctccttatgtaactctagaggacaggccttcacttatttctgtgtttgggagatagtctcctttagcttgtatgaagttgttaaatctaatagttcatagcagcatcagatttgattatttcaaagttctaagatcaacagcaactatatattgtagccatgtagaaaatggaactcacatttggctctctcttcaatttttgctggagctaacatgacaaaaaccccctttgccttacttttggagtagtgtaaggatcttctctgtttgctgtttccagccttgacctccttcctctctcttcctgcacacttagtccttcctatgcattatggctaaatcaaccttctgaaaacaccacttagtatagccctgttacattaagttgtttgttagttacaactaatacttataaatgaaagccacactactcggtcagccaggaaaagtggtagtccctccctgcctgcctcctctctcatattcccccaacccccaaactccagtggatacattcatgactctccaagtatgttatccacatttctttctaactttctgctttgctccctgcattatgccttctagttgatgcaccgggatattgtggaaagaacatgaacttaaatggactacatctggattcaaatcttgcatcttctgcttcgttagatgtgtggtgttaaacaggttatttaatctccttgagccttaattttcttattggcaaaataaaagtcaaagacatttcctgcgaaggttaaatgtaggtaatttgatttcataccacacacacacttccgatgtagacattcaacattctatttttcctgaaatgccatcctctcctcagttcttacttaagaccagactgtactttaagtgtgaattcaacttctcccatctccataaaataagtccatttttccctagtgctgaagtggaacttcgtctttaaaatttctctagcatttgtgggttgtgcccctctttagcagtaagcatgggttacttttatatatgttcaagtatttgagtataactacagtctgacttgcctgtggaggagtcatgaaggcacagttgctgtctcatacatatataactccttgtatctccacagactaatgacaaatgcaatgcaagtgttagaaacctaataaacatttgtacttgctctagtgtcttgatgataattatgtcaccaggaaatctcaagtcaaccaccacatacttccacaaaaccagctttatttcatttaagaattttggacattcttaaagccaggactgtacaccagtacatctgtatcatttattttgcctttgttcattctgattatctggtgcctgggttatctagttattagatatttttgatatctctactgcatatggtatgttttctaatgcaaaatctttatgaattactttacatacttagatttagttcctcttagaaaaagaattcagaactgtaacttttattacctggcttggggaaaaaaatacatgatttttgatgaattgtgtgctattttgtgagaatttctccactgacacgtcttttgaacagaagggatttgctccccaagttcttactcatgagctttcaatagacttcagatgtggggaagcatggccctcctcaaataagatttgcaactgcatttgattcactttcctcccttttatgaaattgagatggacggctgagccaactgaaaaaaaaagtatatgtgaattacattttattctaataatattagattgtcctacaaaagtatgcttgcatgctatagggcaaaatcacatatcttatgtgtatatatatatgtatgtattttttttaagcatggtaaaaattaaaatacagtagagagtaatattgactctgagcaacacaaatgtggtctgtttcaaagtgaggtagctatctggaagagattttcaactttagaatatgttgatgctaatggttaaacctgcccaccttgtctttgatgttctgtctgagctcatgtgaagtaataggattaaaaataaagtgtacacctttcttttgatctaagtagccaaaaaggagggaaaaataataacctgtctcctgctccaatttagcaaataccactgctctaacaaaaccgatatgatactgtggctgggttcacagatgtaacacatagggtacactaaggttttcacagccattttccttttttctgaagcagcataattccagatattgctgcataaatgtggctttttaccatctacaaaaatcaaggcaagttcagttaattttaagcaacctctctcaaatgacttgcttttctgttcactaataacttaatagattatttaggactgttggtcagttagccaaaagtgacagtgaaaagatgttggcatgagtttaccttaccaacagagctaaactgctttttttttttttgcgacggagtcttattctattgcccagactggagtgcagtggcgtgatctcagctcactccaacctctgcctcccgggttcaaggaattctctgcctcagcctccctagtaggtgggattacaggcacccgtcaccacgctgggctaatttttgtatttttaatagagatggggtttcaccatgctgaccaagctgatcttgaactcctgacctggtgatccacccacctcagcctcctaaagtgctgggattacaggcgtgagccactgtgcccagcctaagctacatttttaaaggacctgtttgttttatatttttgggtggaaatttcccaacacatatatatatatatgtttaaccaacccctacttggttaaacacacacacacacacacacacacacaaattcacacatatacatattcgtctgctgtaaaaactctgatcaatatagaaattaactactccaaactgcggtcatttcagaatgaatgactatggtgttcagatgtttcccattgcggggaaaaaaaggtgttgtgaggagggttgtggggacagatgctgtcttcctcaggtgatgtaagaaggcttagcttgggttgattgtgcttggaagctgataacccaaattagcctttatgaaactctttggtgctctgaatagatctcttagtggacagatggctttttctacaaactggcaggcatgcaaaacacatcaaaaggaggtggtaagctagcattacgttttcagtacttaccatcctagtacctgtggtcatgaatcctagtacctgtggacaagaccacaaatgaactcttcattgtttatttatttgtattatctttttttttttttttttttgagacagagtctcactctgtcgcccaggctggagtgcagtggtgcagtctcggctcactgcaagctccgccttccgggttcacgccattctcctgcctcagcctcctgagtagctgggattgattacaggcgtgtaccaccacgccagctaattttttgtttgtttgttttttgtagaaactgggtttcatggtgttagccaggatggtctggatctcctgacctcgtgatctgcccgcctcagcctcccaaagtgctgggattataggtgtgaaccaccacgcccggccttcattgttctttctaaagggagcttttattcctctcctctttcttatctctgcttttgtcatttttgtgtttgttttctgttttattttgtttttcctgtcagtgacgctactagttttctgttcttccaggttcaagctctcttaattgacaatggaataacttttagccccttagcctgcctgcccataatctcttgctttctctcacttctttccaaccagttactacctttagtttctgtgcctaaatgcagcctagtcctttgtgttttttccctctgcacccagcaggcctgcctatcttaaagttaaatatcaatcatactggcaaaagttcccctaaaacaaaaagaacccacagcaactgaaagtcattcctctgtggaactcccatagagaattgtctatagcatttttgccagcctgacaaaggctggactccacatcagggcctgtgggaccttcatgacttggtacctggttatctctgcagtctctcctcttctctcctagtgcttttgtcccctctccacatatacacacaaaatagtaaaatcctgcccctgctataccagctcctcaaacagaccttcctctctactcctttattcactcatctgcctgaaatgtgcccttcctaccacagggcttgctctcattctctttcagagctcctctaagaagcttcccctggactggctcctgttcctctcctacaagcttgcagcatgctctgaactggccctcaacacacagcatggagattgtgttttttacttttttgtgccttcactatagtatgagttccttgaagtcacaggacacattttatcagtgcgtccacagaacaatgccagaaacaaactacttaatgagatttgctaatagtaagaatagatgtggtgcttaaatttgtcctatattatgattaactataattattttctattaggacataagtttcctaacagcaaaggctgcacttcatacatattgaccctgagagtgtattgtacattacaggtactggtatgtgacagatattcactgggtatttttcccttgaattattcactcagaagaggattggcctttaaacagtgctttcataaaattacactgatttcagtgatgacgccatttcttaaaatattttggtacatttccttccccgattgtgtaggaaccagcaaagaaaagtcaattttattacttattgtgacccaagatgttgttattcagcttggttatcacagttttcctcttttgaactcttaacttctggttatgtgttaaaaatcgcttgaccccaaaatttagaaattttgaatatatttagcatataggattgtgaaattctcaagcgcaatgaaagtgtctgacatgcaatctgacatagtaaattttccttaaagacatagtgagtgaatgaatgaatggatgaatgaatgaatgaactatttgacaaactctgaagataaatccaaaaatatactaaaatattttcaatgatattagtataattggagtacactctggaagagaagttatttcagtgtctttctttaagcaaaatgaaaaaataatgataataaatccacctctttgtctaatagacatgccctgcattttctgtgttgagtaagaagctttgagtcattgacaggtgtgtcagtatttgggtttgagttcttctcatcatctgataactgagttatttctttgaagtctccctttttagtctcccacccttgggattctagactttcacctacttaagctcctttcctcataaactgttattttgttccatcccatcttcctttctgtttcttttctttcgttccagttattggattttctgacaccttactgcaagatcctcttatcttcatggccatgaacttttagggtcttagcgacgtatatagctcactagcatagatccctttcgtgtgcacagtaggcaagagaagaatgtccttaaaaaacaaacttatagtcctagacctccaagtagggcaaacagagaaaaacaattttgagcattttttattcttttagaagatgatatagatctggtgaaataaattaagagagtcaagcacaagttaactcaagcagaagcaagtgataataaagtaagacaatcatgagggtacagtttctttaaaacaacagtcatgaggttttgttgtatgctaagcgtggtagagatcttattgtctgctctcacgctcatattcatgtatgcttctacaagcaagcatataaaaattaaaactaaatactgggcattttctgctttgaattttaaagataatttaaaagtattaaagtcaacttccattgctttcttttgtggaacatttaaagaaaaagacagtcaatggaagcaaaggggcacattacttgcatgaccctttgctattaaaaactgagaatacatagcccctgtttttattactctgacaaagtgacacatatttcttaaagcagagtaggttcttagcaagctggctgtagcttttcacaagtatacaaatagcttcaatgacattttgtcaagcaatttccagtgtacaggttcctaaaccttcagcccactggatcacctttaaaaagaaacagtgtcaattgaaagaaatttaagaaagccaaggccagggctggtcagtgtgttggagatggatggtacagctttcactgttgcccttgtgcctttctggtccctgtaaacctctacttaaaaataggagtgactcaaacagaagtcaggaaaaggttgtgcctatgtgagatgatatcaaagcgatggcattactcccagggaccctaagtgaatggcatgttcaatttgtggatattgctcagaaaatgcatttttatcttccattactgaacaaaataaaggatttgccacagaatatagttcaccaaagttgtttattttggaggaaacctcaaacttgtttttatcctttcaaggggttttcagtaaattttagtagaaaactcccccgcctagaaaccagaagacatggttctcatcctaacgttcaccaagtgagagctcacttggtcatatctgtgagttaagtttcctagagcagtgttccctaaaatgggttctatacatgtagtcccatggaatgccctctttaataaaaggagcaggggggagggggagacgcatcacacactttatctccctgtgaatgaatattcacaaagcacgttcgcatattcaagtctttgagaattctgcagtaagtgagcctgtcaaatttcatttaatgtagtatgtctaaaacttatttaagggaagaattttttttaatggaatgcttattaaaatcctgcagaagtatttttgagaacacactttgggaaatggtgctttctagacctttgactccacacctgaaaaatgggctaaaactaagtaatttccctggtccctagcaggtctcaaattctatggttggtataaaatctcagttgtgtattcgccagtcacaaaatgtacataaaagccagcaaaaaggatgttttttctgacagaaagtaggaaaaaacaaaggttcttctacatgttgtgtttaatattataaactatttcatgcttcttcataaaataacttaaaatccacatgccatcccttaattttaatcttaaatttaaatttaatctctattgaggggtaggatccacattaaatttcatatacaacatcaatttaatacaactgtgtatgtggtaagtccacaggaaaaaaataagattttgtttcacaagatttcatgattgctgctattgttgttattcccctttcctactcacattgtaagctcctcagacagcaggaacaattctctgagttattttggaatgttttattgcatacaatattgggtataccgtagttgcttcttgtttttgtgaaagtactcaatagtgaataaactgtttaaaaggaaaccacatttgttctcatgtcttttgaagattctacagggatagaattgtatcattgtttttcaacagttcaaaaagcaaaactttttagaattggcattaagatatgagacaaacgtatatataacacacatatgtaatatatgtatatgtatgtgtaatgtatatgtaatatatatgttatatatatgtctgtatgtctcaaacactgtgaagtaagtcccaaagtatgtacaacttaatgaagacactcaacacaggaaaaacattcttggttagtgattttatatggacattcacagcaatgaatgattatgaataaattttttttatcagggaaaagaggcaagtggagttaaggaaaaacatttctcgagcacttgccctgacaggcatagccattataatttaattcattaaattgcaagcactattatcagcattctcttgatgaagatacagaggctcagagagattgatattttgatcaaagtcacacaataagtggcagagctgagatttgaaccaagtgcttgtaatttcatgtctaccttctttctaaaatgtaaccaaaggaattatttttctcctataatcatctagctattgaaatgctatattgcaaaaagagttttaatgagatcgtactattgagttgttatgaggagctttttatatccattttctcaaattctagaattccagagtccgttttctttttctgcctgcatatttatatgtatctaaagagtttgatcataaaatagaaaattgtttttcttaggcattgatgagtactttactatattttgagataattatctgaaagatgtttctttgtagaaatgttttacatcacatttaagaaggattattatttaaatttcaaaatagaacagagcgttctcaggttatttatttgtttgttttctgtccctgcccccatgcccttcagcatctcctctggcttttgtgacacacgtgctcatgagctgccacaactaggtccctctgcttagggtgtacatccctcctcccaagtctggatacaaggtggcattaggtgagggttgatggagactacagcacatgaagttcatccatgttcttagtcagtactaaatgacatctcattatgggtggacagtaaaatatttaccacttaattgttgtacaaaaatgtattgaagtgaaatccacctagtgtaaaattaaccattttaaagtaaagaattcagtggtgtttagttcattcacgttgttgttcaagcactatttctatttagttctaaaacacttctatttagttctaaaacataaaatatttccatcactccaaaggaaaactgcttacctattaaatagtgtctcctcattcctacttctccctacccctggcaaccatcagtctgtgttctatctccttggatttatgtattcgtataaattgaatcataaaatatgtgactgtttgcatcttgtttctttgccttagcataatttttcaaggttcattcatattttagcatgtagcagtagttcattcctttttatggctgaataatctatagtatgtatatgccacaattggtttattcatttatctatgaagggacatttgggctatttctatcttcagactatttattgaacatactacctttgattacccccaaaaaaattcctgttgcaaaagcacttgaaatgagacacttaaagttgcaacaggagcaccacaggaatgaatccaatgccaacctgccattaaggttctttttgaaactggatcctttaaaatataatgttactgtaaatggactttaatgatacagagtgtatatgggttatgtatatggtaccaaatatgtaggtaccttctttttaaaaaaataaattgtatcaggtctatttaaggtgtacaacatggtgttacagacacacagatagtaaggaagtgtttttaaatgtaatatgatatataatcttgtttgtgttcagtattaaatttaatagaattacacaaagcctacttagatagcttagtttagagacaaaaaatattagttctctccaaaagcttcagtaaccaaaagctttaaatatattcttttgtcaattaataaagaagaactattgaaaacaaattatctggcatctctacatatgtaataattatgcagccaaggcttttcctttggaaacaatttatacattatataaacctaactttctcatccaagtatcatttcaagagaggcaagcttaaataatggaggcaatagggaaacataatattacaataatggtctttggtgcggtttggaaggttttaggaaacatttggaactatttttctcataaagtcagttaactattgaagtgttatgatagcatttccctctgtattgtatacagtacaaaaggagcccagttaaaggagacatcaattctgaatatcctgattagagggatttccaccaaccaggaaattacatgctctggtatcctgggattagtttaatagaaagatacagtgaaataaggaagggataggtgatttagggtgccctgtttgctttcaaatgcccatttctttgcagcttcatctagcaacaccacactgaaaaagcctaaaaggataggaaaggacctgaattttcagagtaaatatgctctaactaaattgatgtgatatttcattttttgaggtatatttctaactagattataagccaattctgttctcaaaactgttgaaatggaaaaaatgtttaaacttttcttttgcttacaccattattatttgactgtttgaaacttgacagatgtgtgcctcaaagtttctacacatctgtcaaatgttaaattcccttgtgaattgataaccatttttttttgcatttgacatacagattctgtgatgatagttacttttataaaataactatggtctttttataaatttaaattgtaacactgattaaaaatataatgctttctcaaagcacatagcctgttgaataaggaaatgagtgctatctcatgcatgcttttaagaagagtacaatatttttgttatacttgagcttaaaaaccatttctgttgaaggttgctctattagttcattcttgcattgctgtaaagaactacctgagactgggtagtttataaagaaaagaggtttcattggctcatggttccatagactgtacaggaagcatggctggggaggcctcaggaaacttacaatcatggcagaagtagaaggggaagcaggcacatcctacatgactgaagcaggaagaagagggcaggggagacgacacacacttttaaatgaccaagtaggacaagaactcattatcacaaagacagcaccaggccatgacagatttgcccccataacccaaacatcttccaccaggctctacctccagcatttgggattacaattcaacatgagatttgggcggggacaaatttccaaactatattagttgccatgctatctgttttctcagattactagaggatatggctaagcaatacatcaagatggttaagttttcttttccatgagtgttgggaacctgcctgagagactaaaccttgagaaaatttaatgtgttttgggctgtcactaaagtggtcattcccaaccctccactccttaaaacaagataaaacatgacaaaataaaacagaagatcaggcaccaggtaatttgaaggagatggagaaattttcaaactgacattgactttaattgaactccactcaagaatgaaacgtatatactgtaatacttctagtaatgtggaaggaggaacattggcaaattcagtttaaaaacttaagatttttttttttcattttcaaatggaatatcctgagaaaataaactagagatggattgtaaatccaagtgtggtaactggcaaccctccatctctcattctcttgcaatctcattttttaaatgaagcctaagacactaacgtgtctaaattccaatataaagcaaacaaataagtgttttagtgccaggattagtgctaggtgttgcagtacgaaagcgaataggatagaatcatccctatggcataaaggctgggatagcaggcagacaaataataacaagtgcgagaggattgtgtggtggtgtgtgtacacatggatgaaacacctagctttcctggtggtggctattaagctgaagcctggaagctagtcttgcattactatgtccaggactctgttctaacctagagatctaaaaaaattatcccagaattttgtattagctggtatcttactggtcattcaggggaatggctctgattgttcatacgttttacctccaaaatgtgattccctcacttacacccattcaccctagttggttctcctcgaacagagaacaaacagcagagaacaaggggactccttgacagtgtaagaatcctggatattcgaagacttactcttctcagctttattctgcacccacattgctgcatccactcatcccatgcagccccactgctttcttgtgtgtttgtgatacaatgatataatacgaaatacgtatttgatctttgcttcaggttcctgatacagaattcctaaaatgcatggagtttcctgagtgataggagctataaagttgaaaggagtgtcttttgttgttcatagtaagtctctttcaaccacacctgagtttaggttcatgcccatgtgacttttggaaagcccctaaggaggaggggctggttgaccgagggaccaaccatgtgattagagggttggaacttttggccccacccacactctgaccttatgataagaaagagggactggatagagattgagttcagtcagcaatggccaatgatgtaatcagtcatacctacataatggaacctccctataaacccaaaaggacagggtttggaaagctttcaggttgatgaccacatgaaggtgttgggaggggggtgcacctggagagggcatagatgctccatgcccctttccctgtggtttgtcctatgcatctcttccattggactgttcctgagatgtatccttttacaataaaccagtcatctagtaagtaaactattttcctgagttctgtgagctgttctagcaaattatcaaacccaaagaggggttgtgggaataccaatttatagctgttggtcagaagtatttaaggctcagacttggcatctaaagtaggacactcttgtagtacttaacccttaactgcagtacatagtctcagaattaaactgaattgtagaataccttgttggtgttagagaattggtcattgtggagaaaaaacacacatttggtgtcagaagtgttgaaagtgtatagtaaaacagtgtttgtttttcttttagtatttctctggaagtagccattattttataagccaaaatattttttatacttttcacatcatcttttccatgggataatagttaccttctgtctcttgtttttgaaatttttctgtaatctaaacatataccaaattctatctagtccctatttttttcccccttgagtttcacaatgctaagtggccacttttctttcaagttcctgatcatttccacatcctgcactcaccctttatcccagtttgtctgatttaagtccagaaaagtagtttctctacttgcatcatctgccttctttgagcttaaactcttaggaaagtaagtcaagaatttatccaatgttgtgtttttgccaagcaacacttccagatggtgtcctcatggttgaagtcccccaccaccactttatgtacttcttctccagttttgcaatgtctgttaccaaaccacatcctctacctggtctggtagtccagagtgcattttccaacaaataccaccaccactttctctctttttcccaagatgtctccacccttgggcttataatatgcaagacggatactatgattttcatgacgtacatggctctttcttttgagcaaatcttttatcctttggaacaaagttttcattttggctagggtttattcttaacaatagcactactattcaaaagcaaatatttattaagtaaagactatgttccacatttggtgctgggttattaacatcttcaagttcatttggcactaactatattaatgctaacggtaattcctatgatgtagatataattctccccattttgcctatgaggaaactgaggcttggggaagttaagtagcttaccaaaacctacaccattagtaagtgataaggttaggatttgaacccagaactgtcacattccaaagcttgcacttttaatcattacagtgcttcctatctctcattgccttgcaacatcttaaaaataatcatacccccaggcccggagcggtggctcatgcctgtaatcccagcactttgggaggctgaggtgggcagatcatgaggtcaggaatttgagaccagcctggccaatgtgatgaaaccccgtcgccactaaaaatacaaaaaaagtagccggcgctaatgtttttagccacacacctaaacgtgtggcgcatgcctgtagtcccagctgctcgggaggctgaggcaggagactcgcttgaacccaggaggcagaggttgcagtgagccaagatcgcacctctgactccagcctgggtgacagagtgagattctgtctcaagaaaaaaagaagaagaagaagtaatcataccccctaagagcataaaaatttcataaactgcataaaaattccaaagtaaattggctgcttattcaaactttgatgtacagacttaggcttaaagttttcatcactgctggcttccctttaattttttcctaaaattctttgggtacttttaccacttgctgctttgttttatcctccatggcttcaggttttatgattgtatctgagtatttttctcccgctcttccttccaaaattcagtttaaaagcttcttggtgatgttggcaaattagggacattctttcctggcttcatgaaaaacactttttctgtgtactttttcttgttcgagtctacaagagcaactcttagcactatctatgtagccacctgtttgctctttatatccaattttctcttctgaggttatggccttcacttttgaaaaggattagtaccaaagggtatcctgtcactatacccaagcccttgaattttcgtcctagatggcaattagagcagttttcaattctggtggcaacttagaaccacctggtattaaaaaaaaaaaataacagttgtcaggccccatcccagatcaattgtgaatcagtctttggaaataggttttagacatcaatagtatcttcaaattccccagtattttaaaacttctgatgtgcaactatagtaagatccattagcattatgagctttgtctggcaggaacgtttgttcccactcgaacgaacagaagtgggtacattttatgagtcttggcaagctccatctcacaccaagattcatgctgtaggaagacaacatgcctcttagcttggctacagcttcgttcacagaaatgaacaagttccatgaggtttcttttctgactgcaattattaacagcattgtgcctccctccgcaggtctgagaatactcccagagctttgtagtgcccctgtaatcaccctcgatagagagcccagcacctcttgtatacttccaattgcatatctttctccctgtctctcttgacacatattattttactgactcttctcttgtcatttattttcctctacactctccacatctttttttttaaatttccttctaagaagacttccttcttccttcgtttgaatctaggttagagaaccagccttaagtctattcatcttctttagcaggaaacaatcatttagagtaggcccaagctaggcaggaacacaaacaaaaatattatatgtaagacatgattcctgcttcctagagcttacttttagttaggaagaaaaaacaaagggacatgaaaccagcagtcatggttgataagtagtcaacaatattcaggagtttcagaaaaagtgtcttagggaaggtagacattgaactgaacctttcaggataaagtagagaggccactgcaggttgcttgaacaacatcaatgaagctgattattaagcactatattaatactgcttaatatggagaatttgtcccaaggagattgtgagacttgggaaagaagatttagatggggtagggtggaattaggagagaagagtaattagtaaggtggtaagattaatactttcacctcaccccaacccccttattcaaatcatttgctacactctaaactgcaaaggccaaacactgtcttccgtgtgttcctttgcttaccatagtacctaacaaagtatttgtacaaaatatattcatggaatgaatgaattcttctcaacctcatagagatgtcatgaatctctttagaaattaggtgaaatctatgagctcctttctagaaaaatgcaaataaatgcagatgggtacacacacactcacactcacgctatgctgtataattatatacaggttatagaattgaacctttaacataatataattgtaataacacattaggaagataatatctgcctacctatttgaaagcttttcagtactcttagtataagttatgacttgatagtgttttgactaagagaaagtgaaaaaaaaggaaagcaatcttaagaatgaaaattttgatactggtgtctagttatagattttttctttttcttgtctcccctccctgagctttgctagcatgtttttttaaagctggttctcaagcatctgcacttaaccaatttgaataatattcctcaaacaagtctttcctatttattcattattttctttgagttcttagtgcaactaaaccaatcagaaataatggaagaagagaacaaattacaagggaaggcgggtagtggttgtcatcattgttgtttgccatcctcacaactcaggtgtctggaaagtttttagaaccctaccatgaacagtagccaacagtgcaaggtgagaaattcaatggggctatttagagcagacataaaaataaatataagaaaatatataaattcatcaaacaattctgggacttttccaggagtctccctctaataatgataacccaaaacatcagcaaccactttgtctaggctaagcaggtgtactgtctttctggggaagttagtctcagtgtgaaatgaatttattgagacatagtctccctctaataagagatgcattcattagccatacaacgtttcaactaatccttaaaacatccttaggaagttgttctcatttgataagtgaaaaataaaaggctcagctaggttatcatattggcccagggttacttacctattagatggtgaccctgaaattttagtccaaggcaatttgattctaaaggtattttgctactctcactctcctactgatgaatttttacacagacaccctacaaatcccctcccagtcctgtttctcagacatatgtgaccactttagtgagagggaaatttaactggcatagttaccaaccactctagtgttgcaagcaaaatacaagtaaaacaaaatgaaagggccattcttttgcaaacaagtttctttgccattaacaccaacagattcatttatcctagcagacaggaatgatcacgtatatctctttcaaagagtatatccacattgttttccagtagaagaacaatatatattttttagaagatgacctaattgatctattctttagtaatccaggaaaattggattgttctgctcatcggtggaagcgtggtctcatcaacatggctccaggaggccaggaatgaccttgtgttctcttgcatgtggcttgggttaaggaatgtaaggccagtaggaagcagcctcatttgttctttgggactttaatgtgactgtaactttaaaaatctccaatagcagaaatatttttccaatataacatctataggttgagagtttgatatttaagtcttgtgaaaataaaatttggacttgtaaaaataagtgcatgtttattataactctctaggttcactttctctggcaataaccttcattttgcaacactaaactttgttaagcaagtatttgtgccaaccactatgctgaacactttcctatacgttgttatactttaccctctcaacagtctatgttctttttagaaaggatcatgccagtaatcagagcagagtggtgtggttgctctgttaatgacaaatgatttcttttctatgaaaataggttttataatattacatttatgacttttgttatccttccttccaaggaaggataagtgctatttataagaagctctgtttaataatatgaggtaaacagaattctgtttttaaaactgttagaagtggtcgaaggagtttagatactaacggcccccacactaagccaattctacagcacgagagcaagtccaaagtgcatcttaacatttaaatctagattgaaatttaaattccaccaaccagaactcgagctgatatcagtgttgatcatagaaaaagaaatgtttctaattaactaactttaaagccctatcttaatcacttagagcattcttgtgcacatctgtgctgcaggagtaactggattacctccatggtgtgtgtctctgggtgtgcgtgtgtgtttaaagcaatgctataactctatccaaatgcaattcagcactgctttaaagtttagaagcaaatgtgtacttagtaacatagtttaaaacttgaaaccctcctctaccttatgtgtgcttctcttgtaaattgagcttgtttgcggaaggcagccatttcaaatactgtgacacatacatcccagaacttcttccctcttacttcaacctaacctaaatgagcaccagagccagggcctctcatgtggttttgcttcatctgacaagtgacatcagtatctttccatttgccttatttttataaaattgtgcccagaatgaatggtgaggccagtaaaggaacctgagtccgaggagtaatttttcattagggtaaatgaggtgatatgatatacaagtaaaacccgatgtgacaacgtaatataatgctgtgatacaaaatgtttgattctattcctgtgactgttttctaaggcccttatatcttttgcttgtcttgtgtgtatatatactgatcagtggaaacgtaattggtaatcagatatttatttctgtcaatgaatgaccagatggctcttgcctccattggaggagaaccatcttgcctatccaatagctcagggacattatgtataacaaactgaacaggaggatcatctctagcccaagtaagaaactgcagctgcttttctctactttgtaaagttggcagaggatcacaaatgactttattcttattttttaattgaaatagtttgtgtattttccctaccaaagtaacacatgcttattctggaatactatgctgatacagacaaaataggggaagaatgcttacaaatcaatttttactacccatcacttgccgcttggaaatttgatgatggtaatgaggataaaaggctgaagtttatttgagtacatattcttgcctggatgctgtgctaagtgctttacataaattagcttatttaatcctccccacaacccagtaatgtcagtaatggtattaatccccctttgtagaagaggaaactgaagcccagagatgttaagtgaatcatctgaagtcacacagctactaggtcatctagtagagggaactaattgaacctgacagtgagcccccactgatttccaagcattaactgattaactctgttgtatatgttacaaatatttcttacagtcttgtgggttgtctttcagttgtatttatgaaatttgtgatactttatttacacagatgacagatgagtccattcttttttatttatttatttatttttgagatggaatttctgtcacccaggctggagtgcagtggtgcagtctcggctcactgcaacctccacctcctgggttcaagcgattcttctgcttcagcctgccaagtagctgggattacaggtatgtgccaccatgcctggctaattttttgtatttttagtagagacggggtttcaccatgttggccaggctggtctcaaactcctgacctcaggtgattcacctgcctcggcctcccaaagtgctgggattgcaggtgtgagccaccgctcccaaccaagtccgttcttttcttttgtggtttctacctttagcaccatgtttgaaaaggcctcttctaaccctagattataatgtaggaaggagaaaaatatgctaacagtaccagaagaaattagccacaagccagaaagccatagtatcttcccaagttgtcacccacaagaagaagatctgagaatgtgattgaaggcaatggtggaagggaaactaaaacgactccctcattataccctataaagtccaacctgttcaatagaccggttacttatacatctgttcatgccttctcccctctccttcaggctcctgaagtagggactggactgggaggagggatgagagaaaaggggagtacgctagttacatagctggtactgtttgagggcctctcttaggtgtcagatgcctgtggttgggtcttttgtgtggcacttagttatgttcttttgagacatacctgtggagacctcatacacagaggtagtacacctgtcatggataagaccgtatctgggtgacttctaatcacctcctattctcaggtcataccctacttgcatgtaccttgccctacaggcccagtcttcttaagcatagtcctttcaatactgtgtaagcctagctccctccccgcaccactaggcccacaggaaaacacatcaggcatcttcttccttacaaacggtaaaaatagacactacttccattgcttgcctttctccttgacctgccatgttgacaactttggtcagtatcctaccttcagaatctcaaatcagggccatcaccatgatctatgccccatattttagggggcatgcagtaggttctcccaagaattctgtgctctgtactaggagtagaaggaggcaggtgttgagttttggctgtttggcagccatccagcttggggaaagagatgccagcccctctcctggcagatatcccagtctctacccttttcttatataggctgttagagagtgatggggtaagagtattttacagataatatttctgtctttagcaagtcctgcagaggtgtgcctagcacctctgtttagcgtttgcaggtattaatcctcagcattagagcctcagctgaaatgccaggatgataggaaaagtcccattccacatcctacgataatggagttatttcgtgtgatggggatatcatgtgatagaaggattctaatttttttctttcaaaatagattgttagttatcacagatgctttctaattggcatattactttttaaatagtagtccaagtcatcaataaattgatattcatttcttctagaagtataaccccattacaataaaatgaaaaaaaattatatcaaaggagtgttctatgtagcaaagctatttctgtgtcacagtgtgtagtccttcaaagcagtattttgttgatcttagtgacaacaaattcaatatatctaataatactgcatagcaggtcttcattctcttccctgttgatgtgacagtcactctttaatgaaaccttattttgtataccatttgcattgtagatcaggaatgaagagctgagtttgcttaagcaatagctgatctgtttatactttttatattcttccatcaagaaataattacccttcaaccaaccttacctctttccacttcacatatgcaaaccacctaaataaaacatactcaaactcccaaaccacacagcagtatacagaagcatccaggacccagaaaagcatagaatagtgtatacataaccttttccacttcatcataccaaggcattcattcattcagcaactgtatagcgagcatgtactgtgggccataaacctgctagacaacagagttgattttgctcatttatttaccacagggaagtaaagaataagatttgttttaattcgagtcctataaaattggaatgttatttctggcttaacaaagatattgtaacacaatttttggtatctcattgatttgttgcccataattctctgttggaatacatctacacatggattggttttaaatggccttcagcagtttactgcagggccatctggccatttgctgtctgtattcccaaactaatatctagttctagaataatctggcttttgacactatgaggactcagttataccctggcatacattactgaagtgttaaatgtgtataaagtacagcatgtattgacagttcagatgatatacactatactttaagatagcccatgcagactctcaatacatctaaataatggaataattacctttttcagttacaagaaatttttttttattttctatgagaactccattgaataataccttttctagaatatttattatatgattaaaggtatacagttttcatttatatctgttttagtatttatagagatgtttgtgcatctttgtggctatgacccacaataatattaacacaaactctgaattcatattaagtctctactgagagtatttgcccattttcatgaacttacttttcaaagaaaaaatatttcaaggtggaaagtaaaaaactcttctgcaaataatgttgaacctcacaataatgttcactatattctgaaagaagaccatggattgttgtgatctgtaaacaaccaatgtgcaaaatttttttaaagctcagaagaggggaatttggccatagaatgttaaaaggtctgatttttcttctaattatttttcccataagagcagagatttgagtttgcatgggcactctgtaaatacctcaggttgcctaagagcttaagtaaatatcttagactttagaaaactacttcttttcttttctttttttttcctttttaaggaagaataaaacctggattcaaacctctttccattggctcactttggtgcatcaatagctcttccaagtcatgctgagtaatgcctaaaagtgaacttgtcaccttcctcacctattcacaaaaccttctgttctgatgtgtcctatccattttctagtccaaaagtttctgacttttagcaggtcagaaactggctctaacaacttcctataggattagattctcacgaacttcagatactaggacttctggatagagaagataaagtaggttttaaaataatggtataagaaataaattgaaaacatgagaaataaaaaatagaccataaaaaatgcatattttttgaaggactaaataggatttttatatatttatcaaaattaactcagtggacatgctaagtattacacattgataaagagagaattgataaagagaggattacattctcatgcctgtaatcccaacactttgggaggccgaggagggcagatcacaaggtcaggagatcaagaccatcgtggccaacatggtgaaatcccgtttctactaaaaataaaaaaattagctggacgcagtggcgtgcgtctgtagtcccagctacttgggaggctgaggcaggagaattgcttatacctgggaggcggaagttgcaatgagccgagatcgtgccactgcactccagcgtggcgacagagcaagactacatctcaaaaaaaaaaaaaaaaaaaaaagagagagagagagagagatagaatgagaattggcaacctagaagctagatagtaaaaacttaaaagaatgtagcaaaatggagaaagaaattgaaaataggaaagatgttgggcatagtggcatgaatctgcagtcccagctacttgggagactgaggtgagagaattgcttgtgcctagaaattggaggcttcattgagctgtgatcataccactgcactccagcccgggcaacagagtaagaccccatcatatatatatacaaattaaaaaaaaagaaaataggaaagagatattaagatcttaaaagatgagaatccaacatatgtctaataggagttccagatggaaaaattagaaaaaattttaagaggcaatattcagagagatttttgcacaatatttccagagattacaaaaataatgaatccccaagataattcatgtatttagttttaaaacatgagagagtacaacaaaaggtttataataaaaagcaaaatcttcttcctcagtcctccctacccccctgccccataccttcctcagaggctacactctgacaaaattgtagtaatttcttatcttgctatttcttgatttttttttaaatgtgagagatctgttgactttcctgcctttggaaatgattgtgttagctctcttttataagcatggacgcacacgcacattttccctcaccctatttttccaatatgagtatatctcaacttttggttaaataaatattctgtgtttacagcattattactatgtaaaaagtgttccctgctgagcctcattgtgttctatgattagatttcctttcccaaataactcttcattttttcctggagctaattattacattgggtttatttgcttagtttctgtgtcactatcaacaaatccattctcaagctctgtcactgtcactaattcatctgctcagtgttggccacattaggaaacctatcatttccatttttttcttggatgctaccttcctggaggcctcaattctcttgctcccgtttgttctatttgctctttgggcccttgggtcaactatgtcctggattctgtgtctttctcttccttggtttacttttttcttatagggagcacatccaccagtatcttctcaagaaaaagggtacgtaagagacttgattgcctgaaaatgcctctagcctacctcacatttgattgatattggaccaagtattgaactcttatttaaaaatcatttatttcaaaagcttgaggtcatgttccattgttttctgctttttagacttttctgactccttgcatgtgacttcccttgctctctcacctgaaaggtattaggactttctggtttacctctggtattctgaaattctataatgattctacttggattgaattttggttcctttattattctaggaactcaatacatcagtacaaataaatttcttatatttttttctttgattttcttcccacactattttctcggtgttcactttcttcaactcctaaattgaccttattttatctcttttcccatcctccttatttttgtttttgtttttgttctgctttctacaagattttctccactttatcattcagcccttccatcgattatttatttattttttttttagttatatttttaattgcaagcactctttattgttcttggatgtcctttcttactgcatttgtcttttctgccatggatgcaattatcaatgtgaatatttcttataggtttttttttaagttttttcctgttctctacattgtctcagtttcttccaagtgaaacaggaaaagttcccttgttcccctcccagggtgtgtgatgggggtgtgacttgctgcttcagcgccccactgctcaaacctctaggggagcatacagacagggagactgtgggggtctgaccccatggcagtatctaggcatgaatgtttacagctgaagccccaatgggcatgtgttacagggtgctcttttagttttgctgtctataggtgccttgttttaaccagctcaattaaacctctaccttgtcacaaggacagagggttttctgtatcctgggttctttccttggtgtaccggaagaatcggatcatacccagtgcctgtcagtacattcctctggatgtccagccacccgtgtgttcctcccctgatgtgcttctttcaatattcagccgcctgtgtgtctgcctgctggggtctcagggtttttataggcccaggataggggcgtggcaggccagggtgtcttgggaaatgcagcatttaggcaggaaatgcctgtcttcacctaggtccatgggggtggagccctagccagggaccccaccctcccctacccagcacttcccttcccccattccctatcatttaaagggaccatgctcttccctttccagcacttgcatatcacaagttcctttcttatgctttgtcttgtttatttcatgttacgagttttcctcaaatgtctgctggttcctggctgtccattcatatcagagagcaagaactgcgacggatgattagaagttctctgttcagagacagcgcttgttgactggtgacctttctcatggaatgaacaaacaaattcaattattttgttgtggcatccccacatttcagtttcactaagtcagtttagttagtttccagagaaaggctcttataatttcctagaaggtgaatctccagctctctgggagccaaataggtgaaaggttctggagaaacatcaccaatgaatgggtgtactttcacttcactcacccttgcctttggcctcccctggtctctggtttaacccctcaagttaggaagcatcctttctggtgttgaagtgggagctgcataggcttagagaagttatcaagggggttgatttctctctatgtaaaatcactatcaattcttctgttttcagtttcgctccacaagtgtacctctatatagaggaacctggactgataaattcctgagcctttccgagtttctgtggaacacgcaaccttcttcttgtctaaaactacatacacacacacacacacacacacacacacacacacacacacacacacacctgcatgcttatggacacattctgcctccccctctctgctcaaccaccgctcatccatctgctttccatcttctgaaatttggttcacattcttttccattgcagtccttcccagtttttcattttatccttgtatgcctatgccttttaaataaattccctaccattattttagtaggaattgaaaaggcaagggaggattgaacattggtgtttgctctagcatgtttgccccagtccattcaagccgtatctggaatgtttattcagacccaatctgacccctcacttgtgtcattaagggcagaaaggcctctccctgcttatttttcaggcctcatcttttgtccctcccctccccacaccttcccatctatctctgcccagtcaatgctctggccatgttttgatttttatctctggaccatattctctcttgccctgggctttatgcacatgctgttactcttagcacatcccagctcttgctcccatacctggctaacttgtagttatcatggaggtcacagctgaagatcagcttctctagagagccttccctggcactaactccctttctagggctgggttctcatcttgtatcacctaattctttcctgattgaagcacctaccacattatatgttccatgaggacatcttagctaatttacctggcacataataggcactctaatttttgttgaatgaggaatgactgtttctttctctgaacctttttcactcagtgttttcactgagtatttgctgtctttgccttcaagccttgcttatattgtagtaatgagtaatggcccagcaagtcagatatttcaaatttatccatctgttttatttttactccctttttctgaactaagaaatactaaaatgtgtagaaaagctgaagtaagtagaagtgtttatacctcattttgtatacttacaggttttatttcaaatgtaaaattaacaaaattatgtcttccaatattaattctggatgaggtcagtttctgtggcttaaaaattagatagcaatataatcaatttgaattgaatcaatacttactgtccgaacatttaatatgggagccaaaagaaaaaaaaaagtggttatgttgaaagttggctttgctggtaattttgatatattcaggttgtggataggcaaatgaaaaagaaaaaaagactagattttttatgtccatctgttcatgcttcagagatctggaaactgaagttttaaatttcctggttttattttcctggtttatgcagttttaagaaggaaaatgacagaatctctcagaaaaatgaaggaatataagtaaagacaaggaaaagtaaaaggtggaaaacagtatcataggaaagacataatagaaatggaggaatatattaatttaattaataacattggacctttttacagttaatgtatctctaggcgtgaatacaattctttgattagtatacaaaagaaaagaagataacattaaaagtacctgccttaagtggatggctaaagtataagaactaataagaaaaatatgtcttgaagaaagcatgggtctctagtttataaaataggctcaattatgaaagggccaatggagtcttggactagagtttttagaatgttgaatgtttctctagtaacgattaaatgccatgatgaccttcaccactattatcaatataaaaaataatggccagtaataactgagttcttaatatgtgccaagcaacatggaaacataattctgcaaggcattgttactattatccccattttacagatgacataattgattcttatagaaaagacttttctcaggtcagctaaaaagtgacagagcccttaatttacaaccagtcaatatgcctagacccctttatgccattttgcctcataacaataagataatcattagacttgattagatgcttaatccttacctctgtgagaagtccaggactagcctcattcttactgtacagatgagaaaactcaggtttagaaaaattaaatgactttattcacaaccaaattttaaagaaaaactcctttcctgaaacacaaatctttaaatttttttattcattttaattttttaaaaagtaacatttgggccaggcacagtggctcacacctgtaatcccagcactttgggaggccgaggtgggtggatcacaaggtcaagagatcgagaccatcctggccaacatggtgaaaccccgtctctactaaaaatacaaaaattagctggacgtggtggtgcatgcctgtaatcccagctactcaggaggctgaggcaggagaattgcttgaacccgggaggcagaagttgcagtgagctgggatcgtgccactgtgctccagcctggcgacagagtgagactctgtctcaaaaaaaaaaaagtaacatttggctttagaataaagttcacatacattttctcctttttattccccaaattttctcgtcagttttgatagcttgttcatctttcaaaatagtatatttttgtcactatcaacataaatatagtatctccttctctgttacttttctgatactctgttcaggaaatttgacccatcatagtgttgtcccattgccctttttccgccatagtattcagtaaaatcatgtcatattccaaaggagactctgtaattggaaacactgtcctaggggaattcttatatttgtttggaaagaagaaagtaatcctttcttcaacagcagtacgttttcccatcctattttcaacctgcaaatgatggcttcccctaaaatatcttggaatagaacacatgattagagaccatttttagggtttccatcaatgctttattgatactataggagacatttaattccaaaggtaatgagaacacttgtgaacaaggtaaattcttacacagaaagagcaaatgtacgtgggaaacagctatttcctcttgcttggaagagataacttctgatccatattgggaaaatattttattgtcctatactatcatcatattaagtgaggtgaataaatagaagcttttgaaacttggcttctgagtttcaaattgaaaaaatgatgaacaaattattaagtttgaaaaaagttaggtcatttgagtgatagagataacatactttagtaaacacagtttagtttaaagattatatgggtaatttacaatttggggggttaacagaccaaaatcagtatgtatgaaatgtcactatacgtactgaaagcttcattgtgcagatacaacctcttgcacatagaaggatcttaaatattttttgaatgaatatttgctaactgagtcaacacagtgaatcgttcactgactgactagggaatgtagtgttactcaacgtggcttaaatatggacatcatgtaggggagcaaggaatggcaagtttacttagatttagtcagctcctactacacgtcacgcccgacacatgttctcctttttaatgctctcaagaaatttacaagcacagatattactatcctattttacagattagaaaactgaggttcagagaaattaactgatttgaataaactccaaaattgaggaagtgccagtacagtctctgtaccaacacagcctggattctcaccacttcaacataacctgttgcttgagtggagtaacttgaggtgcttcacagagatttctttacctgtcccccaaaataatcttcttcacaggcttactgtggtacctgaacataccccatttgtgattacttccattgaattaaggtattgcctctgttgaaaggtataatgcattgagcacaaaatatgatgagtgcattgtaacaatttaagattagtttccaacaagaccaataacagagagcccagcatgattcagagctggatccaaaatgggacatagtttcaaggtaggctgcaaggagacccatagtggcagtggtgggtgaggggagggtgggtatggggagttacctgggcactgagaaagtagtataaagaccttaggaaattgaccaccagtgggcagagaatgctttaaagtggaggtaggaaaataaagatttcctgttttcagtttagcctagggctctgccaaactgtgttgaattactagagtaaaccttgtgtaaacgagagagttttgttgttgttcttagagagctctttttaggggggagtggggatcgtgagaagtgagtgtacatatgttagcaaggatggctctgggtttgataaacatttgttctggcaacatgtaaggtagcttttcttattctcatacattcataaggaccttaaattttctgcgtgggaggaatatatcctaaagggattttataaaattgaataagacaaactgctcatactagtaggcagttaaattagcaatgtatacaatctaaacactttgaaattaaaagagaatggggaatttaggcataattatttaagttaaataatgctaatcacataagtggtgttgccagaagaggccatataagcaaatggtataaataaggttatctggaaagtgttagattttcagaaatgactcatagaaatggtagtgggaaataaaaatataaaagaataggctgctggaaatagaaccatcttttccttataacagcccatatatatcccagctattgaaaggacagacatcaggaaatgatgcaccttttaaagcagagaagagaaagctaaagcttctctttttaacaatggaagattctcttttcaatggaagatgctgtctttgctgagtgtcatatccctgggaccagacatggctaatgaggtcagtctgataactagaaattttctttccatttcagcatgtattactcaggccaataagtagggtttgcttgttaattttgacttatagctagtctctgtggatcctgtttttcctatcttatcgcagattcctcatagttcaagcaagacagtcttgctcagtatcctctcacagaatgctgtatttcatgttggctttaaaagtttgtaccatgagaagcaaaatttcaggcatcaagcattgaatacttaacaacatagcctcacagccacggttgggctagcgggtattcccccagagcatttgtgcagtgtgcatcatgattggctcatctgtgattcaagtttatttaaataatgttctgccagagttccttactgaaacatccttcatagacatgtgccacctattttatgaatattagctgttagccattaccggtaaagaagagcatgcagccatactgcagccgaccagccaaggataagtgtgtctttctgtttaatgttgtggtctccaaacatctcattttaaattgggatgggtttccttgcttttgattccattatttagtgaagatagtgtgacggaggaatgggggtgtctgtgtacgcatgagaatgccatatcaaaatttttacttttatactttacaggttatataaatctgctcatcatataagtgatatattggacacatgtagggtagcatgattttttaattatctttgatatttgcttatgtggctagattctaaaaatgttaattttataattaatttccaccacattgtttggcaacaaggaatagtttttgttgtaaatcacccaaggccttagatcgctgaactgcctcaatgtgccttcccaattagttttggaaaacttatttattttaatttctattttccttctcctcaatttggtttctatccagggatctacagaaatcattttgataaaaactgttgatattttttctgctgtcatccatattagccttgaaccatatcttctgtcactttttcactgattctcctgctttcttttagacgtccttttgtctactgatatgtcacattggtgtatggcttcaagtttggatttcatcattttcccacataaatgtatttctcattctttttgcaatctctattatataaaatatgccaccgcccatctggctgccccatgcttctcagactctggctgtgcacctcctagggcctcaagtagtatttcccagagtatcctttgttgaccattaattcttaagctgtgtcctgcaggggtaggtgaggaggaggtggacaggtttcttactccagtaagcttgggaaacaattatcacatccccatcacatattaggtactcaataggtacttactgaatgaatgagttaatgaatgaacatatttataatatatagtaacatgtactttgggaagttaatagtaaagaaatgtttaactttatttaacttagcattttccaaacttgttttcccacaaaaccatctctggtgcaacatctacatgtgtcccatggaatcagtgttgcacaaaacacacctgtgaaacaccagcctgagggatacaacgctgtggctctactactcctccctcccccaaacccgagctagaatgtgagacacgctgaacttcatcaactccctctctccttgtctgccccatatgtaggccagtttccttattccacttactaacaccctcatatctcttcactggctcaaatatggaataatcttgtatcagttatacacgctctctctttctctttaatcatacactaattaattaattttcacctgctatcttccaaatgtgttttgagaaacaggatgactaataatctctgtcatatggacttttacccttgggcatttatttatgagattctgtaggttgaacttaccatagtaagtactttttattaaaatctctcaaaaagacagttgtgaggagtgtattccaccatggcatgtgtttcagccatgatattctattcaacggcacatgaatcaacatgaatgtccaaagttgacttgttttgtgttaaccttattgcctgccttctgactacctctgtgagtcaactgcaagtactctagcctctcgactatagcagaaataagctaaggtgcccagagcacttcttttgcttaccatcaatcttagtggcatttaaaactgctctcaaatctagtcttttcccggctgatatgaaaaaggcaaaggcctttggttattcctacaggtcgatcttaggtttgtgtttggacatggggactgtggtgaggggtatacatttagatctagaaagtgcttgttccagctgtgtctttaaacattgcccaacatagtactggggttttgtggcaatgcttctggaaccatactggcggacagaggtgggaaggaaaggagtctgaggggatgggcagcaggagaggggctctgtttctgtttcacatattggctattggttggaaaggagttgggggtggagatcccatggctaataacagattggaaatgattatggcaatccgaatatttctaaagttagaaataggttctgatggagtttctaagagatttggaaacaggaagaagcattctgtaagatgggcagtagaatttacttaagaaaaatggggaaattattaaatgggaaacctgacatatgtggattactgtttttcttctgaccctttcttttctctctttcacttcttacctcgggaccttttctcttctcattagcacctccaccagagttggaactgggaaagagaaaggaagtgttcagacatgtgcctatttgcatagtcacgtcattgaattaatgccaggacagcacaaacattctgtccagttctatagaaaagccagtttcaccccatcagtaaggtattatttccttttttttttttttttactagcatagaacagtttattgccaggcttctcttaactgtacattataaatagtgtctgattaagaatgttctggatgggttaattagtgtggtgactattattaagcaaactgcttgttagtattatgcctatttgatcttggtattgatgtgaagtaattgaccatagagctacatttagaaaagctgaaataaagtttttttgatttctattatagcaataaattgtttatattaaacatgtctatgaaaatatgagtttcatgacacagaatcagaatagattgtgtgggatggtggatgtggttggttttgttttgtttttagtattattaatacatttgttcagcctaattcaagactagctttattgtaacaaagtagtacaaaagtgtttcagcttctgccttcattcttaccacagagtgtatgaaaactaaagtgtttttaactttccccaactaaaggatatatcctgttagatttggctaattgcctaaatacttcttttggtgacaatcactataatgaatagattataagaaaaatttgaaaagatactataaacaaggaaaccgtagcttgtaactaccttctttcaagtaccggattgttatctatattatttattggtagcttgtccagttctattattaaggtttcctagctgtagcatttccatagggaattgattccatgagctaataaattacaccgtcagggagtttttcttgaaattcagcttaaattttcccattcttaatttcatcccgttactcctggttatacccccttgtaccaagctaaataattattctttttccttagagactcttattatgtacccttctgtttgtcacttaaccaggctattcatagttagctcctttaatctgtcctcataaatcaattcttccattgccttaattattattattgctcttctaaacactctctaattttcaaacatatacagttctcaggtgccccagatgacatcagcatttgcacagggttctatcctgacagacttagtgtcttccttccctgtacaacaagatccagaactaaatggcatcagttcgctgaatcaaatcagctcttgctcatcttgtccaattcagcatggtctaaatggtgttttctatgtgccctacctccattcaaggtttattttgatttgtttcaattttgtgagatttgtaagctgttttgattgctgcccctatttatattctgcatctttccatgtccctattcactatgacctatcaagtcagtcatctgcaacttgtcttaacatgggattctattcatccttgagaacatttagggaaggtgttgaataaaagtaggcctcacacccttgcccacagctaaattccttgtcagttaccaattcctgttgtttacaaccctttagccaatctcccatctcttttaatttgcaattttgctcacatgctggccaatataaatgaattttatgagtaagatgggtcatgatactgttttctaaaatgaaaatatgttgtttgaatcccatagattttttttttcttttttttttttttttggtgaatccttcatgagctaagtttgtgattctgttaaaatccttattaagcttgcctggcactctttatctgacataaacaaataggttacttcaattgctttattgttctccagatatgtacagatgttccttctcttaccatttgttccatttctttaggagaattgaagatagtgtcatagtcattctatttttttaccttttctggtgatcaatggcaattttttatgttgtgttttagtttctagaatctcttcagtattttgaatttgtttccagaagaagttgattggttcccaccataatttggggcctatgcagtttgaaactatagtctgtaaatgcccaggtttctttccattttaaatcaaggactaaatttactattttattagggcatatttaaggggttagtaccattctttgtgttttgtctttctgtatacaatcatctctttattacttggggagttcttatgtatttgtttgagtttcctcaaggcatttgaaattagaatagaaatttaaagatctttatgaaacaaacatagaagcccccaaaacaagctttctggttctggaatgtacatagggtcctacagccaaagaccttgtttctagctcctgtgactcctccattgtttcttagtgttgcctatcagcccttgctttcagccctatttaacgccctctccctgtctccacagtgactgtcctgaggcctcagtgagtttctgaaagcctatctccacctctgttcacctcactgaaatagatgaactgacctagtgctttaatgaggcaactccttagattctacacctgccacctaaagctgttttgttttttcagcttcatttctctctttttccctcagctttgcaagaaagcgaggttcactatctttacaagaccctgcttgcttttcccctacactatgatcaccatgttataatgtttttctccttccatcttataagatttttctgtttcttcaggatcccgcttccttccctagcaagtattcccaagtgaataacactgtgcccatgtgcctcatttttaaaagtccaaccttgccttcccctcccttctctctacctccttttctctgcctctctctttcatacacaaaccctagcctcctgcagtctgatttctgcccacaccactctttcagcaggagcagagagtggcctgtcgaagtagccagtgacctatgatgtgacaaggccaaaagcttcttgtttctgctttgtagcacctctgcagtgttttatgccccattttacacgttctttgagggttcttgattcatttcaataatgtgatattactctcttggattctcttcctactcttccagatgttcccttctgctctccttccatggtttttctttttcacctacctctgaaacccatttcttcccctacacaacaattcagggaggccaagtttctggatggggctcaggaactctgagaaaggacttggtagtctggcccagtctacccctctagaccttacatccagacctgcatcccagtctctttgggttgcatgttatttcctgaggagttgtatttcttcacccctttttcctttgatctcatattctctgactccagagcttccctgactctgtcttgcaaaatgctttacctaaagccttctttaagcctttattgagccccaagtcagcattaatctcttcccctccattaaaaaaaaactggaatggccattgtatgtatagtatgttccagcgtaggttagttggctgttcttgtgtctgtctcctactcttctctaagcactaatggtttgctttccaatagacggtgagctccttgaggatagcccctctatttgtattatgtggcttacaggttttaagctataattttttaaggtttcattttattttgattctctatcgataagtaacagacattgaactctttgtgataaagtgtcctggaaagataggagagaaatgataataaaaaagatattaaaatatacttcaggaaacattagccaagtcaatttaatacaaagtatattcagatgcccaggaatacagaacagtcatgagcagaaatgaccagtgttaatcaaggaagtttcaaacatttttgtaggttaatgaacaagtatggcctgaaaataagcactgggccatgtggtgattggaaaacacaaaatggaaatccagaaggatgagtgagggaagagtgataaaccatctctgtaatcttatgttttatggtatgtgcagtgcaagttttatagccatagaaactctttggaaactattcaaagacagcccagtccaatttcaaacttttgaacttctcttagtggctactactttttacactttttctggaatttttgtataacatctttattttttctcagttttatatataatcattatgtacttacaggaaggtaaaggacaaattttacatatttttttccactaaaagtatattgcattctttttttgtaacagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggtaagtcaaggcatgccaatttagtaagagttgtagaactggtaaaagaaaatatattctgttgattgacataataatttgttcttcttattgctttagaaaaagattattttaatgtggtggtattactaatgatctgccaaggtggtactactaaatatcttcacatgaatggtcatgtgcttagattaaatttgaattacaggtaattatttgctgcaatttgctcaactaacagtagtgggtaggcacttctagcatatcaagtcttgttcagaaagtttcaaaatataagaatcagattccattttatgcacacacacacacagttatcacaaaactatttcatatatacacactgatacagcaatattaccattaaagcaagaataatttccattatttactaccttgaccagtttcaacagggtggcttcattttacttgtcataagatgtatatcagtacatttgaaaccattcccttcactcagatgcctctgtattgtgctaagcaaaatactttctagccaagtcttttctaaacagaggaaaatcaactgcagtatgtgatctcaccaaataaaaactcaaacttaaccctggctcctataaattaggatttaaagaagtaaaatgtcctgataatcttctggtattaggcatgaacattttaatctagtttttattcctcccagttagtttaatctgcatgtggcctgattagagtacacttcccccacagattatggtctctttattgcagagatgctaggctgatcattaggtccgattttctgagagcaaccgtttgcaggtgaagtaataagagcaccacaccggccgggcaaagcgcctttgccgaggatttgccttccagcacattaaaactctagaagctctcccagttgatctgcagcatctggtacctaaagggattttcatctttaattctaaatgtatgaacgtaaaatgtagggattgaaagttgatgtggaatgtgtttttgaatttgtttgtgcaacttcatacttccagcatagcctttctaaggtagtgacaggtatatttaaatcatattttacttcgaatgtgacagagttcaatattatttaatgtgattttaaaatgcagtgggtctagatgagattaacctgtttcaaggtaaaatagatgtcatcatttactcccttctgaaaagctttttcttttattccattaacctttggttgtctctgaagtactatttattgcaggaaaatcagttctaaaagttggttccagggtatcatgaaaatgttaaattaaataatttctagtctgcttttacaaaacagcaatatggaggaaagagtgaaaaccatgttattcaatactttgcacaaaataagacagagctatgttaataaaattaacaatactaaattgaataattccctgtcttcctttgtatatttttgctttaatttaatttaattgcctaaagttagttgcttaaagagatgcagcattatgtttgtgcatattcttattgttaaagctaaattatttttaatttggagaagagggaaaaaagccgcatcaacaagagtaaatgccaaaatataaaagtaacacattcatccttacgggtaatatagtagaacattggaaacttggaggttgccagacacatagctaacattagggctaattttgaaaatctagcgtgcagtcaattttactgatgcctggggacatacaaggtagaagctgacaagagaactaattttgtttgggttatttactgctatgcatcatccgcaggttcccgcctgacacacagctatatgaagggggatattatcacacactaaaaatttatgttgacattcgatatttgttcaatatgtcaggagtattactttcataatcaaaagagtaagaaaaagagaaaagaaaagcactttatgctcatatagatatatctttttaataacagtctataaggttaatatagtttacctttgagagtatacaatgaaaacaagcagggttaggaggggaaatgacagaaagcatcaacccgagctgtttgtttgccattacctaagcgagccatgtcagctctctggcccgcgtctgatagctatttgttgtacagagagcacagcataaaaaaaatatcaaactcttaatactattgtgtgcccataaccatctgtcactgctagcctggagatgagaggaagattacgaggaataaacactgagccgccgagcattggtaaagccttcgggcaaaaaactcttgtggggacatcaaagacattctaattccgaggcagtcaaggattacagtgtgtaacctgtgctgacaacagataaatgactggcaatattgtgccagagctgttgggtcctgcatggagtactgatgatgatgatgatgatgttatcttgcagaatggactctgctgggataattttatgataaaacacttttttcaaatgccactgggtctaggcagacatttactagctacaggggtagcaatcagtttcttcaaaatttactgttctaagcccattagagttccatcgcagcaagactcttcaatgaaaatctaaaacgcctatattttctttaggagaatttatgcaaatgttgtgagctgaactcctaccctttagtggtagatgctttatcatctgatttatgtaaatttgctcataaaaatacagtttatttttaattggtgaatatgaattagaaaattaagattctggttcagcattcatcaaacatccccagctacaagcacacatttatttagacccctgatcgtatgggtggaaatcgtataattgaccagtcaaaatgaatggtattcagaaggaaactatggtttctactacaaatgaccagggttgtgtttcttgttcaacccccttagtttgagcctcccccatccttgtactttacatattcttgtcagtattttgagctgctttaactccctgcttgaaaaggggggttttctttacagtagcctgcaggaagctctttagaagcaggaagtctgttgcattttcaccttggccatgtatctttaccagagagaaggcattgatgattgtttccatgtaaacctaaaggagaaaggaacactggagagggcaatttggattcttagatcttgtcattaccttgcctaacaaaacaaaaataaaaccctcctctatcataaaaaaatatgcccatgaaatcatgcagttgcagtagccaactctaaaaatgaagtgatgctgacctcattgtgttagttccacactgggatcatgaatggtctaaaatatagtgtcagcctctaacatatctcgtactaagccaaccaaatgtagagcctacttgctagaatatgtatcaaaatcaaaagtgacattttctagaagacacattctggctttaaatctgtgttaaaatgtctgtgcatgagaacaggcccttaaatgcaatgcttgcccctctcctcattctttctcaaactgagcttgtcaaggattatagtgtgcaacatctgctgacagtagataaataactgacagtattttagcagagttgctgggttctctgcagagtaatttgttttctcctttctacccagtctttaatgttttgttataaacatctatagcaaggcacggttagtagaaataacttatagagaaagacctgtaaaaaacaggctgcaattggcactgcttggtttttttttttttaactattttctttccaaatactatacaaatgttgtaatattaatccaggttccaacctttatgtaagcattctctaataattattataaagggcataaaagacacactgctggaaggaccaaaaaaaacaagtttagactatattgaaagatcactctctcaaggccacagttctcaaactctttggtctcaagactccttcatactcttaaaaattattgggataccaaagagctcttgtttgttgggattatacctatcaatgtttactgtattagaaattaaaactgaggaaaaagttttaaaatctacattatagcctttaaaataacaaagaaccaaatatatgttaacataaataatgtatttttatgaaaattaactatattctcccaaaaaaatcagtgagaatagcaacattacattttaaaaaatctataatgtctaagtagaagatatttggattcttataactgcttaagtgtttaatttgttgcaatatcttcttttggtagaagtttatgaagaaattctgcctcacaaagaaatatagctggaaaagttgaatgtttaatgatttcttcagattattgtagatattcttctttgatactataccaaaacttgacaagtaggagttccttaaaggtttgctgtaatgtggaatatgaaaccacataaatgatttcttcatgctccattacctgcagtttgaatggattttgtagcatcatgcattggtgatttgggaaacacaggttcaccaaattgaagatcttctaaatgttgacacagttcattatacaattttaaaaaatcatatttgttaatatcaccattgatctcatagacatttttgaataatgagaagctgtcaagctaagattttaaatgcaatttttcaaaattctaatgttcccttaaaagcttaaatttatctttgcaacaaatattatcacttgtttctccttgagtgacaagttcacatggttcatgtttgagaaaatgtctgccaaatagtgaagtctgattaactgtggtttatctgtcagttgttctttgaaataaactcactgtttcatgaaaagacaactagtttagcttacaactcaaacaagcatacaaatacttttcctcaggacagctattgtatcttggtatgcatgtgtgtttctcattttattacacagattattaaaagatatctatcgaggggatgaacttaaataaaattaataaattttactgcttcttcaatgacatgcttaagtaaaacagacttgtttgtgccattgccttgaattgtgttaaggcaacagcagctttattcaccattgttcttgcactatcagggcctatgtcaacacagtgaaaaaggcaaattacatctttagttatccttatgaaaatagttttactttgcagcctccttgaaaaagtcttgaatacacccaggaattcagactactctttgaaaactactgtcaaatggaatcgatgtgacgtaggtaaatatggctgccaccagccattggaattgcctaatttgtagttctcatagactaaatttttttcccctgaatattaattttttttttttggcttaaaacttgacagtgaacaagtgtttatcttatataagtcaactctctcagaccaaacacaatttgcctcaacatgggctaagtagctaggaagccctaggatacagatctatgatataagaaattctgctctgatcataaaacccctgtaattggcccataattggatgcattcttgttaagaagaataaggagtgggccatgaggcatgttaaaaagtttgaaattattagagtagctacagttataagttctaccatgacctcatcatttgggatatagggaaattatcaaagctcttcacttaaagtagaatgactttttatgagctatacggtatttgcagcattttccataaaataatgataaatcagcttatgcaaagttgatataaagagtgtgaattcagaaaggaaaaagtccaatcattgagaactaaaagcagttttgaaacatacttaggtgagtcactgaagtaaaacatgtaccataagattgaacgactttgacatctatatttcaagaaactttggcaatttctaacaaaatatatgattgatataaaatggaaaattatgctttattacttggtactaaaataaattactctgtttcaccctttgactctctgaggtttaaaaatataacttcaaaaacacaatcaatgactagtcttctgaaaagatgtgttttggatgattagaatgatatgcttttcaggtcagaataaacttacctttgttttctcattgctgaaataacttaggaaaagtatggtgagtaagccatcttaaatctttcagcctttactggtcattaccttataatagaatactttgggaaggacagaggatggtgtggggtgaatagtacttttggaaatcagtcttcaggtgccatgctaggctgtgaacagaagggcaaagtgctaatttttggacactaatgttctttgttctatttcaatgttatgtgtaaatctgtttttctaagagaagaatgatcgtcacagaataatggttctggaaaagatgttcacgtgctctggccatctgcttttcagcatactccaccaaaacttcctcatgcctgtgagaatccatcttacgtgttctgatctctaaaaaagatgattccatagatgctttccattagcactattcgttttcacagttaagtaacccttataaggttataagacaaatattccttataattattgtaagtagctagttctcagattgagtaggaataatgaccaatagctctttgaaagggatcattcaaccagttctgtgtttatccatcaattagtcaaagctcacatgaaataataaggttctaattatttatagtcattctcaatttggtgataagttttctttagttacatttttcatgcctagagtgtttggggaaatttgttggttagtttgtttggttggtttttgtctttaaagaattttgtctttaaagaaaatgaattctgacatttaaaaaacaaaaagctctctaaagaattttactagaattttagggaaaaattataatcaaatatctggctaaaattaccatgtgctatatgacttacagttttattttatcctctgacatagcactattagattaatctatgggaatctatttcaggattttgaattagtggtaagaaaatagatactaagaaatccatggccaaagaaagagcctcaccagaatcccatttatgatttccaaaattccatttttggtgccttgttgactgttttccaaatcattgaacatatggaaaataaatatagattcaacatttagtttctcattgcctcttggattgtttttaacattttaacacaccatgtcagcataaagaacttctacctatagcagtcacaatcttggtactgttataatagaatatcataaactaaagctcttgttgcccttttcctgcccaacatggttaaaaagttcactaagcatgatttgttttgtaaacatactaattgttgcaaaagacgctgtttcattatggtatgcttatgacagtcatcttcaactgctcaggacccacatctgcctttgcatcctctgtcaccattcttttgatcagattcttacagtggacttcacttaacatcatagtcaggggtgggtgagttgggaagtagatagctaggtgatatggatggagggatgaatggatggatggacaggtggataggtggattggtagatcatctgtttctttgctatatatttttatgttatatacatgattgtgtgtgaatttaaatatatttctcctttccggtcactaagcctttttccacaccatcctagtagacctaacttctctttaattagcctactcctttctacttttttttttaaggctaatattcctcctgtttctcttaatgtgtggtgttacctgcctttccatgatggtagtcatcattatatttctctagtgatgccttgtagtcctctgccttccacagacatcttccctgatttaaattctggtgaagtgttaatccccctgactgtgaatgtccacgcaccgaaggcactgtgcggtgcagtgtaccacataaacatgtaacagaactttgcactttccacatgcctcctagccctactcatttcatgttttcaatggtggcatttgttttaggttctaaggtttttcaggacagagacagaaacttttttgtttagggggaattttttccatgcatctaaccagagtgcctggcaattaggggtacttagtcaatgttacttaatgttaatgaattatagggtgactgtttggtaattgaccttcacctgctcagtaagtccagttgaggttatgtctctcttcgtgggaagaattcagtttatcgaatgacagatagacacggtcatgtgatcagcattgcttttacaaagcctatggtttcttggtttgttttcttttatgaaatgcatttataggcgttgtaaatacaaagccttcaagattttgttaaaatagaataatgcattttaacagaagagtggtaatggttaggaagaaaagctcaaactggttaaaaccaaagtaatttctaagttattatggaaaaataaatccagaagtgaagatccctgtagattattttttaacctacccctccaccataatccaggtgttaagtcgttttgaaacaatccattgaaatcactttttaaactcttatgtgaaatcctaagtgaatgagatccaatagcttttctagattacccaggaaggttttcatttattttttttttttttactcggtcagtcataccaaaaaattccaaggtagcacagcagtaactactacaaattatgtaagctttccccccccttctgtcgtctttattggctatgcaactcattagctatttcagcattatttggcctagcatcatttgttggttaaacaaaagaagggaaaattcagaaacagagaaacaaaatgtttaaggtttgttcttactcagatgtatactcatagtccctgtgtcctgttgaaggaaataatttattgtgatcttagtcaaaagcatttctctttttgctgtccttttttattaatttagatatgtttctgagatgagaattgatgttacttctaattatggttacatgtagttaatttccttcttttttcttaagcttggtgtgaaaggcagtttcctccaaaagaggcggtggggagctggttacagggagggaagaatactgatatagctgatcttcctgttgccttagcaacagatttatttattaggggttgaaatgacatgagttgatataccgcatacctgctgatcggcaaactcccctatttcagctgcagttgacaattaagtcctggacagctacagccaggggttaatgttcctcattaggagaactaggtcattactgggaaatcaaggcacttaaggtagcatgggtaaaatacaaaattcagcatctagatgagtgaggcttttttatgttaattaaccttattttcctaggtttaaaaaaatcttatatgcacatgacagtggatcaattaattgaaaaaagagctagtttactttactctctgagttgtcttcatttcctttgcaaggatttcattattttatggaaaattcttatgtctatatgatgagtaaaaagggtattaaaattaagaagggaatcatcatggaaatcagctttaccacaagggaatgagcaaataaaagccttggaaatgaaaataaataagctttgctaatacctcacctaaggagcggagtataagcccatcagagctgagagacatttagaggtatttctttgcttctttattaagcagttacatagttatttgaccttcagaaactgaaactttggaaaagtgattccaagtgatttgtaaacattctatttgcagaaagccgtatagcagtttaacaaacaataactttccacttcataattggcttttaaaaataccaataaaattagatacattcgttgaaagtttttattaaaatgtctgagtgggtgcttttttcacttgataagttcataaataatgtatcaagccccttctgaaagctttgttttcttacttctttaaagagcctttatgttgaaaggggggtatttacagagtagaaaaagatttattgcccagaatcctgttttatcttcattactgtactgcctccattgaaaccacttcttaccagttttttcacttgtggtaactttgtaaacatgaacaaaagcaaaaaggtgctcttaccaacttcatcccctaaaatactgtgtctcttcaactgaaaaactaaatcattaaaattttcctccctccacctacatgctatataaactattcctaatcatgtaaaattaattgattgaccccagagacttagtatggaactcttgtcatttctttccccaccaaaagaaatgtgcaactctcctttaactgattagtggttcggtgtatatgttttcacccctcaaaaatcattgtcctgttatataagtgaaaccaggccctctgatacttccttagaaaatgcaactctagtaaacctctgttagtatcatatatattgccacttaccctcaaacttggcagaaaattactgtattaggtggcaccactcaccttccttagagaagcatttgtttccagtctaaaattagacgtgagccttatgtaactgcccctcttcacctaccatagtcaattcttgattttaacaagaacagttttaatggagaaattgtttccccagtttcagaatcattgcccaagagccagagtcctagcatgaggagatatggaagaaactgttagctatccccccaaatttctctctttttcttaggaacacagaccacattttccagcctgtattgctgtttgcttggggtggctgcgtgactggttcttagccaataaatgtaatagaaaaaagtgatgtgggccacttccaggcctggtccataagaatttctcacccactttctcccatgttctttcttcctcctcgctggacagacatagaatgcacttgttgaagatgacagtttctcctttggcttgggaccttaaacagctatgtggaagaggactgcccttctgatctccccacctgcctagtactcttacatgagccttttacatttttttaacccatttaatgtagtgaacctaccttagtggatgtggaaagctgctattataatccagacaatatagtggtggtttgactggggtagtagcagtggtgatcataagtggtcaggatatattttgaagattttggcctgagtaagtggataaatgaaggtgctgtttactgagatggagaacacttggggagttcgatttttaaagtttgcatttggacatactaagttagagatcttctagacacgtggagatttcaagttggaagctgatattcaagtctgttatttagatgagcagtcaacactaaagacagaaatttgggagttatcagcgtagatatgtacaattcctttaaaacaggtttaaaatatattttaagcttcctgattttaaacattatatttctactaattctataggcagcaattatagcctagttatagttatagcatagtaggttctgagtctctgtgtaagtcctggctgtcacagttaccagccttgtgccttcagtcaagttatctactctctaacttcagttttcttctttatatgatgggaataatgttaactacattacagaattgttctgaggattaaagaagatgatatatgtaattgcgttagcacagttcctggcacagagtaagcacttactaaacattagctattcttagtagcaaataatatagagtacttcattagctcacacgggactctcacttttgcccactgtctcttattggttaaaatcaattttttcttaactctcctagaaaaaaagaaaagaaatagctaaataaagtcatcttttttcatcttcattttcagcctacccaaaacaagtacatactgtacagaaaaatggaattaaactacagagcaaacacttctaaggagcagcatctgccttgtaaatgaagtctataaaaggctaccaaatgtcccttcacatttttatgattgttagttagagtattactaaacctggatggaattttttttgaggctcttacatcaagcacccacactgtaaatatcacaaattatttccgtttttaacaagatggctgccatgagccttcactaaagattttagcaggagtgatatagttttaaagatatgatttggtaaaaagcactttctgcctgtataattgtcatatttttaagcacattactgttttaaaaacagctttaatggggtataatttatatgtcaaaaaatttacccactttaaatatacaattcagcgatttttagtaaatttacagagttgcacaactatcccacagtccagttttagaacatttccatcaccttagaaggaattctcctgccctattaaggtcaaaccctgttttcacccctgacccaggaaaccactaatctacttgctttcactatagatttgccttttctgaatattcatgtaaattgattcatacaatatgtggtcttttacgtctggtttctatcacttagaatagtgtttttgaggatcttccatgttgtagcaggtatcagtagtcctttcctttctaatgctgaataatattccattatatgggtataacacctattgcttattcatttgtcatatgatggacatttggattgttttcacttttttagctgttaagaataatgctcttggtacatttgcatataagtctttatgtggacatatattttcactttgggggggttagatacctagcagtggaatcactgagttatctaataaatacatgtttaagttttttaaaaacaggcagatcacattttaaatacctactaattttttcttagattcattcattcatttaaaaatgtttattgagctacttcttctaaagccaggcaccgtactgtgtactagatatagtcaactcttgattatccaccataatcagaattaaatgtagtctggatgtgtaaaatctccttgttatccataaacctgatatagggcattctttcaagtgtcttcagcataaaaagtcaatcttaattggcctgttatcccaaacatgtattgaatggctctatgttggggagctaccaggaattcaaagataaaatgtataacctttaggagcccatagtacaggaagagagatgggtatatggcctccatatacttccagtgtccttgccattttctaaaataaaacacatctaaatgcaaacccctgctttttttcccctaaactcttttatactcctgtttatgagtggtacatttattccctcacattcagctccaaattattaccttgtttgattcctcttcacttgaacactatatttgcttcctatggctgctgtaacaaattaccaccaacttggcagcctaaaacaacagaaatttgttctcttacagttctggaggccagaagtcagaattcagtatccccaggctgaaatcaaggtgttagcttggcctcactccttccagaggctcagtttctgatagctgccaccaatcaatctgcagtttgtgactgcatcactccattcactgcctccagtcacattgctttctcctctttggtctgtgtcaaatctccctgtgcttccctcttataagaatacatgcaattggattgagggcccacccagatgttcgaagataatctccctgtgtcaggatgcttaatcatatctgcaaagtccccccccctttttttttttgcttgccatgtaataggtaacattcatgagttccaaggattaagatgcagatgtcttttggggggccatttttcaagcttatgcaagcaccatgtgcaatcactatgaagttattcatttgttcgttcattcattttatactttttgagtatatactaccatcaggaagtgaatcaagcactgaagatgtaatgatgaggaaaaatcacacacacagtctctgttcacttggagcttacagtacctattaatcaaataaaaatttgccgtgataaatgttatgaaggagaaatagaataagtaacttttcacataaacattaataatgttcattatcaaggcttttaaaaatacagaaaagttcacataaagaaatttttaaaactcactgcaggtatctaccatgcataagtaattactattctgttgttgttgttgttaatatcttttcatttttttcttttttccagttaggaattcaaggtggaaatcattactattcttgataaataattaccgtgtgtttcattccatattcctgtttggaacttaaacactattttgattttttaagtaattacccaaatgattttaatatacaaacttacccacatatctacctctttctttggttatgattgcctcttacatattaggccttttcttctgcccgaagaacatccttaagaattgcttttagtgagggattgttggtggcagtctcatctgaaagtatcttttatctcccagttattgtttgagtatatttttgctgagtttatagctgtaggttgagactatagtctctcagctttgttttgctattgagaagttatttattttatttttatttatttatttatttatttttttattgatcattcttgggtgtttctcacagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaagcatctgtttaacaaagcacatcttgcactgcccttaatccatttaaccctgagtgggcacagcacatgtttcagagagcacagggttgcggggtaaggtcacagatcaacaggatccccaggcagaagaatttttcttagtacagaacaaaatgaaaagtctcccatgtctacttctttccacacagacacggcaaccatccgatttctcaatcttttccccacctttccccgctttctattccacaaaaccaccattgtcatcatggcccgttctcaatgagctgttgggcacaccttccagacggggtggtggctgggcagaggggctcctcacttcccagtaggggcggccgggcagaggcgcccctcacctcccggaagaggtggctggccgggcggggggctgacccccccacctccctcccggacggggtggctggccaggcagagggtctcctcacttcccagtaggggcggccgggcagaggtgcccctcacctcccggacgaggcggctggccgggcagggggctgaccccccacctccctcccagacggggcggctggcggggcggggggctgacccccccacctccctcccggacggggcgactggccgggcggcgggctgaccccccacctccctcccagacggggcggctggctgggcagaggggctcctcacttcccagtaggggcggccgggcagaggcgcccctcacctcccggacgaggcggctggtcgggcggggggctgacccccccacctccctcccggacggggcggctggccgggcagaggggctcctcacttcccagtaggggtggccgggcagaggcgcccctcacctcccggacggggcggctggccgggtggggggctgacccccccacctccctcccggacggggcagctggccgggcggggggctgaccccccaccgagaagttatttaaaaagggttttctctctagctactttaaagatcttgtctttgtctttggtgttcttcaccttcactgtgataatgtttagaaatccacttcttttaatcttacttggaatttgtcagacttcttaaatctttaagttggatctttcatccatcctggaaaacatttaccataatatcttcaggtatttcctctgcctcattcgctctcttctctccttttggaatctggatctggatatttcttattatcatatttttaagctttttttcatatttttcatgtctttttataatatattctggattctggataattttttcaggtttatctttgagtttactaatcctctcttaagctttgttgaacctgcttttaattgtatcccttgactttaatgatttttttaaatttctcaaatttctttctgtgactttttcagaacttttcggtcacttttaatagtgccttgctctttacatatttagtctcttatttctttaaacacttaaaacatactacttttgtatcccatgtttgataattttagtattcgagagctttgtgggtctgctgccttgtttctctttgcttatgggactttatttcctatgtgttttttaaattttgatcacgagcctatattttttggaattttatcatgggaaattctttgagacctgcctgaattgtatctggatttctcctgaggggatgtgtggttgcctctgtcaggtgcttaaggaagctaccagcccagtgtgagattaggaaattacaggagaattttattaatctgtagcaataacagccatcctcacatctctcccatgcattcttttctttccatcctactgatgccccattctcctggttccagtctttctcagtgcaaacttaaactacttaatagccttctaattttctcttctctgaccttggcaccctctaattcatatctagggtaactatcccaacccattaccttcttcatgtcattttgttcagagtccttctgtggccttcactctctttatcagtggtctcaaccctggctgcccattaatatgtagaatttttcccaaattaagaatgtctgtctaccttataccaattaaactagaacttctgagagcaggctcttgcatccttttttaaaaaacatcctgaacaactctactgtgcagccaggattgagaactactggtcagcaggagaatttttttttttttaaggaattaccgtaatctagcagataagactttataggacagtggtgcgtaaccctggctgcacatagtaaatacccatgtgcaagccccccacactgagagattctgattcatttggtctgaaatgaaacccagtgtgtattggtatttttaacagttttgtaagatttgcaacacacagggttgagaataaggataatcgattcagggataatagattcacaggcttccaggaaccaggctggtagtgagagaagggggctagatgggaactatggtaaactggagagcaccaccactccatgaggggcatgcagccctactgaacttttactgattatgaaacatgaccatcacttggcaactcctgctctgcagtatagccacatctcactcttctagtcaaatctcaagaattcttgaaaaatattcatatatgtgtacgtgtgtgtatgtgtgtgtatatatatgtatatatgcatgtatatgtgtgggtatctccagccaggaagtatgagggtatgtttacctttttcttccccagctcagtgcgtttattcacgttctgctccttacctgcaatgccgtccctcctccatgtctgcctaatcatcctcattctttaaggaccactcatgctttctctgccatgacatttgagggctggtgattggaggagatggatgttttgggaaggggacttaccctgtatgtccctttctgtcttacgtaaacctgcttccttgagtatctgtttatcttgaccatacttctttgggagttaaataaaacaaagctttatataatcaaattttttagtattttagctttatgattatcaccactcagttctatgaatggatttattacatttaaaaaattatattaaattatattacattaaaatttttatataatataggagatagagtcggaactagaaagtcttaagtatgtggatttagatatgtaaggattaaaaacaccaaggttgactaagataattatagtaaatgatgtaaataagaggtaaagaaaaataaaacagaatatctcaaaatcagatttgggctggggagaggtgaatcagtaggaatgtcttaagttaaattatagcaaaagcaagccacactcattccctaagatattttatatacaagtcatttatttcaaaacatgttcaagtactgtgaccctaaaagggcatctgaaagatgaaagaattaatatttttaatttagcataagaaccatggtaaatgaatttcaactatagtaccaaatacaaggaacccaagccataaccattcactcattcagttgttcacaacacatatttacaaggggtaaggaggttggcctccccagtgcccatatatgccagattgtagtgtttgagcacattctgtgcagctagactgcccagtttgaatcccagttccgtcctttaccactgaacaccttaagcaatcagtgtaggcaagttgctcaccctcactaagctttagtttcttcttctataaattaagtagaagaatgatatctacctcgtagagttgttgtaaagatgaaatgatttaatctaaccactggtcttagagcagttcctgattcatatcagagctatcctgtatacatatttgctgctattattaatctgtgtttctttaactcaacttaagttctaagaatgcttaggagcatcaaggaagatgtcttggtctcaaatggcatatggccacattggtatcctctaaaaagaatattgccctgcctgattcttggtgatcacctcatagtgttggtgtcttcttgtaagttcccatctgcccacaggttgcatgattcatgccagtgtgcactgcagggactcctcagcatgacgcagcaccacctatgtcatgctggctctatcaggtaactcctttatctcacccaagggcttggaaaatgtggttcctctcctgtttccatagacctgagaaaacagcaagcttgcttttagtactccctgacccaggctatttatgttcctcaattgttcccatgccttggtggccacaggagtgcctgcaaagctgctacctccttgggttctagaggaaaagatacaagccatggtcactcttccatcaaactgattctccgccaccctgtttttcccagttttcagccttgggtgtccaatcaagagtatcgataacctctccaactcacctttcccagcccacagattttttgtgttttttggggttgcgggaagttgggagggttaggaagagtgttgagaaaaaacctatttggtattactcttcaaaactgttgtttagaactcagcctcaggattttaaagtagaaataaataattgtttgtcttctcattgcatttctgtttaataaccctaccttaagcgcagagactatacaatatccttgcccttattgctgggaagcaagggaggaatggatgtgcaaagtaggaaataccaagagaggaagcacattaaacaaattaatacttcaaatattatccttctacacatgtattgatataacttcttttgagacttctgcctcagagaactccccagtcattgcagtacaacataataagtgaaaacccagaagaggaagaactaattctgcctggaaaagtcaggcaacgcttcactgaggaagtgaggataattgaaagagggattccattagacatgttacttcccagttcctgagccacatatgttgcaaaggagaatagtgatttaatctgaatgtgaacctgtattcacggagtctagaaagactcagctagaaatggaaatagtgtttgtctttatgtttccatttgcaactctaaaatcgagatgaatagtctggtgtacatgatccctggtgtttggggctacacttgggctgcagtgaagttggtggcaccttgatatccctagaccctacttgaggtcatagaaagagctctcatctcttgtgccagagcccaggactcacaactggaggccattttaaatgtgtaacctgttgcagacctaatcctcattttaagaaccagccttcagcaaatgtgaaatggaggaagtttttccatagcaggcactgcccagttgcacttttatttattatttaccctctttttggtgtgagccctttacctctagtccaggtgcccaaaacttccttttgtttgatatttcacacaattcttaccctccatatacactcatcgctttgcaaaattttcccctcctgatcttcctttaaccatctgaacttacattctcttagtggtctgttaattagtcccaaaagaataggagatacacacatacatgtgtatatttttagattaaagcacagtaatgtgtaaatttttgctaatatcttaatgtgttatgtccccaagggtttatgcattttgaaagaggtcctgcttttccaaaatgaaacccaaaaagggaattttcacctatccatctaaccatctatccatcaaataatatttaggatgaacctgctttgaactaagtaccttgctaagatggtactacttatacctagaaaaggctccagactgaaagaatttcagacactgtaaatagtaatagatgtgatttggtgaacaattgactttccttagctctaacatcatagaaggtggtggaagaggggagcagcctctctccttgattagaatttagattccttgaggggagcgtctcctgttctcattaattatgaacgtattccaatatcttgtacaaagcctgtctggcacatgaggtgctcagctctcctccatcgaatgaattcctgacttcaggtaagaatatatttttttgaggccaaaaattctgacgaggtaagagatttttgtgttgtcctgaatttttacattttaaataatacactgtaaaaaataattccaattaaatggacccttgagctataccataatgttttgttagagattgttttgaatataaaattggtctgcctggcatccttcctaaaggtaattgatactcaagtaaagaggagaccccttaaaacctctagttggtgtggatttattactgagaacccaattagcagatgaaaacactcaatatgaggcatttaatacttactggtactataaatgcaacaaagatattaaactactaatttctttaatttaaatggttaaaattgtacctcatttaaatacttcccaaatctaaaatgtactaacctatgcactagcttttaagtttaaataactttttaaaaatattaaaactatgaagatataaaggaaaagtagaataaatactgaagaaactctatgcttaaaaaatgaacaattaatttcttagttctgctccttaaatacatactgctctctatatgtgagcatttcgctaaagaaaatagcattgtaaattaatataatatacacatgatactgaatcttggaataaagtttctcatttagaaagcatggtacagtttccatttttaaaaaagaaaatatattgtcatgaaatttgagttaaacccttctggtttctaaaaccttttaaaagattacttttattttaagatttatatgggaaattcaacttccagtgccactttattccatgaacatgaatgaactgcatagtcaaaagaaaattatttcttgtaccagccaatgtacttgtgtaatgctcctggaaaacatgattattacttcttgcaaaaaatggcttatctttctgattatttccttagtacttcatgctctgttcctcaagactgaaacaggtaaaatgggagagttcccttgacccttttgtgggacttgcaacagggctggctcatttactcagccgctgtgctcagtcccttatgggagggagcacacaagccagggggtgtgggaactggagtgaatgaacactggaaccagccggttgcttctttcttggggagtcaggctctgttcaggccccatggcagcatccaagcatgttacaatgctcttttagctctgctgtccaggaggaggtgtctgtgacccccagagcaccagagggcatgtgttacaatcagtgctcttttagcatttgccatctgcagatggctaaggttaaccagctcaatagagagtcagggtgacagccttttacaccctgccctcttggtacccaagttcttgtccagcgtccaggaagaatcaggtaacctgaatgaattaaagagtggtaaatgtggaggactttattgagttgtggaagtggctctcagtgggaaggggagctggaaagtgggtggaaaaggaaggtaatctctccctggagctcagccatccccagccaaactcctctctgaccatagtctccaacgtccagctgctgcttctcctctcgatgttcagacacttctcccttctgtgtgtgtgtgtccactgagtttagggtctggggttcttaggggcacaggatagggagcagggtgagccaaaaggcaacattcaggtgggaaaacaggggtagttcttactttgggccacaggtccaggcttgagggtggagcccttgacagggacaccatcctattctacccagtatttccctgcctcctgtccatatcacaggcacagggaaactcttagcaccagcaacctgcaatccctgttgattctctgctaaggaaggatttttggtcttgcactcaaggagtacccttccccttagagaaccatctgctgaccttctctgaaaatctaagggtatcatctctccacttccacctgcacatctatttgttcttcattatctttggcagctttttcacctcttgtgtgatttagggtttttgatatcttagtgttctgaaagatgatgtttgtacttctatttctagtttttgttgcttcgaggtaagtcctaagagaaggggaaaataacagtttactcccccaatttcagttgtcacttttctatgaaggtgacttggtacaatgttataaatatcatgagaaggaataatgaacatccttatcaggaaaagaaagacatatttggtggtaattaacatttgggtcaagtattgatgattaatatgagggtgactgcgttaatcatggcttggtggctggattaatggtggcatttgacaagattagaggtgcaatcctgagaagaaaaattcagttatggacatatgtatgtttttacacaaataaaagttttactttaaatgatatttgtaactgtgttataaataaaaatggcgatttactgagtgttcactacgtaatttgcatatgtaactcttgatactttagatgccagtatgtataattcaaggtaaacattaaaacctcggctgggcgtggtggctcacgcctgtaatcctagcactttgggaggccgaggcaggcggatcacgaggtcaggagatccagaccatcatggctaacacggtgaaaccccgtctctactaaaaatacaaaaaattagccgggcatggtggcaggggacctgtagtcccagctactagggaggctgaggcaggagaatggcgtgaacccgggaggcgaagcttgcagtgagccgagatcacgccactgcactccagcctgggcgacagagcaagactccatctcaaaaaaaaaaaaaaaaaaaaaacctcaaaaatgacacatttcagtttattatagataactgattataaagtatagcaaactttactttttaaccagttatcgtggctataaaactcactagaagattcttaaatttccaattcagtaaatgaagaataaaataacaattatgataataataataacagcctttctttattgtatatttactgtttgcctggcactgcaaattgtttcacatacatcatttcacttaatcccctcaactgttccttgaagtgaatgttattagattgctacagatgaggaaattaagtctcagactgatttggtagtttgccctcaagtacagatactaaatatgagaactaggatttgaaccctctttcaactaagctttattgttcatgtaaactattttacttcaattattctgatttaaaaatatacatttaaaattgtcatatgtgaatttattattggttttgaatagcttcttttctacctgttggtttatatacatctctaaagcaagccaattttgttaaaatgatctctcactaaatacactatctaaagtaattggttattctctattatctattattatctattctttttttttttttttttttttgagacagagtcttgctcagccccacaggctggagtgcgatagcatgatctcagctcgctgcaacctccaccacacggaggttctcctgtgtcagcctcctgagtagctaggattacaggagcataataccatgcccagctaatttttatatttttagaggtgagggcgtttcaccatgttggccaggctgctctcgaactcgtgacctcaagtaatccacctgcctcagcctgccaaagtactgggattacaggcatgagccaccgcactcagcctctgctatctattcttttctttgctataaataaattgttctggtggccaggcatggtggctcatgcctgtaatcccagcactttgggaggccaaggcaggtggatcacctgaggtggtcaggagttcgaaaccagcctggccaacatggtgaaaccccgtctctactaaaaatacaaaaaattagctgggcgtagtggtgcatgcctgtaatcccagatacttggtaagctgagacaggagaattgcttgaacctgggaggcagaggttgtagtgagctgagatcacgccattgcactccagtctgggcaacaagagtgaaacactgtctcaaaaaaaaaaagagaaagaaagaaaaaagaaaagaaattgttcgatactcactagcagtaagtatatttaattaattaagactttgtttcatgaggcttctcattctggagaaccttttctcgagcagtgtagttaatttatagcacgtgatgttattagaatattcagaattccttattcttttccatgtaagtatttagtctaccttcagaacctaatgtgattagttcttaataacctgaaataaggagccacaaaaaaactggggtaacaaggtttggggctgaactttttctttttgatatcatgaaagggactcagtagagtaatagagatttatcccatttgtaagaatacagaagagaggagacatgtaattaattctgtttataaaatgaaaaaaaatacaacatatgtagcaacaagaacatgtcattctgagcaggtctttatagaacagacattccatattgtgttcacccttgtccacaatcatttgccatgacaatctggtatacttagcagttgctgctgagtaagggagactgtctcttctatgagatctctgtgtcagccaaaaaaacacagcagtctcatatgggtctagaaacaagacataaaacataaacagaatgtcagcatttttctttacgttggagggatttcttattaatgactttgtccatttctattttaacatttttaaaatcagaaacaagtttcggaatgggtttttcttctcaaattaagattctttcccatctgattgaagaccttgtcatttctagacatgacaaaatgtccacaactgaatatgaaaacctgttattaagaattgaaatgcattttgatgaacggcatatcataattccaaaccatgtttaattctccatttaagaaaaaaaaaaacatggttcttcatgtcatttcatagacctatcctactatagttttaaaaatataaatgtctctattcagctatcattcattcattcattctaaagccgtattttgaatacctgccaacttctggagtcagagggtttctctgatgtgtcggtctttcagacgaattataaagagacagcatacaaataaatatgaaataatatacaagaacacattcatgaaatcatcagtagtatatgaatgttagtgcaggagcaaatcagagtgatatgggatttctcagggatgactgcaagtaacaaatttaaagtaagtagtggacaaggagtggcagagaagaaaagagaatgtgtttcaaacacaagaattgtgggcaaaggagcatggggttgcaaacagcacagagggagaggatgagaatgatggaaatacttcaagttggatagggcagcttaatttcactttaatggtttctagttagtgtagagttaagagatatcgaaggaaaatcatgttggaaaggataatgtaacagtcttttggaagctggattggcagagggagtcgtaagctcagcgatgttaagatatgacgtgaaaacattgtactataaaaatggagttgagcaaacaaatctttatttatgaaagaagaaatggctaggttggtgataaattgattagggacagcagtttagtttttaagtgttataaatgagttgtcattgacatcaagtgaagattctctatattcatctgattacacaaatagcaaaatacacacaggaggaaggaatacaaagatgagacccacagagacttgatctagatttagagtcaattcaatttactaactttttagactatgtgataggggaaccagaggttaaacaacaacatgacctctgccctcgaggaacttacaatgtaacagacatgaataggtaaaactttaaaaatgggttagttccaagagatcatgtcctttgcacagacatggatggagctggaggccattttcctcagcaaactaaggcaggaacagaaaaccagacattgcatgttctcacttacaagtgagagctgaacaatgagaacacatggacacggggggaaacaacacacactggggcctgtcagagggttggtgggggaggagggagagcatcaggtagaatagctaatggatgccgggattaatacctaggtgatgggatgatctgtgtagcagaacaccatggcaacacgttaacctatgtgacaaacctgtacatcctgcacacgtacccctgaacttaaaatttgaaaaacaaagcaccttgttttgctgaaaaaaaagaagaaagaaaatggattagttccagaggaggatcaacacaataggaatggaaaaaagaggcctcgctaagagatttggaatggctatatttattagataacaggaaaaacagaaactccagaaaagagaagtctgaatgttacagaaagagctagatgtcacttttagtattgtttgaaacatcaaaaaattggaaacaatttaaatgtccattagtaggataattactttatataaaaactgtgaaatgtattagaactattttaaaatgagatatctatatgtgctgatgtagatagatgttctgttatatatttggtgaaaatgcaatttacatgactgacgttgatctcgtttataaaatgaggaaggtattgtaaaaatatgcttatacaaatctatatgtttgcatatgcatagaaataggtctggaagcctactcgccaaacagtagttggcagcggttacacttgaggaatgggatcaggtagggtgaggagtgagagctttgagtgcttatttcatgtatttctcaattatttggattttattacaatggacacgcattttgttaaaattgaaatatttattaaataattatagattcacgtgcagctgtaaaaatgagagtcccctctggtactctgataatacatatattgggtcttctgtttttatcccataggtccctgaagtttggttcttctttttttaaagtctgttttctttctgttgatcacattgtataaattctattactctcaagatcactgattctatcctgtataatcctttctctaccactgagcccatccagtgagggttttgtttttttttttaattctgttacattactgtatttttcagagctgtgatttccatgtaatacttgctgagattgaacactttagaacatggttttaagctccctggttgtcagagtaaagcaggaaataagaattatacatctttctatccaagaggtagaaatacaacaattcttgcaaacatcaaagagtctcttaaactggaccttggggaaatttctaactagaggaggtggactggactgctggggcagctctcaggataactagtaagcgttttgaatgtatttcctacatgtttcttggaggaaaacaatgttaaatccaaatgattagtcagtttgaatttacagccccaattaccacatttgacaagaagaaacttgattacagaaaatggaaagacttaataatgaacttggagagaggaaagtttagttccatagagtctccccagtctgagaggaagtaattacatacattgtgctgtttttaaattatgtgggatggtgactgctgcttaagtaacatcccaggagtagggaagactcaattcgtcttaagacacttcatggcccaccagttctttgaggcatgggtttctacaggcttactggccagagttgcagagaaagggaattcattggcaagttagacagctgaataaaaatgactgtgtacaatatccagtgagattggaaatcactgctgaaaagaaacaacctggggagtctaagcttttagcagtggagggatttagaagaaatctgttgtggagtggacctagtgggaaaaaatgatttagtgaatatggttctcactgggtggccttcaggatggaatgagtgggaagatttaactggggaaaaggtcattaggatgtcattgtaatacagtatttggaaaccaagcaaggatcacatctaagcaaacattacagtcagtgttgtcaaaagtaggagagagcataacaagcatgagaatgaagcagggcaaaggtgggaattggttttattagagagcactttcatccaagaaaatgagaatgggaatagcaaagctgtagagaaaaccagatgaggaaagaggaacatagctaaggtgaaatgatttgtgaaaagtcacccagaaacagtacattattgaaaactttcttgtcaataagtattatcaggtaaaggagtattttgaagatgccaaatacatgaatggcgaattgtggagtaagagtaggatcacagactttaggaaggaaactgaatatgagaaaaaagcaaaatggaagatcttagagtgctcatggactttgagttttgaaagacagacacctctccttctattaaaaagaaagttgagaatatgaatgtgcagatggcatgaaaccctgatacacatagaatttaattttttgataacttaatttctgtatcatggcccatttcaatatgatgatagaaatctcaagcagttcaaattctccgtcttccattttcctggtccccattcctcatgggccattgctgatggatcccttgcttctgtctgtctgcctacagctctatgatccttctgtgacactcacagaagccacacttccgcttttatgcctaccatggctcaggaatctctcgaggctctttccagtactgtctgcctagtagtgacatagactcagacattcactctgtggagtcgtgcttctttctccagaagcatagtgcatggcctctgggactctcagagctctgttctcctctgctcctctccatcagtctcttgcgtttcttgcctggaagtggagtggagacacggtgtaggagggtgtatgctacactctcatagcattttgcctacttatttgtacctgtttgaaggggttttagcttctgtaaacaccaagaagactgctccttttttttggttgagggacttcctccccctctcctccagcccatgtctttcctgaagcaatgaaaataaaacatcttaccatcttgaatgtctttggattcacgggagtagacttggaataaattgattaaaatttataacattaaaataactacaaatacaaaagatggagagaatgagagcgtattgtattcagggtgccagacatttcttcattcctcacaacagactctttaaatgtagttactgttaccccattttaaggatgaagaaactgaggttgcacacggttatataatgtatctgctggtcttactggcctactgctagacagaggcagagccagttctttctggactgtcctttccaccctccctcaaaaagcaaagttaaagggtggaatgcagtgtgagcatttgcagaaagccacatggatgttgttggtctttgtcaactcttaagtaaatgatggtgaggagcacctgtagggttagagaaagcactggtagtagccaaaagagagaaaagaagagcaggagcaaaacagacagagaagttgagaaatcagtggctaatgagactactgtctgaattaacgttcaaagcactatgacacaccacgtgggaagtagaagctgcaggcgtggagggaaaccaaagctgatcccttgtgtgtcaggcatgcagagaggagtgaagagtgtgtggccctcgaaagcatagtggagaagtcggtaattctaacagctaggacagggtggtaaatagaagcctcatgtttttgaataaggagcacatcactggatttggaagtgaagtgctatttcataatgggaagtaaagatgaaggttagcagaatattagaaaggtgaagaaatttgataccattgttttggagagaccataattccttattgcttctccatatccttattgccatctattatccgatgagtttgaaccccaagtaacaagaaactaaggaatgtttatgatttaatgatctggaaatgttactatgggctgaaggcaccaactctgtttttcctctgattatatgtgggaaggaaaaaaaaaagtcaaaaactgcctaaaagaaaatgacttcataggattagatgtaatttcagatgcagacccagtctcttctgtgtgatcttgaaggaatagttatatttgtatgaccacttggttgagaggcttaagtaagattatgatcaggtgcttaacatggaatctggaatgtaacaggagctctataaatgtaacttgcttttcctacaccttcatttattcaacaaatatttatagaggagctaattttatgccacagataatgtgttaggataggccacattatgctgcagtaatgaagacactcccccaccccaaatctcagttgcttaaacccaacccaactatatttctctcacctactcaaagtctgctgcatgtttaggtggctttacagggcaactctcctccatgtggcaacccagactgcatcactctttaaaattaatcctcttaacacaagacatcttaaggtccaccacagcagagaaagatgtagccagaattgcttttagatactttcgtctgaaagtggcatacatcactccattggccagaagtagtccaatgtccttatactactggaagaagatgaagatggagtcttctgtgtgctcagaaagagaggatgagtggatattgatgaacacaaatattatctaccactgcttggctaggtactgggtccttagtagtaaacaaaacaagtaacatttatcctttcctgatggagccctcaggccagagtgacatgctcctgggaacactatagcattcataaagaactagtgttctgcccaagcaagggaagagactaaggagattgtattcaatatgtatgaagttatgtggaaaaataggaaaggataacagttcagtgtaagtgacaagtatggagatcttagaaatcctcaataaatatttactgaatgaatgttaagtgacgaataagaagaaatttagctctaagaaactaaactggaaaggcaacagagagagagaacagatataggaataaaaaacacatggaaacagtttatgcttttcaaatgttctgaataatatttgggaataaaagctgttcttgctgtatctactgcttccagtaagcttgaaatatttctgcgttggtctcttctgccatagtggtggtgcagaggaatgaattcccagccagactgtttcattcttacctactcaagagtatggaaatttgttgggaagcttggaccctgacttatcttctggaatattttgtgaagacttaagttgtcttgattggcagctgtcaaatgtatagggattataggaaagaaggaattatgctgctgtaaatactgaaaatgttacagggctaagcaaaaaaatctagtaattttatggtagaatattagtgatggataatttcttaaaagcattaaagtgatttctataaaaatgtttattaaagaaacaatagaaaacatgcaaaaaaaaacaaaaagaaagaaagaaacataacaacccctaaagataatttccattaactttcggtatacctatgccaaactttcctagacatacacattcatttgtcttagaaaaacagattacacagatcatgccactctgtcatctctcttttactttacagtatttcttgaatatttttctacttcaagaagtatatttatgcaacatttttttaatggctgcatggtattgcatcatatatgtgtgtcagaatacatttacttatcattccattaggtcatttacagatggttgccattataaacaatgctgctatgaacatactctagctgaatttctgtgcacatctttaattattttatagaataactttcctaaattgcaatacttgggtaaaagttatttatattttaaggcttattatttacattatcaaattaccctttaaaagattgtttcaatttatattcctaccagcagtggatgagaataagagtgtttaggagcccataaatctgcaaatatggttgtagcaaattgggcatactaccgtacatatgtttaatattgatagctgttagcagaaaggggcactcagtatattatctttaaatcctacattctatgtatttaatgctttattctaaaatcatatgtatgagagtttcacattaaattttctagaaaggaatttaagacagattcacatagtatgctaaatgggttcattaatgtcataggctctggggtaaaatctatggatgatccattagatagctagaatgagttctttactaaacaaaatatattgagctctgccattgaatgtcatccgtgccttgatatgtggctgtagccaaatatttgtgtacatctttaataattgaatattaggcaatttctcatttttcttttttttttttttgagacggagtttcgctctgtcgcccaggctggagtgcagtggcgcgatctcgactcactgcaagctccgcctcccgggttcatgccattctcctgcctcagcctcccgtgtagctgggactacaagcgtgcgccaccatgcccggctaatttttatatttttagtagagacggggtttcaccgtgttagccaggatggtctcgatttcctgacctcgtgatccgcccgtctcggcctcccaaagtgctgggattacaggcgtgagccaccgcgcccggccaatttctcatttttctaaaaagaaaaccccaaattttttcaactaaattgattatattaaagtttgcatgacatagatgaaataaacttgtatatttataatatgtaatttactaatttagacataaataatactttaaaagcatactataagtaataatttttagaagtattgctcttttcccactcttaaatttcatgagggagttttggtccaattcccccttccatgcattcttgagttcataatggtggcacctcttcaggcagctggcctgttttcactacctgtcatctggaatcgagtttaagtagcttggggtgcaggactttgtgaaactgtgtatgatggaaatcttttccccaactacaaaaaaagaaaaaaaaacccacttactacttatctccagtaaccacttaactgttacttttttgagtgatctttaaaatacttgttttcagcaacatccagcacttagaattgttaggtcatgtctcctaaaataattaccaactcaatattaaattcgtttgcttctgtttttaccagtcccagcaagtgaatgattgctaaaaccatccaaaactctcatcagttgtttcaggctaatctatgttccctaaacagtactttgtttaaaataaaataattgagacagtgcctggtattaataagagagactttataaggactttagtataaaatgcctctttttctgacagataactttgggaatgaaaaaatctcaccttacatttggccatatattacagtttaaacaaaaagaggggattcacacaaatctcttttgtgttcttatgcaaagtaactattgaatatgaaagcttttgtccacctataggaaatagctaaagaatacggcaggattgtaatgcatttatcttgtataaaaacactgagaattgaggtttataaagcctgctgctttgaaaatattcacattggaatcttttaagaactacagctctacccgattaaacctcctcccaactccaaacctcatctacttttactttaataccaaaaataaaaattaaaaaaaaaacccagccatatttaaaatataagatctcttaggtatccatagccaaaattttggaactcaaaatgaaaaatttagagaactgaatggctagatttccctatggtgatactatcactttaagatatattatattgtttccaatcttttcatctaagtatttcctagagaatcagactaaaagaacattgtatagattaggtggcagctatttgattgatatggttgaagatggcatatggcatattctttactttcaaactgttttgagtctttgttcttgcctgtagcagtagtacctgtgagaactatccagaaacttcccaatggtacatgtatgtaaaatacatcatcttaaaaagcaatgaacatttcaccattgcattctttattatttgaactaaatcaaactgagagatatagaacttaaatggctatagaactctaattctgtaagatattacaatttcataagattataaatgctgttttaaaatgttaattagaagatacatttgttttaattcatgatactgaaaatattgactgaattgtgaattaacacatttagggttgcagatgtcatttttcatgagatttcctgaatgatgtaattttcatatttcatatagcagtttgatcaatttacagatttattttacataattagtaaatgagaaattcaattgctgatatataactattttttcataatgtaaaaaagaagctaaaattctgaattataaataaaaaacaaatattttgaagacatctggtccacatctgtctgaaataagataatttaaaacagtgtaattaaatgcaagaaatactgaaatattcacaccttaggatgttaaaaaaaactcatttcattttgatgtgatttgtttaattgtagagtttttaaaaatgttagtgtcctttagcctctcattctatcatttacaaagaagactgacaagctaaacaaaaaaaaataatccatgtgttccaaagcctctactaaatgaaagaattatctttattactattcttttatatgggcataactccactcctaagttaatactcagcggacatagacccagacctacctccttttgatgtatttataattctccattcaattacttaaaatgagagattagtgagagggtctctaatctccctaaattgtgcgttccttgtgggcacaaaggagctcagtaaatgtgagaggaaggtattcagacctatggaaatgaaaagcatctttggtacattctcatgatcattggagagtcagcctttgaagattggtcttttcttacattaaaaaaaaaaaaaagtttatttttaacctttgttaagtagaaaattaaccattttagggaagagtaaatacactatactttctgtagtccagccttaagatgtgaaaagacagatttgtcctttaaggctgcagagccttaaaacttcaataggactaggttctgatcataagagacaagtttgtggacatgaaaatattgctgatgctatagtgtgaagttataggaagaaatctccacttggataccagaggctccccaaccagcagtagaccatgaaaaaaattgatactgtaggaagtgaaaccacttttcctaacacatgccctaaggtaacacaagttatattttgtgtgtttatttccagggagcatgataaagatccagaaagcttttttaaggtattaatgcatcttaaagacttaggactcaatttccacgtgtctgtacttggagaaaccttcacagatgtcccaggtacctctgttgaattttctaatgtgtatttttatagatgacataagctctacaacgtaagtattaatttccatgtttccctttgttagaataatcaagatgagcactgttaaccaaaagattatacgatggcattaaagtctgattcaattaaaaaaatacttaagtaagcattctttgatttaagttgagaacgtgaagtcatctctttgatcaaatatagtttatacagtgcatcttgatgtaaataaaatatattgctttaggcatcttaacacttaaggaaagtgggaatttgtaattggatatacaacctctcacctctggggtcactggtttgaatcctgctcacattggtattggctgaaatatattaccatctgttaggtggcctatgtaaagcattttggcatctaacttgtaatgtggaatggactatagtccatgtcatagttgtcgttggtccatgccttgtttattgaacttgagaaagacaaaaatcggaagctgatagcagcagatcctctctttattaatgccacacggagccttttcaaagagccatttccttcaccctgcatcctcacagttcacatttgggtcagtaaaatgaggattcataagcacacaagttatacaagtattcatgtcttttaagctttgggtgttcagcattatttgaaaaatcaaatgtacaagcaacaatatttcagaaataacctttgccattgtgcattatgactcctaaggaacacctaaagtttactttcacttagcaagtgcttcttgattctagtacagtgtcaagaactacacccagcctgcatctcagtagccttgtctcatatggctcatcttttgcccgctgcagctgtggatactgaccttttcccagttctcctaagacaccaggcttcttgagacctttggacgtttgcctgtttatttctattttatccttttgatctcagctcaggggcattttctttcgctgtaaagctttgtcatgatttctcagcaccccatacttcatcttcatggtacttacctcagtttttaatttatctatgtgtaaattttttcatctctttcacgcgtatgcacacaagcacacatggcccatacacactggaatgtaaatgctatgaggacaggtactgtatctgttgtgttcatcattgtaccccaaagcccattgcagtgcttgacacaatgatggagctcagtgaatatttattggacaaataagtaaaaataatgcaaactccctgctctcaagaaatttataatttttttttgagaagggaacacttatgtctacacataggcaacagagggtgaaacacaagataatataattatacattatctaagccacacaggtggtttcgagtgttaattgaagggctggtacttgaatagccagaaaagaaggattaagttattccaaaaggggaaacaacatgggcaaagcacaagaagccaacattttagaaaatgtgattaaatgagagaaaaacctcaatgatgagtgctgtgaggtcattaaacagaacaggacattctacatgcagacttagtaagtaagttggtatgtgcattacacaggtagggtagggcccaaatatggaggagcttgataaccaaagtagattgggtaaagataaggaatagggagcctagatcttgaacaggaaagaaatatgatgaaacctgtattttaggaagctgtgtctcgcaacgatatgtagacagaatcacagtaagaccctctggtagtaatcccagtgtgatcctgtaaggtgctggcagagagattagtgagagggctgtatgagagggatgttctcaaggaaagcacagaagagaatttgatagatgggtggctatacagaaggaaggaaagaaaagatcagctcatttgcaaagctcataagttcagttttgtttgtaccagccttgaggtgtttgtggatggattgagaaacgatgctggaggaaattccccccatcagaaggcttcttagctggtcttaccactgcgtactttcaggccaccactacaaagaagactcggtttttactcaaaagcctaagttctgggattacatctctcctctcccacacattgaccttgagttatttagagcaatatggagggttgaaaatagggtgtggagcagttaggggtccaagtacttagtgctcagtaattacaggtgagtaattattgctcactttggcttcgcttccacacatacttactgagcactgtggaggggggattccacagtgaacagcactcagtttccccctcagggatctctgtctaactgggatgctgtgaaatacacagagagtactgtggaagcccacaggaagggatagcatattgtctatacacgtgcttctgttactcctagtagcaacagagatttttttctgcctcagccactggttcatctctaccatttcaaatgtgaattgagtcttcacggccatggcacttcatcttgcacagaggaggagcccaggtgtggaatggatgaaagagctggtaactttccaggttgtgcccttagaaggccgctttgctggtctctacaacaaaggcttcctaacaggccattctgtatcacttcagccattattgtcacccctctagtttatgtaacaggttcttagatagcatttactgtattccaggtgttctaagctgttcatgaatattaactctgtaatcctttataacaatcctgttcagtattgctacctccattttttcccaggtggagaaacaaataggccactcagctaggtagtgctttagccactgaggtatactgctttttcatgttctttttttctgacccaactgtttctctaactttaaacattaatttttccccagctcaccattcagcattcgtaatctcttatctagcgcttccacaaaaaggattacctagctggcatgcatttctttgtctgatgtctctttgggtactacattatcatttctggccaggtgcagtggctcacacctgtaatcccagcaccttgggaggccgaggtgggtggatcacctgaggtcaggagctcaagaccagcctggccaacatggtgaaaccccatctttactgaaaatacaaaaattagccaggcatggtagtgcacgcgggtaatcccagcaacttgggaggctgaggctggagaatcacttgaacctgggaggcacaggttgcagtgagccaagatcatgccattgcactccagcctggacaacagagtgagactctgtctcaaaaaaaaaaaaaaattatatactatgtgatacctagccagaagaattactcttaacgctgttaacatttgtagggatatggttctcttgcaaataattgcaattattattatgctattaataacttccattaattgaaagtgtgcttctttcttggccatttgcctgattattttatgtaatgctcatgatactcccattgagggtaggtattaccctatcccattttataggtagggaaacagactctgaaagcttaagtcactttgattacattgcctataagtgagtcaagcatttctctttcacatacaagccagaaggattggaaaaccaagaaaggcttaatgtatcactgcaggaccattgattactctgttttcagctttgttttctttccctctctacagaactcttgggaggaaagtggcacaccactgagtgatggcattagtgccaagttttactgccctttctgatgaagcaaacaatcatcactaaatttcttttgaaaactataactcagcaactttgtagagtctctatactgttgattgttttcaagcaaaaattatgttgttacaaagtttttgtaatctttttcctaaaatgtatagtagaattaagagtgtcagttacaatttatagtgctacagtttatagatcttttgcatcatcccttcattttacaggagatgagagatctagaatcagtgactttcccaaggcctcactgctgggcgcagtgggtgagatgggcagtagatagtggcagggtttggagtagaacctgggagtccgttttcctcagccctagtcactgctacattttttcaataaatgtttttaaaatacgttctttgttccaggcactgttgaacatttaggatgcaatggtgaatgaagtagacatgttctgtgacatttgaaacttatagtcccactccagtgctttgttcatcacttaatagaacattccttaaaaatgatagaactgacatttcttgagcacatagcatgtgctagatgccgttctcagccctttatgcattgccttatgtagtcttcacaatagccctgtgaattggcactgttggaattaccatttacagctgaaaaaagtaaggcacagggaggttaagtcactcgcctgaaaccacccaatcagtctacctcaaaggcaagtgctcagcctgtgctctacagggaaattcacagaatcatccctgttttacaggtaagaaagcaggagttgataacggtgagaaattcctggccactcatgtgaaatgaataggaaaaaaaaacagtaaatatagggttcagtactacctacagtttcaggcatgcaatagaggtcttgcaattcatcccctgtggataagggacaactatttcattgcctgtaatcttcttgctggaaacaacccagctggtatctgaagacgcatctagcaactatgtcctggaaagcacagcagatatgaagtggaggtagtctctgtagaaatggagttacttatcacttgcaggtgacttggcattttgaaaagcttttagtggttttcaaccagagattcccacctccacctccagggacatttggcaatgtctggagacatttttggctgtcacaactgttgtgcaatggggtggtgctcctggcgtctagtaggtagaggccagaggtgctgctaaacattctgtggtacaccagacagcccccacggcaaataattatccaacctaaaatgtcaatagtgcctagattgagaaactctgatttgtgggaattgaactcagcaaaccaggcttgggactgggtctcttgaagctttctaagttaattcatgttcatccatctgtgcaatgaaaaggaggagatgggaaagggaaataataataaaatcacctgccctatcaacttcagtgagttataatgaggatttcagcacaattagataatttgagggaaagtgctatctaaactactatgcagattttattataggactcatggacttgcctccagagtttgtacatggaatgagtttttaatacattttggatccataggagacatgaatgatcctgtaccttaaaagttcattttgtttttattcagaaaattggaaaggtcattctgctacataaagcatctgcatcagactccatattacaaatgaaccaaaaagcctagaagctcctcaatgcaaatatttgagttttggccaattctcatgataaggtcacattgttagcccttgagattattaaaaaaaaaaaaagaagaagaacaaaatgcttaagatatcaaataagtggaatgtgtttgtgtacttaataatttcccacaaatggtaattctaaacaaaatattattttctgtgaactgccaaagacttaaacaagcgttcttctttccatgctgcagacatggtgggaaaaggagttttagctttagacattagggcagccagaaaggttacaaggaaaccaaaaacctgaactatggttttcgcagacagaagtctttctgtttcacctttaatttgaggttaagaacagtatatggaaagcttctggttagtatctggtatgacaatggttattactatgatcttggcatatttctggttcttggctctggagtcaaatgttggataattatataacatttccctccacttccatcttctccttcactcagctcccagctcctgtctcattttcatcagagcagctatactaagggggaaatactagaaaggttctaggacacaaataacatacatcacactaatataaagttgtaaaattttgtcacaaggagagcctagcaaaaggaaagctactaatgtattgataaatgttgaattataagaagattaggccaggcacagtggcagagagagaccttgttgtctcaaaaaaacaacaaaagataaatacattgagatgaagttaatgtactagtaagattgaataaactcatttttctccagaccataccattccctaaacctattccttttccttataatttttttatcattattcattccctaacatataattacttactgagttcctgttatggtctagcaccatgtaaagtattgtggataccaagagatgaagacatggttcctcccctctggaatcttactggctcattagaaaacaaaaatgtttatataattacattttattatatcacattcttgtttatattgtaacattttaataattttgaatacattatttacaatgtttatgggcaaaccttatagcagtctagtgatttaacaagtattaacctccccaaattatagctgaggaaatgacgcatattagctccattttagtagcatgcatttgaagtcgattctcagtagacagagccatcttcacatgattcttagaaatgaacacatagttactttcccgagaatatgattgagaaagttagtcttcaagaatctgaaattcaaactgaaggcttctgtctcccagtcctttgctgaaataaagaaaacaacaaaacataatgggaaaagtaaggaagattcaattaaaggtaggcatataagctcctgacagaaaaagaatacatgctaaatagaaatgatggtatctcttaagataatttatgaatttaacaagactccaattagggtgccagaatattactttacatatcctcacaaagtggttctaaaatctgaacaaaataagtaaatgaaagggcaaactagcaaaggaatcatgaaggaaaacatgtcctaccaaattcagaacatgtatgaagtgagaacttttcaaagagtaccatagagatttaaaatatgaaagtaaaaaaaaaaaactaggcagaaatggagaagcagaaatacaacttgtatatacatttaagagcccacaaacttatgataacacaatttactaatacacttatcccagctcaaaaacagagtattttttcttagtgaaatcagttaattgaataaaataaatgtttatatgataaaacaacaaattatacatttataagtaaaggtttgcaatagcatcaacacattattataagtacagtaatctactgaattcttactctgcaccaagccagggctaggcttttactctgatatctcattttgtatgacaacaatccccttaataagtataattactttcccctatgtataggtgaggacactaaggctttagttaaataacttgcctgaggtcacacagctaataaacaaaagaggtgataatatcagaagaaataaatactaaatcaaattttaggggggaaaactctctaattttaccagtaatgaagtacatataaatacaaaaaaaattatgaccgagcagttgcattgaacaaaacaataaaagtaaagacttgtaactaagactagcccacttgtggggcaacatctgcatgtatggtgatggtgatgcacattatttttcctgaactatattactctaccctttgtttaactcagacatttcacaggaaatgtatcccatggaaataattccaagaaggaaaaaaacaaatgacaaaagttgttcttgcctctttctcttctctactgtcccatagtgaacaggtaactaagatcctattctttcttgatcccatgcctccttctgattctgttggctcttttccagttcttgcccttttcttctgggcccttgactcctacaaaggcttcagattagtctcccagactctggataccttgacactgagttcatccacttgctattatcagtgttctttctaaacctagaacatccaagaagataatcataatagtataacaataataagtgtttgtgtcagattttctgcaggatgaacttaatttcctttatagcgggggaggttcttcaaaatctcaccctaggctagttcctcatgaattccagttatctttgccatttcctgaatacagctgtgcccttacccacctctatgtcttgtgttatttgttgcttaaattcctttcttcctccccatgtagacacagtcaaaccctttctccacctggcaaaatcccaactctataccttcctcttctctttccttcctattgtttcatggcatctatactcattccatcagttgcaaagcatgtatcacactgcaccatagtgatatatatatcacttatcacttggctgccataatagggccatggtataactgactggaaggcactttgtaggtgaagagtagaacttttgaaacagccccacagaagaggagtctgcagcactcctggtgggagtgctatcctggcccagcttttattgataccctaacaaggatgaggttcccattcagtacctgtgaagctatcttttcctttctcaggaaaggcttattaactgggctgatacccttccctcccaaatgctcagaacattcaccagctgcaagtaactggtaacaactcactctcattcctcaatgtgtcctgtgagaatccatttttttctaggatcactcccaggcatgccagtccctgggcttaaagtctactcctgcagcttctgtaagtagaataatcttttctactgaaaccagaagatccattgccactcttaaggcaagatcatttatccatcctaccagggaagaccatgaagataatgagttctggaatacagctcccaaaacatctctcaagaaattgttctcaaaaattataaatatgaaaacatcactgagggaaaatgctctgtcattttcataagctgtcctcaaagtttgagaaatgtgtacttgggaaagacacaggaaaataaattaattaatggaaaagatcgacattactagacaaataggaaattggaaacagaccttaattttgaaagcctgtaaaggcatatgagatttagggttgatgggagctcttaggatgtagttgctatacttggttttcagttcctatagttgtatatggtcatgatttggagtgtggtatggtcaaaataatatttccccagtaaaagactatgggggaaggcctgcttgttttaatattcctgtttcctgcaatgcctatcagaacaggagtctctgacagaaagcagcacaacagggaatgagtatgaatatctggatccaactagtgagtttttccagctatatctctccttggctaaattgttacatttgtgaaatggaaaccatcagatatatgctgccatgaaatgaacactgtcctggaatttataaggctcagggtctagttccagctctgccattgattagccatgtcacctctttcagccttactttactcatctgtaaaataaagtcattccaaagaagatagaactagaagggaccttggagatttctcagcttttaaaatgcagacttaaaattcccacccgcaaggggattttacttagtgacgctttctgaaatgtgtattatgaaacccgtaagcataataattatactttttcaatacactttgttttctacctgtattttttttttcacttttatcataggttcagggggttacatgtgcagatttgttaaaaaggtatattgaaaacactttttattcctcaccgttctgatgtctacctgtgctgccaacagcaattattccagctaccctggtgtgtgttttttatcctgtcattgcctctcactcgttcttcaccttcaagtatcctatgggagcttttattctttcttgttgagtttatctttaggtctttgtgaggctgactaaaaacactcctaaagatgagcccatgtatctcaccttctcttctgatcttatcacattaagtacagcctcattgttctgactttcctgatatggtttcagctaccttcctagccttacttcaatccttgaacattatatcctggactgtagcctagattagtcagtgttccctgaagatggctcatatctcaccatccagtgcccctccctcctcctttatttgtcaaagctcaacccatcttccaagagtcatctcacccactttcccaggcctctcaaacacatgtactacctcctctctttgaatgtccatgagattttgttggcattttgcagtgtacttatcatacatacttcaataatagaaggctcttgagaataatggcagttgtatctgacacaacctgatatgacccaaagatcctagtacagctgtgttttcaaacttttgaccatgatccacatcaagatatatatttacattgtggctcagtatacctattaatgtagacatatttataattgaaacaaggcttttataatacatattcttactacatttgacgcactctgatgttttctttttctgatttaatttctttttatgctgctctaaattgatttcacaaccattagccacaattgtaaaaaacaccataatatagcacactgcacaaagtaggtatactgttgtacacatttaattaaattgactcggctttttccaaaatcattatagaaatattactgatttgtgaatatataaaatatatccattttgatatatttatttagattttaactttaccaaaaaaatattttataacctcaaagtattgctgctttggttttaattttacatgatctgaaaaagcaaatgcagttcatttttatgtatttttaaagtaagaagatgaagatatttagctgtacgataattatcactgtaatgacaaaactcctgagattaatgtatttgacataccataaaattgctgtttattgaatgctgagtatgttccacacattgtgctaggtgcttcatatacatttcctttaactctgtgacattcctccaggatcagatattatctccactttataagaatgccaaatcaaactgtaccattttactcagtgaaaattcttagcaataaactaaaatcaggaattctgatttggttttattatctttcttcccacaaagctccttgtaatttagcaagtgttttttttttccacagtacattttaactgtgttcagtgcttataaaaaatgtcagactgatggtgttgagaatgaaagttgtaccaactgatgagttaagtttcttgatgttcattttatgaacttcattaactgaaaaatataacagaaaataatgctttacagttcattttatcatatcttaaaagttacattgattctagaaaaatagaacgtttagtgtctagctagatactaaggacatagttggtgttcgataattgcttattgattgattaaactagtaaagggatattaaccctaaatgttggatttagatgaggaaactactacttaaaggggaaaaaagatttcccttggctttgttattctcatagcctctttccactgcacaattgatgataaggtgttgcccagacagacctgatttaagaattggtatttaactttatcccattgattataaagtgagtcagcaagatttaagtgttgaatagattcaagatacagtcacctttgagtcaggtggaaacgtaaaaaaaaaaaaaaaaaaaaagaaagaaagaaataaaaatcacccaaactctctctctataaaatgtttttgtcataaaagttctgtgtatggaagaatgtccacactcctgtaggatgagagggctcaaccatagcacaaagaaggttaaaggggcatttactgaaagtgacagtactctttaggttctagcaactatttaaggggggaatttatctggtaattacatttcccccataattgctgcttttacactatagatgactgcactcaatttaggttgaattatcttacccaagaccttgtcgactggtgagtctcacaaaaatgagtgtctttctctatggttttacacgcatgcatacaccttccttcctagttgtaatttcatgttttcatatcttgaaaactttgtattttacaatttctaaaattaaccaggaccaagctcttcttaactgctgcttgcctttatttcttctaggcttgttagcttttcttggatttattgcctaaactctcattttcaggatatgaaaaaataaatccccgttgatagttatgtctacattacttagaaagtggaaattatagatgacacatgaaatatttatttcagatttcctttgaactaagccaattagagcccccaaaaggaactctaaatagtagtctgcccaaaatactatcttctaaatatttgaactttgcccttgggtaggaatttcaccttatccttgaaaattagattaagaaggaatattaagatttgcttaagtgaaattacattactggtgcatttattttcattcaaagggctgatgagcaggtatcattttgacagtgaggggctttctctctcttctttcagaagacctcccgtggcattgtctaaacctcccttcactcagcgacacatatttctttgttatttcagaacactttgcttttttcactccttctaagtgcctggagtgagcatcattcatggatcattactttccaaagaaatttaagcacggaatgccatttaatttttccgaatgcagtccgtcattaggaatcttagctgtcactgcaatgccatttttggtgtgatgtgtttgttgcctcatttcttttaattttatctccattagcttaattcttttttaatattttcatctaacgaactttacagtccattttgtttcagtgtctgctaagcgagttttatgaagcagacagttggcttttcatttagggggagggtggcgaggcgggcctttgcttttgtcagctttttttggcaccttaacatttggttctgcttctgtgccttgattataaaagcaaacaactccaagaagttcgttaaaataagcagcagctaattaacctgaacttcagatgagacactgctgacatctcatatcattttacactatattaaatagatgaatatctttttcttgtttttaaaagatattttttcagaggccaaaaaggcattgggatcttctgtcttacactggggctacttacccagcaaagatgactatttccaagtactgtgcatggctgatgttgtcatctcaacagctaagcatgaattctttggagtggcaatgtaagttctttctgtttgtgatatgtgataaagcaatctctaatcagttttactatgtgtgttcgctgttatttcaaataatacattaaaattcagtgatcaaaaggaattcaattgactatcacctattttgtctgtactatactttttggtgattgttaaggtaatccaaagaacttgtttcatttttccccccacatacaatcgtataaaggcataagggccagcctttcagatgtcttctcaagagcctgaattaaactttctgttgtggagatgtgaatgaattcataatttttattagaacctcctcccttggaacatactgtgtggattcttataactcccatatatattacctgccaatcaagacaaaatcctgaatctaatatggttttgggaaaaaaaaatgattaaattaatgcatgatggatgttaatgtcttgtgcacatgaacagtcgatcatgtcctccctatcatcatggaggaggacatgaggaatagcaaggccccagataaatgaataaaatgagcactgtctaatggacttcaggtggatgggagtagctgctaaaaaatttctgaatgtaaagcataataacataatggtctttttccttactgaatctgacaaaaattgaatcatttctaataattttaaatagattgacataaaacaagcacatatatattaaaaataggcctccattttcctagcaaatatgtgtatatgtgtaatatatatatagcatataatatacatatacagatatatctaagtgtttctgtatatgtttgagagaaagcagaacacctctaagtctttgtcttctgactttaaagcatgcatcattgagtcaaagccatttgacttactctataccctttagaaataaatttcacaaaggattactttaaaatctccttcagaatatcaccaaaaattgttagaatcttgtcagccaaactattcaagataatttctaaagaggccttattaaaatgtatccaaagaactttcaaaaagagatgaattccattaacttgctctagaagaatactcatcagatacacagaagttatccaggaaaatgcagataaattgggtattgtaaatggagacacttagaaatgtggctaattttctttcttatccactgaagcaaacacaggctctgaaaaggaccaggtaccagggtccctccccacagccctgggcagatggaccactaccactcggcttcacgctggctcatttacttagtgttttgcaatccttaatgtgcacagctggcagctgaatgcaggtttgatactaacagtttagacatctttagatgtagcagatggaaaattttacacaaataaagtaggagaaagtgtgcaattaggtttttatctgcagttatgtgatgcatcctctgttttagtttagaacatcaccttagtgggtggtcatgatcttttcttgtatccaggccctaccttcttgacaccacatttgatgttggctaaatgcccaagtaccaaacttttgtttttgttgagtgtgattgaaatagggaatgcaacaatcagcaaagcaaaaggcataccatcagtgagattgtaacagtccagtacattatggttacattccttgctagttaagtcactatggtaaaatccttggcaggatttttttcaatagtttattcatgatgttcattattatgagttgtaaagagtatgagaatttcatttttaaaatgtcttatggaatgtatcactttcttagatcttgtagacatgctgtggaaaccataacataaaatatgagttacttacaataactaattttaatcccatctgctaagtatgacaacattagcatttccacttaattaaaaacacccttaaagcagcaatgttttaatcactccattttatttactctcctccggtgtcacttataattgtaactttttattttttaataatgagggattttttttctccttgcatcacacaaaaaagtgctgtcgataattagcagtcttctgttattagtagactcaggtgtcacaactgtgtctcatcctcattacagtaaaaaatttcacctatcagattcattattgctagataatgcgactgagagcctttgcaggccctccagaaaagtaattcagccaagcaaaattatcagctaattatatttagaatcaaaagcccaacaactatttgcagataaattgtatgaattgaagtgaatagatctgaatattaagattcatagatttggcagatgatttgttaattggaataaaaaggtcatttactagtctttttaacaatagatcagttggaactctgttatttaactggtagtgcctaagaattgaagtgatgaataattgtattattgtcatgagataatttaaaaaaaataaaatgagaaacttatggaaatgaattttataaattggttttaaaatactatggcctatttaatatattttaaaacatagtcctcatctaagtaatgtatatcataacaagtcaaaaatagaaccaaaagagatggtggttttttccttgatgaattagaaatataaccatgactaacataatttacaaatagaagttgaaatccaaaatttgtaaattttttcttcctaaatcaaataatgccatttctatcttactgtattttaattagcagaggttttttggaaacggcatggtacatattcatacgatgactcaaaatgtaacttggcctgcaattttctttcggggaacagaatactctaattcaaatccattattaaaaagcagataacatgtgcactctctgaaatgcctatgacttcactcttttgattttatgtaattataagagaatgttcatatgtatttgcttttcgattggcacagcatttaaaaactgaatgtctttagataaagtgcatattttcttttggtccataaagagtatcactggtttataaactcagaacttttgtaagtgttttataatacagtcacagtgtagtttatagctgtgcttataataagaatttctgtgtgtaccctatgtatcaaaaaatatgaggtattagtttgcattctgaaattaataattggtaaccagaacctgtgccttcccactagattattttgtaacttctatcagttctcaagcaaaactttgaactaagtatttttccaaaatttgcagctcaaagtaaatacttttcatttaatttcacttaacataggaaaatagggaaaacatcagccacttaaaaacagcttaagtttcatgtacttcgtcactgtaaataaacaaggtaaacactgacatgacttcagagtactcttgggttgaaaaaaatctgcagttcaaaataaatttcccctttggtcaacattttggatgcaattcaaagtttctcataaaataaacatattttaaagagtgttttgaatttcactgcataatttctagccaacagaaatgacagtggtatctttaaagttgattatatgtcagatcaatagctattatgcagggctaacacagaaggaagatgcaataccttccttctgcttaacccttctactgtgacgtaaagaaaaacttcccataggtgggtcaatggggaaatcctctcacaaagtgaaactttcatgtttgtttgtttaataatacaagcattctttgctgataaaatggaaagtgagctgaatttttagtcaagaaagcaaaatgttcattaaagtaatcttcatgagagtttttcaacaaaagggggaagagttttacattctgcataataacaaattgttttgaagcatgagcttaaaatgaaaatgccccattacaacagattgtaaatttttttctgatgcttttaaaagttcctcaatcttttctacagcgacagtgctaaagttaagtatttgctattttatttaaacatttttgaaaaatgaacattctgaggctttgcagcattattaagaaaagctgtccatactttaccatgttgttacatgtgtttatctgctgattataaaatgtgttaaacagtattttaaaaacaaaaaaaaatgcagagctgcgctttgattaattcagtgaacaaaacatatgctgttggttctgttctatgaaattcatatatgatcaataaaatcttttaaaagagcaactttggcttttagaattatactgccgaccatgttttttgtcccagttaactctgggctcattcagttaacttaggcaaacaaaaccactttctggctatgatggtaatgtctttttaatatattcttaccctctttctaaaatttttctaggttggaagctgtgtactgtgggtgttacccactttgtcctaaagatttggtttatcccgaaatatttccaggtagctgctttaatgtacattcatctttattgagatttaatatatgattcatgctaaattagaaagtttgaaaataaacttaggcaggagcaattgtttatttggcaagtcaacatgttagtgttaaggaaaattttatgtgttttaatacattagagtaagcttatatttaccatctgttcttttaagataacaaaaaagcaagttttcaaataacattcttcattgttagcatacacatcccataatgatggatttttataagcaggtcagtgttgctgcaattgcttacagattttttttaatgatacacacagaaaaatcagggactgaaagtcacaccaaattatttaaacaattgactagttaataatatgcaactgttgtacgggtacataaggctatagtaccagttctttgaaaaaaatctcatcactaagtatatcacatatgcattgtgttacattagaataatgtattttaatcacccaaaggagatgtctaaacagcacaactacacagtcttatttagcattaaacatccttgtgagctgaggtaaccttataaaatcatgcttaaataatgtaaaacacgaggcggcacagagcaatatgcatttttaattagtaaagtgactaatatcgagtgtgtgctttgaggtttttgtttcattaaaaatgtatctgtttttcctgcagctgaatatctgtattctacacctgaacagctttcaaaaaggctccagaatttctgcaagagaccagatattataagaaaacatctctataaggtagttattgagaagagatttacatggtataaatgccatattgaagtacaaagaaaaatcttaaaaaaaaacatttaattaacatactaatgtttaaaggaaacatgctagggagggatattagttgttacactaacaaggattaattaaactggatgccagttgtattaacctaggtcttatgaaatacgtgcacttaatgcacagtacatgcttttttaaaatttactgttttctaagatgactgtcctttacatttagcccctagaggcttataaaaatgaacctgaattaatgtaactcattagtttaaaaggaagtaaaggaaagattctacaattatactaatgaggataagcctttcttcccatcataatgaaatctttagtcctcaaaaattcaggtgaatgacattagtgaagtttggtgttcatttttgaactacttgaaaggtgatttttaagaattgaatatttctcgcgtccagtttaataaaaatgacataaaaaatcctcagtttctttagaataagaatgtcagtctcatctctgaatggcaaagggaaaatagtgtaaacagcatcatcattcactaccctcattcgttatcttcttttctttatttgaatcaagaattttacattgttgaaataacaacacaaagaggccctactaaaagtctaagtaattgaactaggataaatctgctttatgagttttgaaggtggctctaggccataagtaatatacctttttatattcttcgaatgtagcatcttcattttacataactccagtatagtttacatctagcagttttataatctaacatattttaattttcctatgttaatatataaccttctacatgaaatacagttctctgcctttttttttctcccttccctgttcgtagcctaaaatacatatttacatagtgatacatcaaaacatgactttgtttctacaggaaacagttaaacttcaagaaaaagagagagaaccaaaaatgcaatttaacacccaatttcaagctcattatctttcattgtctattaacttggcaatggttcagaaggtagctcataatagtttaaaatgctgactgaacagttccagcttcagtattactccttgagtcaatagtattgtattgtatacatgggaagctccacagagaaaacagtcgttcaagatttacctcaatatttcctaatttttaaagttcagtagtagttttgtttgtatgaaatatcaatcaaatagtttcccatgtgatagactgtcaaaatatgcagataatgaaaattgaggaaatataagtattagtacaaatgaattaattttttatatatgacacaaagctattttcagtgagttctctgtcagattattgattttttccctctttggatgaatttttggtaaagtatttgtaaatgtgtttccaccatcaaaatttatcagtttgtaacattgcttaaccctgttattctgcatctgcaaattttaaacctctgcaaatttttaaccatttcaaaagtcactgcaaaaagttgcctctagtaagaaaagaaagcagatgtccagttgaaatattttcattcagctactgccataacatagctataattatttattttacaaacagcttctgaaaaaaagaatggcagcttagtggtatgttgttaatataccaaattgttcctcacacagtttaaatgataacctatatcttaaatgttatttcattgagctgttacatgttagtacttaaatatattttagttcatacaccataaaaacctgcatctcaaagttttataaattagtaattcatgcaaaagcatttataagagcttatttatataattcatttttaagcatcgtctaccatggatttttctcttataaatctgtaacacattttcacatttgccttcatccatagtgcttagtgatattgtctaaaaattaatttcaaaaattaataaattagtcaaattttaagtaatcaagagctttatgatacaattattaggaaaaactggcatgttgcaaggtatagagttaaaagcacaggaaggaccacagatttagtttgtgtgttgttataggatttaaagctaaaacagaaaaaaaaatgccttctaaacctttataataatgatacaacaagttattgtaattttttatcttgtgttttataaatagacacattttcaggtaacatttgcttttactaaatactagagaattagcattttagcttttacctacttttcttatgcagtcggagaggatcttttgtgagtactgtgaaaagaatgttgggagttatttttagatttatttcattggacagtgctgttttgcttttataaaacatatgcttctaagatctaaaaggatagaatgtcactgaattctttaatttgttccttttacatttttacaccttactctttttttgttgttaaaagtttacattttaaaatcatttcaacttcttatcatatagagttcactttaggataggatttttcatatggattcacacttagaaatttaatgactagaataaggctactaacacttggctttcttctcacatcagacattatactttcaatatgagtgagagtttggggtataacttgaagcaggatttgaaacagaatgctagtaagtgaaaagcagaaacagaatttactttttttcttaaagtgactccttctatcgcagaacacttgtgtccatgacttcccacctgaaatagtttcagacctgaaatgtttaaattcctcatttgcatgtatgtgtgtactcgctcagtctctttctctcttatacacacacacacacacacgtacacttggcttaggattgttagagaaatccaatacatgcaaaaattaaatgtttcttaataattttaaaaaacctaaaaccatttttcttaatttaaggaaatataaaatcacttcttacaaagtttatgtctacagttgagtcattgactataaacttgtattgtcgagacatgtactttttcaggtcaggcagatgcactggacacatacttctcacagagataaaacagggagctcttcgatgactcctaagcctaacttgaacacaagtttctagaagtaatcataaaagaatcagctaaggattgactccttaaactaacaatagttcttcctttctaacccaagcaagtctaatactgtgaagttgtatttttttggcctcacttttattatattatgtgaatttacttatggaaaattctcaacaattatttgagattagtatttcatgcttttagagaaccctgatcattatatttttaaatgctgttgaaagacattttatagctattccctcattaccagtatagaaatgaatataagagtacaaatagggcagttgtgtaaggtagacattatccagactgacagaagagattttcattcccatcctatttttcatttagttttatttataaattgaatggtattctctggtttaaaaagagagagagatgccattcttgctttttgagagtgacttgtagtttcttaagatttttcaggtgatagctcctgatttttttgttttcctcttcaagttcttcaacattgacaaaacttttataatcttctattatttggaagggagaagaattttagagttctgccggaaactaattccaaacaataattaagcttacaattcacactcattgcccagaaaagccatttgtggttatcttgattatgtcaagctatatgtacctgaaccacagacaagctactttgtttccttcaagaaactggtcaccttatagtccccttttaatttgagcttaaactctagatttgaataaggtgttgctcactagttttaatactgctccagagtccttactttttccttaaacatgaaatgtttgtgatgttctaagaacttctaaaagctctcaactgcaccagcacaattaaggcaaattctcagtctcagtctcagtctctcactctttctctctctccctcctctgcctttccctcccttccctttcttcttccctctcttccttccttccttccttcttcacctcctcctgcaattttatttggtctggctttcctctgatttgtctaaataaaataaaaggaaaaaaccttttagcatcacagatatgctttggctgattaagatcagttagaggttttgtccttctctgctactcatttgcaacctgattctaggtgatcttcttggcctctatgtgattcatctgtaaacctggaagaatatttttttaaatatcaatgtacccctgaagtactggtataatgaaataatgaatataaacctgttataaatatgaagcactttttaaatttcacataatagtaatggcatttatctttgtgtcttcatcatttaaaagtaaaattcacggcagaaacttgtatgtacagtgttacgtgtcttgtgtttatataagttaaaagttggatgatgaactttcatcatccaactatgaatggttgtcattcataacataaaccaagaaatatgtgtgcagcagaatatacccatttgcagaaaacagtagccttcttctctggttggaaatacaacgacactttagaccaatcagaaactgagatttcctgaggtgatgaaactcaagaaccatttacttggtggctttttgaaatgtaattgacgtaagtgatgcaaatttgcaatataaattttcagcatactttcatcttttagtcattaatgctcttcacttctttctcttctctccctcctcctcgttgcagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaattagcatattcatttacatatagatgtatacatctacctatgtgtttctcactgaacgttttccttgtgacagagacaacaaatacaattgtttcttttccggatgaacaaggatctgttttgcaaatgtttgtaagatattatgacatttccaagattttctttgcattctggaaagcaggaggtaaacatttgtagtcattaaggtaaagtctgttgataaaccatcttctgtttactgacaggtaaattgtaacttt

SEQ ID NO: 38562 - DNA, 5301 bp, Homo sapiens
agtgagcgggcgtcgggagtgggcggatgcgttggggttcgggtcgtgggtgttgaggcggagaggaaggcgtggtgtggcgtctccaggtgattgcgattgggggaaggtagaggagccagagaacgactcagccgtttcgggggaagaggaagttggacaacatcggctgttttagtgctttttatttttccccaattcagcagagaatattttcaaggggggtgagttataatgacctatcgcgttttactgagcccagttccactcccgcccttccttggctttgtagggtctcccctccgctccctcggaagcgcttctaagaaggtgggcagagggggggaggtttgctaccaacagctcatgaataattcatgagccccgcccttcgtcaggaagccccgcccctccggatcgcgctgacgcacgctgcgtttaccaaacttaaggaagcgacgtcacaggcccaacccctaagacggggggcggggcgccagtttcagcacgtgctgcctctacccgcgcaagcccaaaagggtgtgcgcaggcgctgcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctccagctgcctcagttatctctgcacccccatcttcctcctcccgacatcgcaaacgtcgcaggacttccagcaagtcggaggcaggggctaggggtggaggccagggttccaaggaaaagggccgagggagttggggaggccgccaccaccaccaccacccactgcctgcagcaggcttcaaaaagcaacagcgcaagttccagtatgggaattattgcaaatactatgggtaccgcaatccttcctgtgaggatgggcgccttcgggtgttgaagcctgagtggtttcggggccgggacgtcctagatctgggctgcaatgtgggccatctgaccctgagcattgcctgcaagtggggcccgtcccgcatggtgggcctggatatcgattcccggctcatccattctgcccgccaaaacatccgacactacctttccgaggagctgcgtctcccaccccagactttggaaggggacccgggggcagagggtgaggaagggaccaccaccgttcgaaagaggagctgcttcccagcctcgctgactgccagccggggtcccatcgctgccccccaagtgcccttggatggagcggacacatcagtcttccccaacaatgttgtcttcgtcacggtaagagggtccagaggctcttggaataggggccaggtgtgaagatgagattaaatgggaatgtagcagggaaggttatgacccagatcctcaaaagaggggtctgggttggcaagtgagagcctctgctgggcgtctctcccctcttataacctggaaaggtggggtgtctaccttggggcattgaccctggagtcctttgtcatgactgcaaggatctccaagatagaggaggactctctttttgctctgctcccggcttggcctataatccacactggtccaccttcccttcccttgaaggctgctgctcactagggaatttgatccaggtggaacttggtcctcagatttactgaaggagcctgagaatgggagtcagacatggaatgtcttctagggaggagattagggtagcgacagactaatactggcgtttctgccctttgatagccaccttgctcctatcagcggcttttgttttcctagacagtttgttgaagcgtgtcaggaacccaagtggtttggctgtagatcctctccacattgaccctagatagtgggagagggaagaaccagaaactcctctgcagagaggagagagtcctgtgccctgcagagtcccctgactgcacacagctccccagagaacactccagttaggctgcctactgggatctttggcattgtgttgggttaagcctgaagaatggtctttttagagggttgtgatgagctgagcttctagaaaaggcttcctaaaggatgtggctcttcatttctctcagagaaaggaaagaataggcctgaaactttgccagccccaactgcagggaaggaaccacaggtctgcctttgaaacctgggttagttacccttgcagaacctgcagtcactccacttaatgtctgtgagtgagaataaacacaggatatggtcctgggaccctagctttggaagacttcatggataatttgcaccatttaaaattactcaggctccgtcgaccttttttggcttaccaccagtaggaagaagcagaggcaggaaggtgtagaggagaaaacaaaactcaaagagggcaggcaccttttgggagttagtctgagaagaaagtggccacgggctaaagtgaggccgcgggactgtatcggcctcagagcaggttgcctgggagcaggggttctttgattccctcagttgacctcactgccgattcttgccctcagggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagtgagttgggtgttgggggaatagtcattcctttggttgaggcaagaaaaggccccgaggtgggcatcgcccttggccaggggaggcggcagcgtgctgaagtggtcccttgcctctctccttaggaaacgatctacaagaactactaccgaatccaattgaagccagagcagttcagttcctacctgacatccccagacgtgggcttctccagctatgagcttgtggccacaccccacaacacctctaaaggtaaggctggtttattttgtcagggaggctggtcctggctgaaagagtgcagacccccatggggattcttgaggtgctgccaaccccttctgatcactctctctcccctcaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgtttgctgacctctgttctcttagggcatgggaggtgggaggatatcaaattctctagccctttcctcctattctcccaaggagagagattcccatttctcctcggccattgtacctagctcttgtccctagctgcatttcagtggaccatggatagagggactgagggttagacggggaagactggcagggaggcacgcaggtactgtgaaaatccttccctttgccctcccccagtgggagagggggttgggttttcaatgtgagaacagcacaataaacttgatgtctagggcagtggccccc

SEQ ID NO: 38563 - DNA, 64909 bp, Homo sapiens
cgcgggcgccgagaggagaggcgaggcggggagcgcaagcggcggcggccactgccacgtattcccggcagtggtggcggcggcggcggcggcgcccgcgggcaggtgggctgggagcggcgcggcggcggcggcggcggggcgggcgagccggcgggcgggcgcggggcacggggcaccgggcaccgggcgggggtgcggcgccgggacagtacggttcccgccacgccggctccgcctccgcgcagtgctgctgacccaggcctgggcgcccggcgggtcccgagcgcaactcgtgcgggcggggttgggggcccgagggactcgagctcgcctgcccgtcgcggctcgagacgctgcatcccggttgctgcggggcgggggctgggaaaagttggggcggaccgcgagcccgcggggccgggcgggaagtgcgggtgcggggcggactcaggggccgggggacgcagtgcaaagggcttgggccggggcggccgggagggccccgtatgggaaggtgggaaacgcgggtcctttgaggacgccgagaaaggggtgcgctcagggtctctgggagtggacaagagtccggcggcggaccttgcgggtgagaagggtcggcgcctgggggtcggggagtagaggtgaggcgggggcgggatagagccttcctcctcccccgttctttcgggaccgaccctgagacccggggcaggctccgagctgggtacgcctctggcatctgaagacccagtggggagttcctgtacggggtgggtggaggagggagctgagcgttgcttcctctgctgctggggccgactaccgcccctccccagcggccagattcacctcagactgcagtgcttttgccctgaggaagttgaggagggacagctgagcggatgagatgtttggggtgttccaagatgagtgggattaggctgcatgatatcataactatctccgggagctgtcagaaaacactcccatgtcctcatacacccacccatccactcatccagtcagtactgccaagctccaggctcccttgctctttaagtgacacctctagatccccagagcccaacagcgcatctgctcacagcctcgagggtggcaagggtggaagacatggcctgctagtgtctgcgtaggttggtgctttcagaaacaagtggttctggaggtgctggatgctttattagaacaacctgtgtggagcccgttgacaatgcagatgactcatgttggctttttttttttcccctttacaaataaactttgtattcaagacaccagtatgcctggtcatttgcagcagtgatacggcaagagacccatagtgggcttcttgagcccttattctcgtcctagatgtgttagcaagaagtttgaccttggatgagtcacttgctctctctggacttctgttttcttatctgtcacatggggtataaagagagagctcgacagtgtgatgtagacaggagtaggtttctgagggacacagtgaaatcttttttcttgtaaggctggatcagccacagaaaataagccttagcctgttcttataaagaaattagcttagatttaaaataaaatatgagaagaaatattgcaaaaagcaaaacaacaaaaaactaatagtagttggtactcgatttacaacatgaatactgttcttatgcttgcagttagtgtacttggttgtccagctatctactataaagttgctcattgtgcttagaaagtgtgtatttcacctgtggacccgaattttttcttattgtttaatcttcaagcttggagtggacgctcaagcttggagttggattggtcctgctggggtttgtctgaagaacatcctcagggtctctcattgcataatattataggtttccttctgtctgactgatgctggggtccttgtacaactatgcttctgccatcttttccattctggcttgagaagtggtgagctggttcctcttgcctctggcatgcccagacttctcatttcttttcagatgagtgtagtaaaaggcaagcagtgagttagaggcagcacattaaaaattgctccaggcaatcatctgtgtcccctccaccccgctcctgtcccctagaccccctgggcaacttctcactagagcttcctggtcataagctggccttgacattttgggtgctgagggccatcacagcattgaagtgacttggccagggtcacaccacacattaatgatcaagccatggtgctggaagaagaggaattttttttgtgtgtgtattttgtcataactgaatgttcctgttcttgtccattagtagctttcaaaatccatattgggtttgaccacatcattttcagtaatccttttttgtcagctttttggaagctgcagttagtggttctctctgagtttgaggtagtggtattttattattaaacaattttttccaaatattttttaaactactttccttttcagaccagatgaggtagtgttaaaaatgatatcttctccaacaagtaaaggcttgattaattaggttgagtctttaaaatatctagtgtttgtgtgtgtataaattttactttaattgagaagtattgataaaaatcataatcgtcaccatttgagcccctgccattgagcaggcattgtgaggtaggagtgagcatcattttacaggagagaaaacaaagccaagagatggcacgactctggtacagctgtcgtgcataagttactgatgatctttcaatccatgtaccattttgttaacagtggaaaaggaattctcagctatcctacagggttgtgctagttaaatgagatactgtatgtgaagagcaacaagtaaactcttaacgggctccctaacccagcacattttaacataaacacttgtagactctggaagcagtgtggtgaagtggttaagttcaagcgtcttgggagtctggcaggcctgggtgtaaatactgaacctgctgcctgacctctctgagcctggtttccacatgtgtaaaatcaggataatactgtctgtcttatattcaagaaatgtacccactaattgcagtgggtgctgagtaaagattggcatccactcctttcccttgcacacaggtacttgggtcaatgggattgagtaagtctttcagcagttgtcctcagggggaaaaggcttaaagtactttttgtacttatcaatgattcttctagcctttttgccttcccaccctaagccccagcacgcgcaatgaatattccagggcctgtgattgtcttgtccaagggaattgaaaaaatcgtaagccagaaaggacaggtctttgatagaaagttgaaaatggatgtagctggtttccctttgcccattttgtggccttcctccttttttttttttttaaattaattttgttggacagggaaaagatacagaattcagggggttctagctggaagggggccctggaagagcctatagtatagggcagctagagagaggagtgggctggctgacggtcaaagctagtttggtgtgggggaaatttctgttagatgcaggatttggcttaatatgggaccaatttccatctagtcctttaaggccctcttttgggactctgaagtttttgtgctccaggcagattttgactggttgtggtggcatcacaaatgagtttccatagtaaattgtatgctgaaaggaaattaaattccaagagggtgtttgttgtgactgatgccagaatttcctctgagaattttattaacattcagtctgtgaaagtacttcttagttctctgaagataataattaggaaatagtttttaaaaagtagaagtgtcgtctttgtgagcttttgaaatgtcatcttcctaaatctttggagcaaatgaggctcaaaacatcatagagacttatattttaaaagcatttcttcctaaatgtactgttttccttctcttcctgttccttccgtcctcctacattattttgataatgagttaattttggtttctttcacattgtggtggcctaatttttaaatttatgacccttcatttttagatcttgcatgtatttttttttttttacccttgagtcaattctcattgattatgaagagctggtatagcaagatgggaaagagagaggaccctggagctaggttggtgagatctaggctctttagaacttggattcggtcctcacagtagctctgggaggctgatcatgctattcccaacacacagatgtggaaatgggtgcagaaacacatgtgtgttcacatagccagcaagtggtttatctaagtgtcactgcaatgatctgtaggactccaaagcccatgcttccagctggaaaggcaggcaggggccttgcatgctgtgccagggttgggacttagtcctgtaggcagagagggtcaggcctgtattctagaaaggtagctcggtggctgtctggagttttgaagtgaagcaagtagaaattaggtgtagagaaactagttcattaaagtaatgtcttgagagatgagggcctgaacagaagacattaagacagtggcagtggttgcggagaagagggggcttgttggaatccatagagcttagtgcctttggatactagaattgcatcatcccttcccatttcaggtctgatgccccagggatgggtgttggagatgctgactatgtgcaggctaaaagcaatctctgcagaaaccaaaagtgcctcctttggtctctgctaacagctagagaaaggtggctgagcacagtccgaaagggccttcccttccctgtgccaccccagccttatcattcctaactttccaggagcatcgcagagaatgaagttggattcctcagactgcattttgggaaatgctagtcaaggttagaagtgtggaagggaagacgccttcctggggtattgtctgcacacccctcttccctggtggcacaggggacccaccagggtttggtcctcagttttggctattccataagagttgatctgccctagatggggttaacttgtggtcaccaaacttgcaggggttgactgggaagcaggagtggcagtgaacataatggccagccccaagaggagtcgaggccagcctcctctgacgggtgcagtctctgcggggcgccaagccatgctcagggaagcgggcatcagagcccaaggagatgattggctggggtctgcatgtcctgtcatcggtaggacgcactgttgccatgtcaggaatatactggttttgtgccctttcccctagtcagtgccagacgtggtcataaacttgcttttgggcttccgtttttccaaattgtgcaacatccctgcccttctgagagtttgtgctggctctggtcaggccggaggtcaggtggtcagattctggctttatttgggctgtgttctcgctgcgaggaggaagccaggttacctctgttggacctgcctgctcccagcatctccagcaacaagctgtctctgccggtgagtcactccgtgcaagagtctgctcacccactttctgcttgatgtttacacttttccctcaaagagggaacctcttcttgttctgagggcacttctcggcagtcccctagagtgtccagttgtttcttttgtggggtaagaacccgtgccagacaggtacatgttttaatgggagaagagcatttctgcctgtggatatgagctgtcatgcctacctcttgaacattatgtcctgagcaaagcccttttctcgttctttttgcttcgtgtttaggtgcgtgtttgggtgtgtttgctttaattattactgggaagcaaaaaagatatttatcaaaggtttaaatctatagcagtgcccctgcaagcagaaagaagaagtatatatttagccaggatatcattgatttatcacccttttttccattttgttcctgttttgttggcaggaccatctgatttgtatactggttcagtttggatttcagtagtgagtgtgaaaagattcctgggctgtttgccgaagtggagggactcaaatgcgtgggcttcagggctgccagtcttggctgtccctgcaatcccaggagcctggcacatggtgcctttgtcaggaaggtggagtttggccaggccgtttctttggctttgcctgggagcagctctgctggtgacagtggaggcctccctctgccgtgggaaagggaattctctcttgattccggttttggcttatttctcatcctatagggatgagagggaggaaggccccagaactagtgagttttggtgatgagcaggttcagggtaggactggtttgcagcttccacagagcttttacagatgttttccttgcatcccacattttccttcttccttgttagtcccaattcagtctgtcatcagtactgcagaaattggcttgaactttgtcagtcttgggaagacctggaagtgcagcatagaaacctgttcaaattggtgcagcaatttcacatcagcataagtagcttgttttggtggtggtggttttttaatcagtttaggtgctttttttctgaaatcatataggtaatatgtaaatgtattctcctgcagcctgcccttgcatttaaatagtgcagaaggacacagcagacttgtcacattccccttcacccagcacccctccccaggtgccagctcctccaggtcctcagagataactggtgttagcagttggatccgtgtcctgaaactgtcaagcctgtatacacaaatacactatggttttccttcttttagaagcatgaatctgattgcatcatactgcttttttcacatagtatattttcgagagcttttcatgcatgtagctcttctctgttcttttaatttgtcttttatttgcctacaaaatattttccagtgtagttatgtcataatttatgaattggtcccctactggtagacatataaactaactcattagttttgctattatatcttcattcatacatattagtatgcacatgtttctctaggagtagaattggcatgtcaaatgttaaattcatttaaaatgttgcagcagtacccatactatgctctcaagagatgtgctagttcctgttgtcagtggtaatgggctgccattcccctgggtgaaagaaatggatcattgttcagtaggcatttcatttattattggtgaggttgcaaacctcatcatttggcttcttttttttttcttgataaacagacatgtttaatgatagcttgctcttcacagagatgtctacggagactttttatctataatccaggagtatataaccatgcagcacagaccaattagccaaatgcaaaataaactagattcttaccacaactatcctataaacactgcaactattctttccaaaaagaccctaatcttatgtgaaaacacctactgtgggggaaccagaaacctagctatgtggccaaaaggaaaaaatagcaattcagtggttaattggtgaaagcaggaaatgtatgtcctttactgtgctgctgttgctgctgctgctgctgctttggtcttcttagttttgttctttttgtctctcttcttcagcccatccatgttagctctcaggaggtttgaataagccatctgaaacttattcacttcctcggagctcaccactgtgctgatcttctttttcccatcggtagctcttaacagacacttgttgtctgcaggctcaaagccctccacagtacctttctttggaatggatttggttcgactgtcatacttcttcaaggtgatatgatgctgcctgatgtccagcacttctggaaaagtctggtcagctccgtcaggagctgctcgctctccaacaacaccatcgcggcgactctggctcgactccctctgcttaagcccctagcagtgagaactggttatttggcttcttgattcttattgctgagatcgtagatgttaagagtggtgggtccatagcaactatagaagatgagggaaccaaaccctcaaggaccatggctcagctcagggtggtgtaagcgtcatgccaccagtggtggcattgtggtacctggaagcaagagctcctgatttcacattctctgtttctcccggatgctagttatggtaataggacattttaattttggtgtaacttgccagagtatttctccaaacctttcatctgaggaatcaagggtccgtaagtattaagatcagtctgtcctgtgctgctgaggcgtggattggagactggggaggggcactgggaagacacttaaagattgcgtgctggaaaatcaggcactgttgcttctggaaaagcctccaggaatgtggtaaagcagatgttttcttctagttgcatgtgattattccccctctcctggcttgctatgggaatattgtggtgctttgacccttagcaggatgctctggggagaagcgatgacttcttagaaggtgtttgaggggtgtgacacaatgggctggcagagaaggcgtctggtggcttccatgaatgggctgatctcggggccctccctgcaggctgggctgtccagtggacacagtgggcttcggaaagccctggcttactggaccacagagtcctttacctattgctcaaaggggcagagagcaggagtggtggagggggaacccttgggagatgaagggactgcagagttgagccacactggacccagctcccattcagcaccttatgggtgtgtgccttgagcagctattttatctccctgggcctcagcttttccctgtaagttaggaataataattagtacctgcctcacagggttgttgtgaagattaaaagaataatgtttataaatctctcagcatattacctaattagtacttggtaattgtaagtaactccacctatttgtgttcccttttccatatatatatgtatctctctctctctctctctctatatatatatatatatatgtatgtgtatatatatgtgtatatatgtatatgtgtatatatgtgtatatatgtatatatatgtgtgtgtgtatatatgtatatatatatgtgtttgtgtgtgtgtgtgtgtgtgtgtgtgtgtgtgtgtgtgtgtgtgtgtatatatatattttttttttttttttgagacggagtctcattttgtcgcccaggctggagtgctgtgccgcgatcttagctcatttcaacctctgcctcccaggttcaagcaattctcctgcctcagcctccctagtagctggaattacaggtgtgcgccaccacgcctggctaatttttgtatttttagtagagatggggtttcactgtgtttgttggccaggctggtcttgaaccctggacttaaagtgatctgcccaccttggcctccacaagtgttgggattacaggcgtgagctaccacacctggctaataactgttttaaaatgagtgactacatatcatatttgcatattacataagtagacttaatctggtaacattaaagagaagaggtcaggagattagtagctgtcggggcagatgagggtgggggctatgggaattaaaagggatgaaggtgggaggcttcggtggaggccttaggtggggcaggagagttgagttgggatgttctcttccaataccattgctcctgcagaatcccctcctttgtgcacatcagagccccacacgcagaggccttttctctttttttagatagactgagggttaggggattgctagtgcaacctctaccctttatttcgaggtggctgagtggggccctgaaagccaaagtgtctgcctcaagctacacagatggccaggacagagcacaagtaggcccagctctctgtgctctggggagttgagatttctttcccttcttccctgcactgccatgtgttgcttatagccagatgcaggaaagagacatggtgttaggcactttacaaaggtctgccgtttactcctcccaaggttcttgtgagatgaggttgagatatgcatgttcttctattcctacagtgccagccacaggttgatgtctgctggtttcattcccctggtcacctgtaatcaaggggagggcaaagactggatcctgctccctctttcccaccacaccatgtatgtcgttagtttttcctgcatggagcagctctcctggggactggtgtggcagtcagtattatttatcgaataaatgagcaagatccaattcagtctttccctggctctcgtgtctctgaaaagagaacatctgcctctccgtttggccctctgggattagtatagcacccctgcctgcctttaagcttatcctccttcactcagaattcattcaggaaatacactgttctaggtgttggtgattttgcactgaacagaaggagccaaaatcctgttctcatggggcctattttctagtgaggatgacagacaatagtgattaaaatacacgacatgtttattaggttcccagggctgctgtaacaaagtgccagaaactgagtggcttaaacagcaggagtatgttttcccatggatctgggggctctgaggggagtctgttccatgcctcccttccagcttctggtggttgctggccgtccttggtattcttggcttgtgggagcatagcttcagtctctgcctctgctgtctcatggcattcccctgtgtctgtgtatgagtcagggtgctccagagagacagaaccaataggacatagacagatagatgagaggggatttattaggggaattggctcacatgactttggaggctgagaaggcctgtgacagggtgtctgcaggctggagaacaaggaaggctggcagcgggactccgtccaagtctaaaagcctcagaactaggaaagctgatggtgtaagtctcagtttgaggttgaagacctgagaacctgggggtttgggggcaggatgtgctggtgcaagtctttcttactcagttgcctgattcaaataccagtctgttctggaaacacccagatgatgtagtactttactagctatctggatatcttttagttcagtcaagttgacatctaaaattaaccattacggtgtgtgtctctgttttcttataaggacactagtcattggattagggcccaccctattctagtatgactgtgtgaactctgaatatctgagacaggtctcaatcagtttagggagtttattttgacatgcgcctgtgacatgcacctgtgacacagcctcagaaggtcctgatgacatgtgcccaagggggtctgagcacagcttggttttatacattttagggagatatgagacaatcagtgtatgtaagatgaacattgatttggtccagaaaggtgggacaactcgaaatggggcaggggcttccagcttataggtagataagagacaaatggttgcattcttctgagtttctgattagcctctccaaaggaagcaagcagatatgcatttatctcagggagcagaggggcgactttgaaaagaaagggaggcaggtttgcctaagcagttcccagcttgacttttccctttagcttagtgatttgggggccccaagatttattttcctttcacaactgcctttttttaaaactgtggcaaaaaaccccataaaatttaccatcttaaccatttttaagtgtacaatatattaattagtgttacctgtctgcacattactatgcatcagtatgacctcattgtgttagagttctgcagagaaacagaaccaatagggttatgtgtatgtatataaagagattcattataaggtgttggctcacatgtttatgaaggttaagaagtcctaagagctgcagtcagcaagtttgagaccccagagagccaatggtgtaagttccaatccaagtactgaggccttgagacccaggagagccaatggtgtcagttccaatccaggtactgagaccttgagttccagaagagccaatggtgtaagttctagtccaaaagccagcaggcttgagacccaggaagagccagtttctcagttcaggtcagtccaaaggcagaaaagaccaatgtcccagctcaagcttacatacactgcaagaggaattccctcttactcaggctgtttgttctgttcagatcttcatttgattagatgaagtccacccagatgagggaaggcattctgctttattcagtctacccattcaaatgttaattgtatccagaaaacatcctcacagacatacaaggaataatctttggccaaaagtctgggcacccatggcccagtcaagttgacacatgaaattaaccatcacactcatcttaaaatattatatctgcaaagaccctatttctaaataagctcatattctgaggttccaggtggacatgagttttttgggactctgttctgtccaggtggtatgtgagatattggtgactgctgaaaaagtggaagagtcccgcagcagaggggaaggtgaggtggtcaaggagggctttgctgagaaggaatgtgtgcacttggggctggagaagggggagagagggaggagctgctgtgtggaggaagaggattctgtgtgaaggggacagcacaggcagaggccctgaagtgtagggacagtacaatttgagtccattgtgtcaggggaggaaagggagaggttgggagtaaagaagaggatgaggatcaagaggtccttctttgcgtggactgtggcctttgttctagtaagatgggagccactgttgtgcctgtgagcatgaatgaaagcaggtagtgtgggccagctcattgaggacttttctaagttcagatggatgtagctgagctgtgtgtgtgcctagatattttgcagcagctgtttctaggcaggtttttaaaaaatgttagtgctgtactgacccttgatccaccaccctttcctttctgtatgcttttcacctacccacccacccacacataaaccacaaacacgaagaagagagagcaaacagacaaggctgtggtggcaggaattgctaggaaactgtgtgcttagctgccctgctgtgagctgcagggcctcacacgtgtgaactggtgggctcttccccccacgaccccttcagccttgggcctgcctggtgaacgccatgcctgccattcaggtggtctttaacctgggtagatttagaaaatgccaaggtcagtgtgcaagctatgtggattcttctgggcttccaggattcttctgtgtataaaatcactatgctgtgaaaagagttgagtcagctctcctggtcagcaggccacatttggccttgaaaatgtgggacagggaggaacatccaagaggacctttggagacagtgagtagatggctgtgtggtcttggtacgtgggcccagggccctctgctgccagccttgttactggcctacaaagtgttcacacattgttgttcttatttgtcataaaaacacttcagcctgcaatctgagtattggtcattaaaaagaagaaggaactccaggcggaggctggccctcagcgggcctggcctgctggtctgtggcctgtgtcgtcggttcagtttgcccagttactgggggaatcactacttcagattccttggccttggagttaaagggaaatatccttatttggttgacatttaatttcctttttgcctccaaaggaaggggcctggcccttgtgtaatgagggctcgggggaagtgggctatatgggggcctgatttcagactctctctgggctgtgcgggggcctgatttcagactctcctgcctccacttaccaagatagtgccagaagcagcctgcttggggaggttatctgggaggccgatgtcattgtgacccctctggggagcatcgctttagaagataattatgtgtaagtggagatgaaaatagaattctccagtgccaggagcagctgctcttccgtagtgtttcaggagttgcctttggggcccctccttcctcccaaacaaaacacacccatccaaaatgaaagttgtgaagatgattcctagctagaaaagtgagtgttacaaatgtgttttgtgagtgtgtaattccagaagttatttttagggtgttctttccttagcacatcaaaagagcttccttagaggaactgccttttaaattgcacagcctttctctgccagagtgctacaggaagttttgactcaggtagtgttccttcagaatctgtggaggcaggctttgcttccttgttatagttagaacagaaaggccttgcccacgagtgggagccagacagggctccacgtgttcccctcccataagacagcctccttgtcctatgcccaggggtggcttttgtctctgctgacatgcccccaacatctagtaaatacgtacttgttgatggacaggatgtattggatgtgggccctggcatctttgctgggctctgagtaggcggcatgctgtgatttcacttagaaccctgagaagttggtcttctggtatccagattggtactggaacattaagttctgatttcatcactgctgccttcgataagttacttgcctccctgggcctcagttctctcatctttaatctagagggttggatgaaatgattggcatgggggtctcccttcacctctccacccactctgggcagccccttgcactgtctccctggtcacagtgcgagctcctggaaggtagagccggtttaggcacagggaacatgaactttttatcccagccagcctgataaatacagggcttccccagaactcaacatgcttcagccctggtgctccctgatggcctgtctggccagacccccagagttcttgctttctgggccaacttggaggcagagacgagcaggtggtggaggatttggctaaatctccattctggctctggaggcgggtgtctccagttgctcaacctgatctccttgttcttttctcaagtttcacacaactttttatcctttccttgaacaaaggctttttatttctggatgatgttgtgagaagtttttgtatttataagtaaggcagaaaagaatggatcataactacaaaattttatatcaattacattccaaatttgttaagaaatatctatgtgtaggaaaaagaccataaagtactttattttagtggtcatctctggattttcatattataggagggctttttaagcattttttttacaatgagcatgtactgtctttataactattaaaattattaatgataattaattattatttattaggatttagtatgtgccagacaatgtaagaacttgccattacagtatcttatttaattctcactgtgaacctatgacattcctattttaaaaaaacaaaatatactgggtgtggtgacttgtacctataggcccagctactcaggaggctgagttgggaagatcacctgaacccaggagtttgagggctacatagcaaaacccatcctgtttcttaaaagcaaacaaatattaacctaatttttgttattgtggtgaaatatacgtaaaaattgcttttttaggctggttgtggtgtctcatgcctataatcccagccctttgggagactgaggcaggaggatcacttgagcctaggagttggagaccagcctggacaatatagtgagaccccatctctacaaaaaaatttttaaaaaattagttatgcgtggtggtgtgtgcctgtagtcccagctacttaagaggctgagttgggaaggtcgcttgagcccaagaagctgaagttgcagtgagctgtgatcatgtccctgcactccagcctgggtgacagtgagaccatgtctcaaggaaaaaaattgccttttcaactatttttaagtgtatagttttgtggccttaaccacatcccctgagagatttttttttggaaccccttatgtgataaatgaggacgctgagacttacagaaacaaagctacctgcccaaagtcacagagctagtcagcttcagaggcaggatttgaacccagaactgacatactcagaaaggtcccaggttcctgggatctgtggtatataacagttggagtccatgatcactcttctgcctctgcccaccatttgacagtagaaagccatttgctagtgtatgtctcttttttgaaactctaggggttggattgtgtttgccagtgaggtggtggtcagcccgatttagggtgtgtggctgacgcaggtgctgcctgtcagcggttgccaaggttggtttgtgagctctgttgtgtcttgagaaggttgaagagtgggctgctgtactgagagggttgtgtgtcggaattctgtctctagaaggtcctcagcagtgcagtggaaagggcaatggcctagagctcagatatgtggccttgtcaggtctgggttattttggagaacacacattgaacttgggaattagtctgtactttagtcctgattgtgccgtgtggtagacatacttaggcttccatttcctcatttctcagtgagtgataaaaatgcctgttccacctgcctcccaggatggtggtgatgattaaatgtcatgatgtagggaaaaagtgctgaggaaaccacagggctctcaaggaagtttctctgatgagaattttgagtgtacaatggtgcgtgagaacagtggggctgaccttggagatgtgaggaggatggatgcggatgtgaagagcagcaggtttgctttatttcatttttgtttttggcagcagcttgtttcctctaccatcgcttcactggtgaagtataatgttccactgtctacctggtgttgtactgcctagtgctgaatgctctaggatttcactggaatttgtccctgccaaattccttggattcactctccccaaaactctcatctctttggtgaaatgagttgtaatttaggagatcattctgtaactgcggtggttgaaagtacatagcaactttccctggtcttgtttgtcttcctaatttttttttttttttagcaaatatttgtctgtttctgttctctaatcttgagcagccaagcgtgtgagtgggctggaacctggtggtctgcccctggggaggggagggggtcccccttgggtggtgcttgctcttcattggaccctttctgtgcttgatgctttgtagaacatcaaggtacagtaggcagaatcccttgttttatgggaagatatgtatactcaaaccaatatgagtgttagggatagacagcttgagaagtccctgtcatgagaggtgtaaccctcagtccaagtggatgaagatggattattggggatagtcagagaggataaactgttggcaggacttctgtgactttttgctttttcacaactgtttgaatcagctctttccaagctggggtttctgtccagctatcctgagataatttcttgagtcatcactgttgcagtgcacgtttcatctgacaggaaagcaggggcccatgcagggctctgctgaagtcagtggccctgtcttgttttttggctttgagaatggtactcgaagactaagtaggtcacagatatctattttgaattgagtatgactgggctgcttggacatctaatttccggatccaatcctgttggtcgcgtttgcccaggagtttggcagcaagcactctctggttggtcgtagggtgtatttataaagtgggaagagtctggagacactgcagttctctattcctgcaggagagccaggagtgggtgggcttcaaaaccctttaggaatggggggagtggaatttttccacctcacttccttaaattttctgaaaattgctgatcctcactaactctatggaacttttttctttcaaggaatcaaatttaatttttacccaatattagctggcctctgcttcaagttggataatagcttcagttgctgtgtgccttgccttttatgcagattatctcatttaatcctcacaacaagctcagaaagtggttattattttctccattttacagaggaaaagacctgagaatcagtggggcagtaatttgctgacagacccagtgtgtaagtagcagtgcttgagattcaaacgtaagatcttctgatcagagtgtggccttttgctgcatagcacagtggtctcaggagccctgggaggtgttctggccacagctggaagtggcagcaggagccctgggagagggtattctgaccacagctgggagtggcagtacagtagtggctccttggcccattgtgggttgagtgcaaccttcctctgagtagaggccagctgtgggtgttggggatgtgggccgcccagcccagggaagcatctgtctttgtggaactggagttatgttttatgatgtcactctggtgtgactggatcacagaattctgagtttataccctttgttggatttttttcctgtttcactatttttctgtgggtccttgcccaagaccttggatgagtgcagtgagcaggcgagatctgtgagttaacataggtggggaacgcattggatgcaccacctcctctgtgtgcactggctgttgacccaccattcctcatcatcagtactccgtgccttccctgcattttggaggactaagcacttttgtagcggggagtgtgtgttttgcctttctcttcagtttgtccccataagctacttccaggggcctggcagtaatgctgctgctccaggtcatttgtgtttgtggagtgtcagagttttcaggactttgcccagaaagtcttgtccagtgctcccagggagtggtcgtcatcatctccattttacagatggggattcttaagggaagtcactcttaggtagcatacttctataccatagcttcccctgtaagtttcataaaacacaaccgagaagatgcctgtttaaaatcagcttgtattccgaaagtgaaagaatgccctcttcaaatgccctggggatcgtgtacacagtagggttctcttctccctcaggaatgtgtggtcccatcctaggttccctcccggccgtttcctggctttgtgagcctgagctggttactgaacctttctgagtctgtgtcctataaattggtgatgatagtacaatctaaaagaggctgtggtaagatatatatgagatagtgtatgtgagatcacccaggctcaatgtgttgtaatcgcttgtttttatttttcaaccaggatggcttgaagaaaatacagatctcagctacagaggttgaggcctgagaaactcccctcccctgaagggcattagtaactgatcttccctgcacacttcctcccccaaaacaagaaggagaggatgaagcttaaaaaccctgtttcagctagaatctttccaaggttttctcattcttttggttttggaatggggtgctgatatatgcttcatttactggaaaccaaaactaaggaagtccatgttaaccacacagcctctcagaaatgcccagtatttttaaaaatgaggaaatgccaaaacacgattttagaaagcggggtattttaaatttacatattggacgtgtcagcacttttagcacacacactttcactgattgtataattatcttgaaaagacttaaaaaactaaatttgaggttttctggtctcatttcttgcggggtcttgctctgttgcccaggctagagtgcggtggcatgatctcagctcactgcaacctctgcctcccaggctcaggcgattctcctgtctctgcctccggaatagctgggactacaggcatgtgccaccatgtccagctaattttttatattcttggtagagatagggttttgccatgttacccaggctggtcttgaactcctgagctcaagcaatccacctgccttggcctcccagagtgctgggattacaggcgtgagccactatgcccggcgtggtctcacctcttcaaagacctaatcagcgtctagtgggtaagtctttttgttttttttgagacagggtctcactctgtaacccaggctggagtgcagtggcgtgatcacagctcatctcctgagctcaggaaattctcctgagtagctgggacaggcaatcctcctacctcggccctcccaaagtgctgggattacaggcatgagccaccgtgcttggccagctcttacatttttggtcacctagtgacagaccttttttcccttctcctctctctcctttccacattagtttttatgtttgagcctagacaagtataggggaaattccagaggaaccagcaaagtgacctgcaatttttgatctttggggtttccaattttgtgtatttgctgtgtgatcttgagcaattctcttacttcaggtctcaaggaacttagcatctcgtaggggagatagaactggagttgatagccctcttattgctgtggctacagacaaggattcttgtcctcagtgtggtggtagtggtttttaagtctttatgtgttataaattagaagtttgcaaggtgtggtttttgacactaagggaattgcaaatgggatcaaggactagacttccctgcatgagacactctctcatcagacactctctcatcagactcccagacttatgttataccacctggtgcggtcagttacagttacctgtttacctggccacctgcctagattaacagcaagctctacaatggcggagacttggcctatgccctgttatatcttaggcatcttatttattgtacttccatgtggaatacaacggatgcctgcataaaagatttgaaggatttcgaatcacttaacatggtagcaggccgaggggtggaattggctaccacaggtcttgtgttgcgtaaactggtcgtgccacatgaccagacttgtctcccttcctcccatgcccacagcccctctgctgagaaagacagaaccagtaccaggtaggtcccttgtaaaaagccagaggggtgagtggaattatcttctgttttatagaccaagatctggagaagtcacatagctaacatgccagagagtcagcatttgaatgtgggcctgcaggagtccactttttatacccttcacagatcggatatgctggtgcatctgcccctgaggacatattcagcgatacaaatccaattaacccgatagcccaagaaacttaaactagtctgaggaagaacttcctgacattttgtttttgttttgttttaaagtttgtgccaaaaaggggctagagttggggcttttcaaactgttaatcacaatccacagtcagagaattgatttagtgggttgatacatttttaaatgaaatagaacagtgaaaaataacaatgtgtgacacacagtaaggctgtgtgtaggtgcatccctcccaggccataatagaaatacacttctgactgtggatcaatgatcaaaatatctgagagagattatagcttcgattggtattggctagattgcgaagtccttggcggcagggatgttctctcttttatgttcccttcatccttagtccagtactgagtacttagctgattggttggtctgtctgggagaatttgtaacagttcacccctcagactggaagaatagtcagaatgatgttaaggacaatttgcagaatactgtctctgcaaggaaatgacaggtattcttacccttgctttatgaatgaggaaagcagaaagacaccgagtgtgatagttaagagcttggggtctaaagtctgagaaacctgtgtttgaattctgtttgtgcagtgtcatggttgtgtgactttgggtaacttttttaagcctgactttgtccatctttaggcagggtatgatgagggtacctacctcaggtattatgacagttagatgagttagctcgagtttagtggctttagcacagtgcctggcatctgataagcagttagtaagcattatctgctgcccttcgttttatgattaagagagattaagtgactcatgttgggtcccagggcaccagctggagccaggcccactgcaggagccccttctagagttgcagatctgtgatggttattgatcttgatctaaacttgtagctctaatctgtggtttggctgtggcagtgaaaggaagtgaatgttgcaacagagcaggtgtgtgcatacaaagagatgtcctggttttgccagttagagaaaacagcatcttccagagatatggctgcatgtggaatctgagaatataaatgacatttcttaggaaagccaggtgctttgtattttcatcaaaaacaacagtttcctaaaactgaatatagcaatgtataggcttaaactggtggttttgtgtcgacacagtgataattttagtggaaactccaagatttggtaaatactgatttctgaaatcactcactgagcctagcagcaccactgtgcacttagaacgaagtccttgaaaatacgtgacatgctgaaggtgaaaggcactggacagaaatcccaaagagacttggttttggctttagcccctaatttgcaagtctgggtctctgttcagttctcttttccaggctggagagttttgagccttctttctccttaaagtcaaaataattttgttctttatatcccgaagtgttgattgtctttgtatcttgataggaaaaggtagtatatgtgaaaaattatctaatggtcaaaacttgctggtttatactttagttgaaaatagccttttctgccttgtttggaagcaatatagtttagggatagttaagtataatggtcaagagcagaaacttttagctggatttaggttcctgtcctgcctgtgcttccaacaaggtgtttgactttggtgccttaacctctctgcaccctgtgtgtaaagtgggttaataagagaattgctaccttgtaagttgttgagaggattaaacggggtaacatgtaaaaccctcaatgcaatgtctgctcctaaactcttcagtgaataagagttgttaccgtcatcattatcatcatcagtattattagtggaaggtctttccaggagcccagaattatacacctggctgtgctgttgctaacagttgccctgggtatgttgctgaactcctaaacttcaggattcttttctctaaaacaagggagttgtccagatgcctctagtacaaacgttctgccccacctgcagcatgctttgtttctcatcaggcctgagcgatgccatccgggctgcaagggtttgagtccccttttccagtaaggacctatagtggctctgccagatgttggccctgctaacctttgcttttctttgcttgattttatgttcgtagtgtagctttctttttctggctctgccaaatgactcctcatggttttatatttttttctagtgtattcagactataggtctggcattggagttaagtcttagcttgggagagcctcacacataggggatattacaagtaagggtgagcccatcactttgctgttgactttttaaatatgtttgtgtttgcacctgtcacacttctcaacccaagtactgaggactgcctatatctgaggctggccattgagagccactcatgagaaaggaatggcttttctggatccataataagccaccttcttgctttgtttccttctttgccttggttttagttcgaacttttaaagagctcaccagagctcatcttggtgtagttttatattttgcacatgcatctttgttagcccctacttttgcaaaagatggagctgtggagttaatctctggtctgccattgatgttttaggtttatcttgttctcttggacaggcatgcacaatgaattaattgagttgttttcagcccacttcctgcctaattgaacacctgcccagtgaatgctgccaagtcacttgcctattacctgatttgccagccattcctgtcatgtcagtgtcttgcttgtatgcaaagactcagtcttgtcatttgtagttcactttctgtgttcttcagataacttttctttttttcatgtaatttaaaggcactcgtgcatcctcctttgttacagtccctctgcattcccatcttgccactgtcctcctggttaagatcattactgactaggcctcataaaaatgctgaaacaccagatgcaggacaagggcatatgtgcaccctgggttggttctgatgctttcgtatctttcccttggtcccaggctaaatttccagcaagccattcttaagtagtgctgacagtttagaactaattagaaatagtcttttaagggttgggacacaagatggtttttaaaagagtgctgtcattttttgacattagagacttgtatctttccaaagagaagagtggtcttactaaaaatgagaaccagggcgggaattcagccttctctgatcacagaaggccgcccctgttaatggcctatgcttgtcctcttgactgttttctttggttgaaaagtcttatagccagtcacatggctcctactggagccctggcttaggtgtgatttttttgttaaaaatatcctggagatacagcaaccccttcttagttatttggtagaattacatatcttttctcttagcctttcaaaaacatagaagtgtactgtttggatttcttctgcccagatttgaacttattcaaatgagatgagactggttatctcctttgatttcattgaggtttgcattttgttttcagtttccttctggcttttctttgcagaatttcaaattttaaaaatatttcaaaaggcatggctcctcaaaaagttaaacatagaatgatcataagacccagcaactccatcctagttatatactcaaaagaattggatcagggacttaaatccttgaatccaaatcttcatggcagcactattagcgacagtcaaaaggtagaagtaactcagccaggtgtccatcagtggatacatggatagacaaaatgtggtatctccatatctgtacaatggaatgttgttcagcaataaaaaggaatgatgtacagatgtatgccacaacttgcataaaccgcaagaacatgttatttgtaagagaaaccaaacaccaaaggccacatattatatgattccatttatacaaattatccagaataggtaaatccatagatagagaaaaagcaaagtaatggtttccaggggctggagggaagaggttgtgtggatcgactgccaagtggatactgattttcttttgggttgatgaaaatgttttgaaactagatagaggtggcagttgcacaacattgtgaatgtctaaatgccgtgaattatgtactttaaaatgtctgatatatgttatatgcatttcatttcaattaaaaacaatttggagcggcagcatatgtgttcttgcaaaagatggcttttccagtgacaccatacaagagttgctgtctagcagggtacttcaatgcgggtaggagaaggagtgtggagtcaggctgctggggctgggatcttggcttgtcacttggcctgggggcaagttggcctggtgagttgcctcccctttcagcctgttttttcttctgtaaagagcataaaagcattactttctagggttgctgtgagaatcagcggagataatggatataaaatgcttggtacactgtaagtgcttaataaatattaacctttatctgttctgtggaaggagaagaacaaagtggactcaaggagagaagcaaagtgctggaactagagaaattggagttgatttcagccatctaggtttgggttagacctttgagaagaattttaaaaatcttgttctctaaatttctttttagaagttgccataaccatgtgcagtcagtgatgctattgggagctgatttctaccaactaaagcaaagaatatttctaaagcacttagaatagtgcctgccagacagcaagggctcaattaagtgcttgattaaattaaagaagaaaaaaccaattggattacggcagtcgtaaggcagcagtagggtgacagcccctgcccacttcccttcctgagctctctgcttcatgcttgggtggtctcattctggagctggttttgtgagacagtgttgagcacacatcgatggagatgtgccggcatcttttgttagccctctggcatttgtaggaaactcagctactggggtcccctttgtaaatgtattttatgtttctgattcctgctttcttccttggaagaaaggtctttatcatcacctgggcccaggtgaaccttccagctgagtagaggacaaagaaaccctggatctaaggagaggctcccatcatccagctttaagggaaggtggaaggcagagggctatgaggcagggaaggctagtctgactttcactggtaaagaagtttttgtttcttcttagcacacaattgtagagatttctaatattaggatactactcgaatgtaaatgggtatgtagatctctctctctacttttttttcttttttttcttttttttgacagagtcttgctttgtcacccaggctggagtgcaatggcacgatctcggctcacagcaaccttcacctcctgggttcaggcgattctcctgcctcagcctcccgggtagctgggactacaggcacgcaccaccacagctggctaatttttgtatttttagtagagatggggtttcaccatgttggctaggctggtctcgaactccaggcctcaagtgatccacccgccttggcctcccaaagtgctgggattacaggcatgagccaccacgcctagacgatctctctcttttctaattccgtttgcgctaaatgtcattatgcacaattagcaccttttatatattggtggttctttactgttggtacttcacaatttagtgcccaaataatgtaaactgtggtatagaaagaagcaagattattggacttgggatctgaagaacagagcttagcagttatgtttacaggatttctatttactttatctgcctgactccccttctttcttttgggaccggcattctcccttcttcaggggtgttacttctcccttacccattaccgggacctgccaagcatggttcttggtctcctgtgttcttggtcttggtacaattttaattataattaatttttgtaattaaaaaatcttttttagtaaaagggataatttattatgagaaccggaatgcctcaagaaaatccaaggcagtaattgcagccatgtaataggatgttaagatggggcctttccctgccccaaatgaatgtgaagcagcctcctgtgtagaaattacaaaggaaaaacagaaccagttttactgcatttggaccccttgccaggtcaaagctattaaaagggggtcagactggagaggggagaggatttgatggataggtgtctttggacagagctgctgttgtgttgctgccaatccgcccagcatagatagggctggggagacgtacagtggtgtagtgcacatttgttcaagcccatctccctggaattttgaacttgaggcccaagagccttttcttctggggtggtggagccagagaaatgggaacgtgaagctgcagtgaccctggtttcctgtctggaggagaaagctggcttgctgcagctggcttggagtaggaggaacttgtaggcagagagaagcagagaagggagtgtattcgcctggaaattccctcctgtctggcctctcttccttatttcaaattttcttttgccaaggtgttttgttttgttacttataaccaagggtcctgagtaacagacatgaccttcgttaactcattgaacttcccttactctaattttttcctcatgtatacagtgatatacaagtaattacctcacagttacagagatgatccaataaaataatgaacatggaagcttggggggactgtagcatagaagaagtggaggctttagcattttgtgattattttactaactacctgtcactaatgatctgattgttctgcacatcattggttttctcgttaaaattctttcagaaacaaatggtgccaataacgcgctccactttttaaaatcacagagttgcttgacctgacctgtgtatttgtaggaaatgaatgaatggctcttgataaattatggcctttccaaacctaaaaaaaagctttctctgagttgagttttaattatattttggggagcagagagtattgcctccaggtcagatgagcttttcttcgtgtttctgtgccagggataatggtgccaaaattttagagtaatggtgcatttatttggccttggagttaagtagccttgggtttgaatgccagtgttgaatgccacttatctaactatgttgtctctttgagcctcaatcttgaagtctgtaaaatggggataattaccccaaccctgcagatggaggattataggagacgatgtgtttaaagtccttagctatgtctggtatgtggtagatgctgaacaaatgcagctgttactattaaaaacgataccttcagtaaaccatttgcaactaaagggaatgaggctagaaaatgtgaatgccgaaatcatttaatcagctattaattgaatatactattgagtgcctcctctgtgcaaggggtagcagtggagtggataagaagttatgtaacaccattcctgtttgtttattagggaaataaatcatgtacgtatggaaaaaagtaatacgtgaggcagctggggtttggagggtggcagaggattggaaatggggaggcttcttggaggtgtagagctgatggaaaaatatagcgagggaattgatgtcaggaattacacacttagggtgatctttggaagagaccaaattttatatatatatatatatatatatatatatatatatatatatatatatagcctcatcctgttttatttttcctttgtcttcctgattccttcccagatctgcttaatgtttctgatcattatattgatgacccatgccaattgcccattccagagtttagcattttctttgtagactaatttttgccatgaaccactggcctatagccctcagtgatcagaattctcctaacagattctgtatccctccttccattttccccactttaattttctgcactggaaatggccttctcaggagttccatcatgtggaatcatgaccattcattcagcagatgcttgttgagcacctacgacaggcagcatgcagggcagtatgcaaaggaggtctggggaataaagagattgatgaaaccaggtggtccctgccctgaagcagcttggttagtagaggaaacagatgggcaaatggactctaattaaatgtgattagtgctttatgttggtcagataaggaaagacatttggcgggagccccacatcccagagtcctccctcagtcacttactgctgtgcttggttcagaaaggctgtccccctcacggagcagtctgggaaaatgcattccttattaataactacgattctgatgtgaaatctctctatatagtatcttggttgggaaagtgtataagtgaagattccttttgtcacctccacccaaatcctcttccactgaggagtccagtcttccttcctctcacagacaaacctgctcttcctcctgggccctccatctcaaaattggcactgtcatcaatccagaggcttgagagcatctttgatacctccgtctccctcatcacctctatctgatcatccaccaagtcctggcacctctattgccctctcttccattgctatcacccaagtctaacccatctccagctgcaggtcatgacctatgttacctcattctgaaattaatttaggggttcccccccatcatttaacaaaataaaaaaatagtagaatgggagacattagagtaaattacatgtagtttaagtttgagttttattttgtcaaacttgtgtttgtgtataatagtttcacatacaaaaaaaggctaacattgctaaggtcttcacatatattgacttatttatctcccacaacaacctgtatagtaggtaccattatgcttatccttattttacaaaagagggaactgaaactcagagaatttgagaagctggcccagggtcacagagaatattagtgttccagcccccacactgcagccacaataggcttataaaatgcaagttggatgattcttcactattgatgggtcccatgctcttaggatagtataaagtctggtcataaggccctgtgtaatctggtttccccacacctctcgggcctgccgaccatcctcttgccccactgcctttcagcttctagatgtgccaggctttgaaacacctcagggcctttgcctttggcctttcagacttagttaggccccttcatgacctgctcccatagtactctgtattgccctgtattgtattgtagtaccctttcacagcacttactggagccaccaagatatacggtcaatgcctcacttaatgacagggacacatcctgagaaatgcatcattaggcagttttgttgtgtgaatattgtagagtgtgcttacacaaacctagatggtatggcctactacacacctagacaatgtgtctatagcctattgctcctaggctacaaacctttacagcatgttgctatactggatactgtaggcagttataacacaatggtaagcatttgtgtatctaaacatataaaaggtacaataaaaatatagtataaaagatttgaaaaatatatacctgtatagggtacttgccatgaatggagcttgcaggactggaaactgctttgggtgagtcagtggctgagtggtgagtgaatgtgaaggcctgggacatcattgtacactctttatgtggcagtgcagtaggtatgcttatgccagcatcaccacaaacacggagtaatgctttgtgctacggttttatgatggccatgacatcattggacaataggacgttttcagcttcattataatcttagaggactgctgtcatatatgcagtcctttgttcaccagaacatcattatgtggtgcgtgactgtacactaagtcctcatttaacctcatacatgggttcttggaaactatgacttgaagtgaaaccatgtataatgaaaccaattttatgaaggctaattgatgtaaacaagagttaaattcctattgcatatttctggcacagaaatatcaccaaacttctaaataaagaccccaaacacttctaatactaaacactgaagtaaatggcagctatacctacatttaagaaaaattaataagaacaagtgagatcactattgacccagtttttggtggatcagtgagtgagggtggtcatgtttacaaaatgaaaattaccagggtcatctcctcctaccgtgcagtttaaaaacaattacgaatatggcagctcactgagcactttcagaccacattgttaatgtcctgcatttgtatgattatactttatgaatttttttttgacaataatttgtattcattcatttatccattttctaacctgcttattccagtgtagagtagcatgtggttggagcctctcccagcagctcagggcacaaggtgataagcacaccctgcgtaggacacagtttcatcccaaggtgcgctcacatccactccgatggggaccattagacacataagtgcctaactccaacatctttgggatgttcaagttaggtatttgtagaggatgtaagaggaaaccagagtacctggagaaaacccacacagacatggagagaatgtgcaaactccacacagacagtggccccagctgggaattgattttttttttctttttatcaacgttataatgcaatgatgctatttgaggacctgctgtagttccttgctgacttcaggggcacaaaggctggcctgcatcagtccctagggcagcgtctggcatgacagtcagggaaaacctaactgggtgtttgattagctgtgggaggtgaaggaagggaggggtctcatttttggctgaatcgtctatccctgtcaaaatagtcctttcttcttcctgtcttacctttctagaaagcatttttttttaattggacatgtttatttctgtgggtgggtcaaaatcttttgagtgggctttttgtttttgtcccattttgagacggagtcttgctctgtctctcaggctggagtgcagtggtataatcttggttcactgcatcctctgcctcctgggtttaagtgattctcctgcctcagtctccgcagtagctgggtatacaggtgcctgccaccatacctggctaatttttgtatttttagtagagatggggtttcaccatgttggccaggctagtctttaactcctgacctcaagtgatccgcccacctcagcatcccaaagtgcttggattacaggcatgagccactgcagtggcctgtttttgtcttttaatctgtggatccccagtgtgctgctctaactagatgaagagctgctggcttacatctgttgggcaggcccttagtccttgtgggctgagcagtgtggtagtgaaggagtcctgagccgcagatcaagaggtggaggacctgactacaccacttctttgcaattcagccatgagacagcttcctgttccataaaactgtggtggggtgcagtggggttgggggtgggtggtaacagcatacaagcctacatctgggctgctttcgacaattgggagattgtgtaaaaggtccctggcatggcagtgttggctgttcaggaaaagtgactgttttttaaaaatctcttctttcttggatctccttgtgcttggcagtgtgcctttccacttagatccaggccttggttggtcaagggcagttttttcatcagcagagtgactgtagccctaaggccaaagccattcaaattccttcttaggttcacacattggtgattgttgaaaccttgacatttgagcttggagagctttctggcctaggctagtgcagtgacaactgtaggtcccactttggccctgcggtcataactagggtgatactaattgcagctttcatttgttgagcatctgcccttcaccagacctgtactcagagtccatgatgctcacaccaaccttgtcaagtaggtggtggactccccattttatgcaagaggaaactgtagtccagagagtttgagaaacttgacgcggtctcctgtttggagttctctataggacctccttctcttttagttataactagtcttttaattgcttttttagttttattccaataggtttttggggaagaggtagtgtttgattatatgaataagttctctgatggtgatttctgagattttggtgcactgatcacctgagcagtgtacactatactcagtgtgtatccttttatccctcactctgctcccatcctttccccaccaagtccccaaagtccactcttatgcatcattcttatgcctttgcacccatagcttagctcccaattatgagtgagaacataggatgtttggttttccattcctgagttacttcacttagaataatgatctccagttccgtccaggttgctgtaaatgccattatttcattctttattatgacgcagtagtctttcgtggtatatgtatagcacagtttctttatccactcgttgattgatgggcatttgggctggttccatatttttacaaatgcgaattgtgctgctgtaaacatgcatgtgcaagtatctttctcatataatgacttcttttcctctgggtagatactgggattgtggggttgctggataaaatggtggtcctacttttagttctttaaggaatctccacactgttttccatagtggttgtaccagtttgcattcccataattgctttgacttagaaaatgatggctgtttgtaagccccttgtgagcaactttttttttttttttccatttttgagtcagggtctcattctgttgcttagctaaagtacagcagtgcaatcatagctcactgcagccttgagcttctgggtgcaagcgatcctcctgctttggcctcccgagtatctgagactataggcatatgcaaccatgcccagctaactttttttttttttggtagagacagggtttcaccatgttgcccaggctggtctcaaactcctgggctgaagtaaattgcctacctccgcctcccagagtgttgggattacaggcatgggccactgcacctggccgtgagcaatttttaatagttgtctcttgtctcttctatatggcctctgttcttaattggtataacccagttttacctagatgaggtcattgctcagtgggtctgctcgtccaggctctgcagaggtctactttgctctggaagtgtttcctgctccttcttttcccacctccagtggtggagtgtgtgctgattggatagagtccatgctctggaaataggaaccaattttctctcctcactacttctttttatttctaactgcttctgttcatcttttcttggctgcattcattttccctctttactgctgtagtttattgctctttgctgactcctttatttttattttccagacttgcctgaaatgcatcttgattctggcatctttagatgtttaaagccctgcactttgttactaatgatttccctcattttgcagaattccattcagttgcagttctatttggcaagaccctgcttttcttctttcttaaatcattacattttaatattcttctcttcctgctcttttatagaaatttgtatttcattttttaggttgtaataatggaccttcaacgccctacagtttgacttcttatcatacttacttgttttcagaatcatatgttcatggagcagaggcacttttatgctgtccttgctttttctaaaaggcaaatctgtccataccattttcgtactcagcacccttcataggctcttgaagatcagctctgaatgccccatcccagtgttggagaccagtggtgtccccctcccttcacctgcccgctacgacactagctcagcagttctccacaattggtttcaggacccctttatgtaactcttaaaaattagtgagattcccctaagagcttttgtttgtatagattgtatctagtaatatttactgtgttagaaattaaaattaaagaaatttaaaaatatttataaacttgtttaaatataacaataaacccattatatgatatatgataatataaagtagcatttttaatgaaaagtaaatatttccaaagcacaaacatttagtgagaagagtgacattgttttactttttcccaaatctctttaatgtctctcttaatggaagacagctggagtctcataaatgcttttgcattcattctgttgcagtatattgtgttggttgaactatatggagaaaatccagccttacacagacatgtagttagaaaagggaggagtgttttaatagccctttcagttaattgtggatagtctttgaaactatatcagaacttgacccaggtgtaaaggtttgttgcaacatagactctgaaaccaatcaatgaacttttcataatgctgttacattaaagtctgttgtcctatcacatccattgaaaggatcttttacacatcattttgtaacatcatgcatcattagtcatttggaaaatatcaaaatatcacatttaataccaccgtttagaaaaatatcaacatatcacatttgttaatgtcattgccattctcatctgaaaagtctttaagtattgagatgctctaaagctgaaaatactggatacaggttttccaaagttctgtttatttgttttgagatagagtctctatcccccaggctgaagtgcagtgccacaatctcaggtcattgcaacctccgcttcccgggttcaagtgattctcatgcctcagcctcccgagtaactgggattactgacacccaccatcacgcttatttttgtatttttagtagagatagggtttcaccatgttgttcaggctgaccttgaactcctgacctcaggtgatctgcctgcctcggcctcccaaagtgctgggattacatgcgtgagccaccgcacccggccccgaagttttaatttttgcttgaaagcccaaaatttgtctttagcaacaaataccgtcagttttccttgaaataacaggctcactgtatttatttttgacaaagtgtctataaatacccaaatctgagtaatcatagtttttctcagtcattctttcaaggaaagatggtgttctgtgaaaaacagtggctaagcttgcagctcagtcacacaagtactttttcttcccaaagacaaccaccgcactctggcctgcagcggaagtgccgaatgagtgcgcttaacattttgttacatgggatattaaaaagatgtgtactcaagaatcaatatttaatgaaattaataattttactgcttcatcaaggacacgcttagctaaggacaggcgtggtggctcatgcctgtaatcccagcactttgggaggccgaggcggttggatcacgaggtcaggagagcgagaccatcctggctaacatggtgaaaccccgtctctactacaaaaaaaacaaaaaattagctagacgtggtggcgggcacccgtagtcccagctactctggaggctgaggcaggagaatggtgtgaacctgggaggtggaggttgcagtgagccgagatcgtgccactgtactccagcctgggcgacagagcgagactccatctcaaaaaaaaaaaaaaaagctgtgtgtgtggcagtagagaatataatgaccactgatacagtgagatgccactgccttgatttatgctaagccaccagttgttttacctgctattgcttttgcaccagcaatgtaagtgtcaacacagttgaagatagttttgacctggcgggactcccagaaagggtcttgggccacacttcaaaaaccagtgggtaagactaaactgcccatcattcatctgcatgctctagattctctcgctttccatatcttggctccatgccccctctacccggaacattcatcttcaccaccacctctccctccccgtgtgtgtgtgtgcatattcacacatatttatatatctacacatgtataggtgtgtatgtgtgtataaatgcacacgtgtgtatattcagcatttctggttataatcgtgtgcaatgatttcatccagtgggctgtagactatgggccaggtttcatatttatcttggtgggcaggagcaccaagtaccatgtctggcacagctaatcacttgctaaatgttagctattttcatcatcatcatcatcatcatcatcatcatcatcatcattgcaagggcttaatacatttttcttttttaacaaacgaagagtttaggttagtatttcccatggtttccttagaacattggttctctgtgatatcagtaagtgttgatgaatgggcatctgtggtcagctagatttgggaatgctcaaatacatttttgattgaaggattttcaagatcctttgttgtataaggtatatattgtgaatctttaaggggaatgggaggctatagaatgtagcatttccaaagctgaataacttgtgaaacttctttttttggcataagtcgtaaaattaggtttcttggaattttctttgggaaataatcacatagtctggccttttcatttttacagatgaggaaactgatgacctatattcattcttgcaataatttatacctcaaatatgtaatgagtacttcttaaagttagacactgctaggttgggtaatacaatagcaagtgaaaaaaaacagagttggggaaagtgttaattatactttttatatggagtagatgattaagtgggaggtacagacattaatgaagtagttactgaaattagaactgttatgtgaatggtgtgtaggaaagtagacagtgctaaatcatttgttttttgttttactcattttcaaagctctgccaggcccatttaggtcttcctctcaacgttctgccactgctagcagctctgtgatccagactgctgaagatcagtaaagatgtccatttgcccagctgcatcatctgagagtgtagcatgttgaagacatgatctgttacagcgtgagacaactttctcttagtgcctcatgtttaataagtacttgtacatattgatagactgcatgaagtatgcataaacatacttagaaaaacctggactgaaagacaaaccctacactgtggtttcttcacccactgccctaactcactgtgctgtacagggggactgaataaaatcatttcacatgcatttcctgcacccccttgctctgacctggccccattttggatggatccagtgactcttcccttccccaccatgcaaaacagaaaaacacatctttctgttttgatccagtactgcccacacgttggggaaaatgttaatatactatttgtatgaatatatttaatcaaagggcatgatgttgatacagtaaaattggcctgtggtctggtggcttcctgggcagatgatagcaggagggttttgcgacagaatagccttggagtcaggacttttgtaagaagattaggtcagtgtttgatttgatgtttcattctgcaaagtcacctacagagaaatcaaacatttacatgtttattaactggtgcttttggttttggcatgtggccacaggctttgggctggatgagctctgggaatgcacaaaaatctctcattccttctcttgtatgggtagataagcaggaaaatatttaccttttcaggttatcctcttcaaagaagcctgaaacttcttcagccacatcatcttcctgccagagtctgaaaaccaacaggctttcaagagaccaagggttgagtggagtcatttagggaatgacatgtatccaggttgctaaattttttggtgttgctctgagattgaattagggaaattcccattgagtttttggacctcttgatttctaatcttctttgattaagttggagttgcagaaatatcatggattcctacttttaaaataactttttctttgtaaaaataattcagactaattgtagaaatttgggtaaatagcagaaggcataatgctgaaaattacccataatccttcttcagagataatcactataaacattttgttttatttgcatgtatttttatatgcataattaagatcattgtgtataaattttgatttcttcttattccatttaacatatgaatactttttcttgtgttgagagcaacatggacttgtattagtttcctgttgctgctgtaatacatttccacaaacagagtggcttaaaatagcaaatatattctcatagttttggaagccagaagtctgaaatcaaggtatgggcaggaccgtgctccatgtgcacagactctaggggagaatctgttccactccttgctctcccagcctttggtgctgccagcattccttggcacgtggtcttgtcattcgtatatctgcctcagttttcacagtgtgtgtctgtgtgtttgtgtgtgtgtaatctacctttcttataagggcatgtgaatttaggtccaatccagataatcaagaatacagctttatctcacaattcttgacttaatcatgtctacaaagaccattttccacctaagataacatttccaggtttcaggattgggacctgatatggtttggttgtgtccccacccaaatctcaccttgaattgtagctcccataattcccacgtgttgtgggagggaactgttgggagataattgaatcatgggggcagttttccccatactgttcttgtggtaatgaataagtctcacaagatctgatagttttataagggaagcccctgtcacttggttctcattatctcttgtctgccaccgtgtaagacatgccttttgcctttcaccatggttgggggggcctcacaatggaactgtgagtccattaaacctctttttctttataaattacccagtctcaggtatgtctttatcagcagcgtgaaaatggactgatacaggacctgacctctctggggccattattcagccttctacagggttctagacaatggactctggagccagactctgtgggatctaatcttgagcaagtgccttaactctcagtacctcttctttctgatctgtaaaatgggaataatagtacctacctccttgagttggtatacaaattacaaagattaacatatacagaacacctaaaaagctcaggttagtggctggcctgtgtaaggagtagctgttagtattgtatttgtgatttttattaacaattctttgttagatgtcatttttaatggctgcataagagtttttaaatgaatctaccataatttgtctaattctgtccttttgttggataagtttctttttcattttttatctcaggtatgatgttgccgtgtagcattaagttttgttccttagtgtagagttctggaaatggaattacaaagtcaaagggtgtgtatagttttaagccacttaatgagaatttgtttaattgctttccagaaagttgaatgatgagagtacctgttttaccatggccatacctgttatcgcatgttaccattttcaatactctgaggtcctttgatatagtctgccctttaagcctgaaatgtacagcatagggaccctacattttgtgtttcattcagtgaggagtattctgaccatgcaagaaaacctctaacacaaaatgaaatccttgctttgtgaagtcaccccagtgccttctccattctgttatgaagcctggaaacttgctgggtgtttttgagggtagggggagggctgttgggggaaaggttgttagtagcagggtaatgctaggtttacagggacttcaatagcatagttttgcttctgttctcaaatgtgaacatttaaaactgagcatttgatgggatgagggaggtacatttgaacagaaaacagattaatgtaatcactttacaactaaggccatgtgagggacaggagtatggggtggggaaggggtagctcctgcattgcctgccagattatctgggagatcagccgtgggaaaggctaagggaacagtttgcatctgtactttgccccctgggtcacctgctagcctgctctcctttcttggtggtgcccattgcagtctggtcctgtgcagcccaggcctctgggctatagagaggcatagcaggggttccaagtgtgtgtgctcaagggaacctgctacatttgacgtcatctggcccattgctgttcaggctatttagaaacagggtggctgtgtttccccagtggaaaggtacagtatacaccatgtgcagcaggtcatgcacaaattcaacaatacccaaacccgccgtagttggctaaatggtggccccaaagatgtgcttagattagaacatccctggaacctataaatgttaccttaattggaaaaagggggtttgcagatgtgactaagtaaggatcttgagatgagatcatcctggattatttggtaggccctaagtgccatcacagatattcttataagagagaagcagagagagatttgacacagaagagaaggcagtgtgccaagaggagagggcatatgtcaagatggaggcagaggtcggaatgatgtggccacaagccagggaatgccaagccaccagaagctggaagcggcgacaaacgagttctcccctacggcttctagagggagcatggcattgcctgtttatttcagacttctgaccttcagaattaatacatttcctgttttaagccttccagtgataattatggcagcctcaggaaactcatatactagtctgtgccctgtccaagacacttctgctgtttatgtgcttggctctctctttctcatattgctagaaaagcttctgagcacttactcccaatttctgtacttatctggtcatgacccagcagcagagttggcactggtttgcagaactcctgttgagtaccactgatctagtctctatcattttatgaatgaagaaactgaggcctagtgagagaaagtgctataggtctgggacgagcagcaggtgcctctgctacttggaatatttagacagggccagatctggggagagcagatagcagagttgcccttcggaggccagctggtgtccctgtcgctgttctgtaccctgttcagtgaaagctgatgctccagtgagcccctggggcgacaagctgctcagaaggcctagaaactagggcaaactggtagagcctttgctgcagctactgagccaacagcagcaggcaaagaaccctgtcaagggtagaggtcacggcttgctgatgacttaatttccagctgactgcttcagtctttatagaccctctaactcaggtcatatttttcctctggagcccaattttaactttccatattttcagaatggcaattatctcttagagaatggggactagactacatgctgctttgataaagtccaaactcctttacttggcattcatgactcctgaataaccaactcccttcccctttccagttctgcgtcccatccctcccttttacataccttaatctctggacttcaccaaaatcagtgctccctagtagaagaggctataagacattaggttcttaaatccccacagtaggtaagtttgtgattgcccaactcaggaactaatggaaaaatatggcgaggatagaggtcgggcatacatctgtgaagctctttgggaataaaaaaacaacaactgtttacatttactgcaagagaatatgaaggcagcacagcagccagtaccaaccactaacatgaacaaagtcatctgagaccatctggcccagtggagcaaccagatgcctatagccacatacataagccaggcaagaccagaagaaaaagcccagctgaactcagcactgattgctgacccaccataccttgaaatgaaatgtttgtttgaaacaaaacaaaaagcacggtaaaccaagatttatctttacgtattttagtaatgataggcattgtaccattactcaattatgtcttgcttgttatggacactttttggagtctcccacctttttactttcaagggaactcttatttattttgctttatgggtaatacccatactaaaagctcctttcccccagtatctgggcttccaacttaatatttaatgccactgaggttttgagttaatttgttggctgtcctctgtggctgtcacacatctctcttcctttcctctctgatgttatgggacggtagttcggatgcctgggtcactttctcatcttttatttttcccaaggctttggtttaaaagcctctgttccttcaccttccgcgtttgtttcttttctaatcccaaacctgtatccttcatttttaaatcagtgatttttgattgcagggaacagccatggtctcatggcggcttaagttagcagcgagtttgttgtagaaatcccaggaatacaggaagcaaagcttgactgcctgctgggcacaggagtgggaaggcccctctaactccatgcaggggctgcttggtcctgtccatcacgcacatgcacacatgtgccagtgtatctgtctgtctgcccttctggagcagggcggtgacaagtgtctatccctaagccagttgggagaggggaaccgtgtgactgccctctcagcatgggctgagggggttccaaaaaaggagtctgtggagggatacctccccagcagctattataccctttcttctaatttctcaacaggaataactcaagtcacctgtactggaaatcagtttgctgaaattaatcaacgattcttgaagttgaagaaaaggtaaacattctcttataagggaaactcattgtctggggagaggttactgtcccagtcatttctctcatatgcctagttttgtgtgtaatattttaccccttctctctgcctggccaagttcctcttcatccctcaagatctttatcaaatgccacctttgtcctttgtggaggatctcctccaggctgcgggtgatttctcctgctgttgaacccccacgacactttctccttcctgtgatgtttgtgttctcgtttgcccttcccctgatggtctcacccttcctctcttggccagtcgggtagaggtctgtgacacaccccccatcatagtacttacttccacgctttattctcgttgcctgtttttgtgttttccccagtaagctgcttaagggtgcatctgagttgtgcctgggacacagtcggtattccataaatgtttctcgaatgactcatgaaggagcctctccacaagaggcctgctcctgtgtggacccacattgtacccccaccacgcctcccttactgggcctgtactaggaatcattcttaaatacattatgatctttgagcattcatccgaaattcctgatcttcgccaggtgtcctttggctattggtgaaatgaagctaatagcaaagcttttgtatctgatacttttttttcacatttgattttggacccatgttaagagcaggaatccagaagtggggagggaggtgacaggcagagctggatgccagtggtcactggagcacagctccccagcccccttctccgcttgtggcgggtgtgagtgggggttgcatgtggggggctttaggtctcgctgtggttgtagcccctcctatctgctgcacaggtggatcaccttctccatctgtgccatgctctcgactgcttcactcagtgactttgtgtcttaacccacctccctgcccccaacctttgtcctttaaatgaataagtcagcaggttccttttctcaaactgtttactgtaactgctaaagatcccataaaagtttcttattaattttatgagtttatgcatcatagccagagggacaaagcatagattgtgggtgttcccagagatacaaatttccagagattgttttgcgtattcatctgcacattgttgtctgggtttgacgtgtattgggcttcagtgtgaggcttttaatatgtatatcctgttatcaattaagaaattatccaagtggttgaatcctgtgagacttcgcaagtgtgtgcaaatctagtatacttgacttttcaacctcttctttcaatgtaacttttatacaaaataaataatcaactgacagttctcaaaaaaaagaaaatcagtttaattggtcaccatcatcttggaagacttgactcagccctttctgcctaacagtaaccagcaactgtctctcacatttgtagagtgctttctcttttgcaaggtgctttgacacacgtcggcagattttcttctcccaccagtcctgggaagcaggcagaggcaagtggtaacttctcattttcaaagttgggaaataagctcagaagttcaatgtcttgcataacatcatgaactgatgtgaatggggttcagttccccccaaccatctgatcttggtacccccctttggaagccatggcaaactaacagtgtcacagaaccgtctctaccctcagtgttcctttgagggaggggagtcttgaccttctgttgagagtctgaccctggtgctccctccaccctcagccaggcagctttcttgaaaaagcagatatgttcctcctgagaccttccagtcagtcttgaaagttttgtttttgttaaggctaatttaaatacaagaaatttaattagcttacatgaatgctgcattgtcttactctgagtaaactggaagacactaacaggtttgatcagcttaattcagctgtatctgatgatgttctttcgcttccttctcttttaaatcattgcaaatggtttctatcagtcaaggcagcagagcacagtgctttattgccatgtggaattgtttagttaactgtgatttttaaaaaattgctcaacttttaatgaaagtggattgtcaggtgacattttgatttgtcctttgatggggaaatgggaaaatagaaccatcataataaaaaaccagcttctattctagaaggggggctattaaaagcaggatgtgatttcagtgaattgttgttttcctaaaacaggccaccatctctggtctttttatgttgagagaccttcctctgatactctcttagattaacattttcctgtgggaaattctaacctggaatcccccaaacaggttactccccatagtgtaagcgttggggcccaggaccagataccaacacccttttactgggaatctgaagcatcagtatcgagaaatctgcaagcctatcgtgatgcttgtaatcaaaggaaacaggcttcacattttacttttagttgtggcatgatgcaagcaccattttactgttaaggttattgttttcttaaccccaaagctggatctgcattagtgaggatcctcatagaggctaccctcatgtgtcctggctgagtggggttccaggtgctcctcagtggttgtgcccaccttgaattggcacagtggcaggacctccgacaccatgagaggatagacaggggtcacctctgaggctggccccaggactcctctgtgttctatagcattcttacaccctttatggcagttagcaaacttggtatctcatgggcacctcaagcttactgtgtccagattttaactcttggtctacttctaccatagtccctttctaggcctcctcccttcccccatcttattaaggtacgtagttgttaactcactttgtcaggccagaaactggtacttcatttgttaatactcatctttttcttcccccaaatcaccaaatcctaatgatgcctctcctaaagtacatcttgaattcatccatggccttcctgtatccgccccccaagtccaagccaacatcgtcctttgccaggtgactgccaaagcctcttaactgactgccctgcctgcttccccttttcttctattcctctcatcaatttggacccagagcaatctttaaaaattcttgtcaaatcatgtaattcccttgcttgaaacctgttggtgacctcatcctgcacttgatgaaacacataagcccagtgcagcccatggagtggactgcactgtctgggccccaggcctggctacagaggcacagcattgttggcaccatgttgttgtagcttgtgagacattctccccttcactcttgacttcctaggaagattgcagtgacttcaattttccaaacgcaataaaataactcaggctctcaaaggtgtacttagaatgaatattgtgttctgggaaatggaacaaggagtgatttgttcctccaaacaccagaataacaactcctagaacacagaggtggaccactatttcatttgtaaccttaataagttaatagccaataagtaatcagctgaaattgcaatactccttgctactccccaagcaacctccccatcccccacccacatattttgacataaaaatgtgcaacagcattttagctcatgaaatcttgaatgaaacttggttctaggttggtacaagaaaagactggcattctattatacaagggaaaaagaaagctaaatattagcatacagctttcctttttaaatatgtttttcctatcttgaagccgatttgttttccttagtcttgagctttactcctgtgtgtgtcggaggtcctgcgtgtgctgccgtgcacacatctgaaaagcacgtacctgaatttcatcttaggcatgatactctccattctcaggccttccccaaggtaattaatggtaatattgaaactccagctggatgtttggtacactgtggcctgatgagttacagcaaagtttgtaatgggaataccagcaaaggtgattttaatagtgtgatgagcgttgtgatagagtttattacccagagtcctgggaacacagagatggcccctcactcaccctgggggatggaaagtcatgtgacccttgagatgggtcttgaaagagatgccaagtaccaactgcttgttacttttttgccaagcagaaggaatgcttgggagaataggggtgcaaagggcatttcagacagctgcatggataaaggcctgggaggtcagcaagggtgtggcatgccagagaacactgaggagggtcgctgctgtggtggagggcacggtggggtgggagttgagtgcaaaaggtaggcaggagccagatcatgcaggtccttccttggggaccaggttaggcaagggatttggattttattctaaaggcagtggaatgccactgtagaattaaatactagggagttactggaccgggtttgtcttttacaatagggattctgtaggcatggtctgtactaagacttctcctgaaagtcagtgatctgattcagatatgcaagtccttttattagttctaatgggtgtgagacttaaaattccagagacttgcacattttaggtatgacggtaggctggatgttgctaagtgactgacatgtgattggtgttaagttagtgccctgctggagtttctggatgattgtactcccctgggttgccatgctcagcagtggtgcattccaggtgcctgctgagcatggacacaggcggttggattcctgcgggtttggaaatggcactctgacagtgcaacgtcagtgaggtcttgaatttgtgacagcaacttaaagttgctgggaatctagaggtctaattatactgttaacttggctttcttgttatttggttaacattttttggttggtggttaaccctgcactctgaagtgatgcatatttatgctaggaatgtgttttggcttcaaagtttatgataactagactttaaaacaggtatgaaatttagatgcatcgtctatatccctttgcaaaagatgtctctgtctcccacatttgcttctctggtgattcttcagtgttactaccatattattttttcctgctaaggggaaaatatgtgagatgagcaagggtggcatcccttgccttgcctccatggacagtggtttcgaaaggactcaggagtgtttgcattacttaaggcttgacaaagcagtaaggtgaaggcagagaaacagtggaggaggctatcacaatttcctcatcaataaagatgagggctgtggggaaggagagaggggtatgtctgagagatgtttaggataagggagaacaatctgatgtagagaatgacagagaggggtggtatctaggagatccccagacttctggcttgggcagcattggcgagagggacagtcttgtatcatctagcaagtaagtaaagcaggccaagatgaggaggcttggaagtgggcaagagtttggcttgttctcccactatgtgcagacagaacagccgtgcatgatgcgatgtcagaggtcagggttgggctcagcacagagatgttgaaagccaggtcctatctgtaccctgttttgttgacagtggggaacacatgaacacattctagttagaggactaagatcagacatgggtttctgtgaaatcattccctggaaattgaggaatcaggaggctggaggaagggaggcatctgggtggagatgctgaggactcggtaatggcagggagaacatacaggcatgggtatgcgtgcagtgtctgcagcctctattttatttgggggtggcgtgtgatacagattctagagtcaacacagaggagaatgagcagcccttggtaagctattaaccaggagcaggtgggggcagcgtggggaaggtggagtagaaggtgactgggagagctctcctctgttctggtgcccaggcttgccttagttaacagtggacccacggtggcctgagtggacctaagactggagctggtctgactcttgctgacctggaggcttctgtgcagtctgcagttggaccagtggcaagatcaataaaccttgtcttcagtgctcaaaagccttcttgttctgtgccattgccgaaaccattctcattgactggtaaatcagcttaaggttcagcaaaaaggaggacatttaaattaaagatcaaatatttatcactttgttaatgacaaatgcaacttcagcagctcaagttcattttctgatggggtcattccctttctcctaccctaaaatagactcttaggagaccttggagaacattgacacaccgctatgtaaatatttgatagcagcttagcttactgcctttcttttgcaaaatatatgaattttgtcaggaatcaaaggtctgcagtgaagcacacatggtaagcattgagagtgcacagtgtgtttgcagaatcccttttggaccggccgtctcagctccttggctagtccccttgctcatcgttcatcaactcgttctgctctggtcgccctggccccttgctaccccttaaaaccttcaggctgctcctgccttgtggcctttgccctccatgcccttccctggcaccctcttctttgaggtctccttggggcttgctccagcctttcctgcaggcctctgctctccagtcacagaggcagtcccttgtaatgctctctgggttaaatcacgtctcccacctggtcaccttacactcttttgtctttcttcatagcactttgttccttgacatattacacttttatttgtttattttttatctccctcaattggactgtgaattccatgagaccaggaactttgttttcattattctgtcctgtcaccaggacattacccagcacatcgagtctgccttgtatttggtgaatcaatgaatgatcagatggaccagtcaatcagtttgtatattcacaacagttaatcagcttgtggcacgtggtaggtgctcaggaagtgtttgaaagaatgaattggtgagtgagtaaatgaatctgtgcatggttagttgccaacactggtgctcagcaactgttagctggataaatgaacggttgctggagcttactcgcctgtctctggggctagtccctagcttctttattgggggaaggcccggatgcacaatctttgatgtgtgctattgtttctgtttgataaattcagttagtccctcattctttccgtttgtctgccatcagccaggctctgtaattaacttactgtaatttagctgagaggtgaattttccattttaaagatgttataaacaactggtgcttgtgcatcttggttgttgatgaagttcatgcctaaaagaacatgagggctgtgttacgtgtctaggggagaaggggctgttagcccacacctggccataaaaacatggggacaggctggcaagttctggcgaagttgtgtttctctagctccagtgcaccagcatgccagcatgggggccaaggatcagggtcagtgtggtcatcttcctcaagggtcacatttaacccaaagatttgggagaaataacattttaaaattttacaaccaatactgatatttgttaaaggagaattcaatatcacttagtagttaagagcaggctgtggaaccagactgcctaggtttgactgtgtctcaccacttacttgcctagtggtcctgagcaagttacataatctcaaaactcatttctcacttctaaggtgggagcctgtgatgcagtagagccaacagcacggggatgtcagggatcagtgagagccacggaaggctttatcacagtgtgtgcacattgtaagtaaacaacaaggcagatgtttcatgtgatcacttgatgttttaagataacagaggagccaaaggaaattttattcttaccctggccatgccctaacatggcctccagggataggcattcacttacttctgcatatttcagatgggcaagttaggagaagcactgccttaacaaaacccagtgcacaccattggatggcttgcatgctttctcaggaattcttccccagccttgccttggagttgagctgccgttaaggaagtgatgaattagccatgcttacttttagtacctgctgttttaaagtacctatttgaatagcaaatgaagtcgagggaacctacaggtttggataaagaactgccatctaaggaatgacggtatatagaggagcttgtaatttgagcattttcacacacattgcttgcatttcattcttataaccacttattcatcaaggtagcgaagactgtcagaatggaaagagacttcagtaactcttgggtccatctgtttgatatgatttctgaagtcccttcttcagcatcctattcgtctttcagaccctgcttggtttctccgggagatagagcgttccctgccccaaaggcagttcagtctggctccccataatttctacgcattggtttaggttctgtcttttagagccgcagctaaatctagcacttcttcaacctgtaatttatgcccttttaatatacagacctctggaggtagtgtttccacaacctcacctgggccatttaaccattgcgatttaaccattaaatatatgaagtctgcgagaggcagccttgactggtaggtcggcttagtctggtggacttcagctacaggtctcaactcattgactgattgtgaaatctcttttgtggatctcaaccagcatttttttaatgaaatgaaatatcagagtatataaacacatattttctaaaactctgatttcagtttgtgttgcatgtgctgccgttatattctttctgcacatcataagcatttcaaaagccattgttttggaccctcttacaggaatttcaagttacttcacgtttatttagttatcatctttgtccttttaatggttgaatttgcttcaggtcaactagttaaagacatagtagctgtgtttcaggttgctgatggctattaatttaactctgattgctctgtaaagaagagcatttcctggctggccagggttaaataacaagacctgttcaaaagctctgcttcctcctttttccttactccaccttcagtgagagaagctggttgtgagcacctagaggatttcgtgcaatcttagggcctgtccttaaaaggcagcctttcctcaaggcaggaggaacctcctttgctgctggctctgggaaggagcttttgaggacgagcctgcacttacccgggctgctttggtctctagactgccctgagcctggaagtattctcacaaacaagagagtcaccttatcacaacttggtgtgagggatgtgacaatacctccaactggaaagggagggatgtggcttagttgaaagaacagagttgagagtctagcattgttttctgatcttgaactctgcattggggatggagggggagaggtgtggggggacaggtgagggacagctgtggagagagggggctccttggacacatgacttaagctctttgaacaacggtcagatttcaggttcagggcctatgccagggacttttcttttgtaatctcatgtcatcctcacattgtctttctcttactttgtcgtactggcctgatgaaaccccatccctggttaaattgaacctcctactttttctatgcctacacctgcgcggttggtgccatcctgactttcctgcttcaagctgtgtggcctccaactgcagtgggccccaagctggtggcaggtcatgccactcctcccattcagtcatcgcctcctggacagctgttcatggcttctctctcttcagacttccaacatctcccttctctccctgcctcctaagcagatgctcttctttgaggaattatttttcatacataattattttgtcattattccttatgatgatgacagctaatgcttatattatacctactatgtaccagtcactattcttgtatatcagttttctaggtccaattattagccccatttttcaggtgagacatctgaggcacagaaagattaagtaacctgcctgaggttgcagggccgataaacggcagaactaggatttcaggccggcactgcctccgagtcttccctgtgctcttgtttactgcagtctggagaagagttgctctcactgccttctgtctgcctgctgccaccctccctcagacttactccaatcttgcccctgacccctcttcactgaaactgctctgcaagtcatagaggacctgcatgtggccagaccagatggccagctcccccttcctcaggacaccttcttcatttgccttccaagccaccatcgtcttcctggttttcttcttgactcccttttcagtcttttcctgcttcctcttcaactcccccaaggtctagactttggattgctccagggcttagtcccctactctgcacacactccacttcccagctttaagggcccacagctcccagggtcctgtctccagcccattctccctgctttgcaggcgcatgcctccagctgccttttcatgcctctactagggatggctgatagattgtcaaactccagctgtccccacccgcctcacacccccttgcaacttcccacctctctcaatggcaacaccattcttccagttgcgcaggcctgagaccttcagtctgttttctttttttcacactccatttccaatctcggtaaattgtatgcctctgccttcaaagtgtactcggtatcagaccactttgcaccacatctacccgtatcctggaacattaagttttacctgaataattcattagcatcttcactgatttccttgccttagccctttcacagctgcagtcagttgtccacacagagttcttttaaaatgtaagcagcacccttctgtggccccatcttgccctctgctgctccctctgtgacccctcagctctccctttgctttctccggacttgctggcccctgcgtgcttctcagacatgcaagggatgccccgcctgagggtctgtgcatgggtcctgccctgcctggaagatcttccccctgcacaggtcccttcaagtctctggtccagtgtcactttctcatgaagccttccctgatcagttactctaaatttacagcctctgcgcctccagcagcacatagcatcatctgacacatgctctatccatttgttagttgtctgtctctccacattccctgtgaatgaagacagcttcattacctgaaggcaacatttttgcttgttttgttcatagctgcatcctcaacattgtcccctgacatacagggtatgcttaaaaaatatttgaatgatagatacttttatctttgtttgacaacatagtaattgaaggtcttaagaggttaagttacttgcccaggatcacagaccctagaattgccaggatgggactgaaaccctgacatgcacttaatttaccgtgtgctgctttttcttgttgactaaggacaataatacataacacagttactttgaggatgaaatgaataatgcacagaaaagcactttattaatccaagtgtgccaaaaaaatgtgacttatctgatttattgagaatgctagctttcatgtctctgtcattcggcaacccactcaaagattcttttgtgtttctggatttttatttgggagtagtcagtgctgctgccactgctgccaaataacattttcttattttttctgcccttggtatgagaagtgtgtgtgtgtatcttttatctgtctgtagctatgatccctcctcccctccatacacccactggccttcaggtcaagagctttcctgacccctgtggcctgtcggcagcagggagctagtggagctggcacctgtgtggctgtcattgtttgttcatgtatatgttcctggggcagacgcttatgttatcagcaggtgctttgcgggtgtccggagtcccatcttgcacaattctcctgtcagcctgtctgccccctacccccactctgccgcagactggagtgaagtgatcacaggcccgttatggctaaataccagggacataaaatgaagcaagcacacttgatgaaccgcagagctgctgctctcaagtgcagaatttatgtctccctgaacccagggcagcttccctgggcttatagcataaagcatagagcagtttggcccttctaatgcctcatattgtaataatgacacagttacaagaagagatggtggagctttctccatatatacccttctcgtgttgtttattcatttgtgttcctgattttgaagtgggagaaacatgcagccacttcttagggagcgccttcaactgtttttttctgaagacaggagagctttgaaactttagaaaaggagaacagcattgagaatagtctagtggttggatgtctgggcctggttactgttctcacatgggttgtacagtggggtgtaatgggcgttagtgtacagggacttagcatggactccaggtctggtcaagctcttctcggcaggcaccccttcaacagcctgtgacatccttggctccctccatgctgtaggccctgggcagtgtaggggtgggtggagagagttgcacttttcctgggggccttcagagcagcctggcccacactgaaaactcaagcgggatgtggtgcatcttttaacccagaatgactgcccagccagcgtgtagcggcaccttccaggcatcagggctagcctgattgtaagcaacagactttacctgctgccaaatgagacataccaagaaggcttgtgttcctctcacaaccttccctgtgtcctcagcttccaaagctgatgagcgggaaccaggcttggactcttgatctgtgtcccattggtccacatgccttgtaggggatagcctggcctccctggaagcagctgcttggggtgggggcaacacggtttctgagccagaaagagcttgattggaatcccagctgcactattgactttctaaccacctggggcctgctctaagcctcagttcccttgtctgcaaaatggggatgaaggctgctgtgaggcttgcatgtttgtggagggctttagtgcagtcgcttgataggtattgagcattcaggaagcagtagctgctgttcttatttgtagggtggttgagaggcactgtggggtcacacaggatgggtgggctttggaatcacatctgagttcaaatcctcattcagttggtcattcattaaatacttaacgagtacttattgcaggttttatagtggagttgagattgtgcttgttcccagcagtctttgatgttggacaacagcatactttactgaatcccagtttcatcatttaaatgggggtaaaaataccaatcttgtatgattgtggtgggaatgaaataagtatttataaatggcagctagctgctttattattacagaattttctattctaactcaatggttagttgcctaagatgaactgcttgtcttaaaatattccggctttgatattcagtccagcagatgtttgttgagcacctgttatataaaaggcatcatgccagcccaggagaatattattaccagcaaggcacatttgcagtccccgagaagtggagacgtcagaggcccagccagctaggcagtagctgccagtcagtgctgcagtaaaggtataaaccaagtcctgagatagcactgaggaggaagctgttgcttctgcatggaggagctggcaaaggccacatgtgatggttgtccaaagatgagagactgcacaggcaggtgacagtgtgagggaaaagcgcattccagcatagatgttccatcagcaaaggcatggaggtgagaatccacaggcaggctcaggtgtgatggtaatagtgggtcatttgggtgtggtgaggctggaaagaatgaatggggctgggctgtgaaggcttagggagttctcagccttgtgggctgagcctatgatgtggaaagcttacaggagggcagtgtgagcccctgactgcatggggcaagctgtccggtaaaagtataatgccagctactcatggaatttaaaacttttctagtagccacattaaaacagaaaagaaaacaggtgaaatcgattttaataatagattttatttaacccagtatattcaaaacattatttcaacatataatcagcataaataacttttaatgagctatttggcattctttcttttggtactaagccttcaaaatcttgtgtgtattttataccacagcacagctgattttggaccacagccatattgcagatgttcaacacatggccggtggctgctgcattggctgcacagggttagcaggtctggggtgatgagagttgaaagtgatcttccttgtcttagaccttcccctgagagcctgaaccaggcttctcgcatcaaacctttgaacaaacctgcccaacagctaattggtacctcagggaaaagagaaaacctgggggattttgtcatgcatgggttatatggtgcaaaaaaaaaaaaaaagaattccctggtgtttcccagattcatgtacatctccacagcacagacctcgctggacagcaagttactgtgtaccatttattgagcctctggtatggcctgttcatccactgcatacttcagataatacattatttctaatttttcgatgtctgcaaaacaggtttcttacccattttacagaggaggagagtcgggacgtgagagatttagtaccttgtccaagatcgtttaaccagatggggcagagctaaggcacaaacctgacttcaaacctgtgttcctaccattccttaataggatctaacactctgtgtacattataatctccaaatcggagaaaagtgcatataagaagttagcatgtgtgcatacatgcatatctatatacataagtaggaaaagacgggaaagttctaatcacagaaaaaaaatcacaaacaattctgtgctgaagaatgcgtccctgctttcctcctctctgcctctggtctcctgcccacacatactggggaccatttggagtgtccccatgctgaccggttgccgtgggtgtgtgctggtggggggtaggagcatagcaggtggagtttcattagaattagtagaactcaggcatttgtgaagtttccgtttccctggttagggaagctagaggccgtggggcactggcatttgagaagctggaggctgcagcttccatcctgcctgagctgcttgctgggcagaagccaggctgagcgtgtgagcttcatttatttctctctgcaaggggctgctgaaccatgatgggggcacaaagtgggcgaagggcgggaagataagtggggtacacccaggaaggtggggactgtccaggcttcagagtcacagatgtgggtttgacctttgactctgccagtcctttcttttgtgtcagtggcagggccttggattcttccttgtgaaactggagcagtcattttaggcagagctctttccagtgtaagggacagagaccccttggagccagccaaagttgaaagaggcgttcatcacatacagagacacgtcggagtaccctgaggacaggaacctgtgtagagctggcctcacaggggactcgactagaaggaggagagtgtggaggcttctcttgtggcctctctggagtgctccctccacccccaggcctctctcccacctggcttccctggtgactacaactgtgtgattgtccaacttcagtgtccattcatgtctcttagattcttgaagtagaggccagttggcccagcttctcctttaggcaagcccacatttcagaggtcctagcagatgtgcttgagccagccctggcccaggaggccgcccggtgcagcccctgggcccagagccatggtgaggcgatccttagcccagagggaggcgggcatggacagtgctctgtggtggcctttccaccctccaaaagtgattgcttcttgatttctctttccctgagtctgcctcccaacttcccagactttaagctgaaaccttctcctatttcattgaaaaaaacagaagcctttagtcccccaaccctcacagtacggagccacccctcgcccccagtgccatcttcctacctcctcttgttgagttcaaagggtcctttgcctctcgaaggcaggtctgtccattcagcttcttgtcttgctcctacagagacctcttcttttttcagtgtcagggttttctcccattctattagacccctcaaacatcattctctagtttcgcttattatttaaagaaaaagaaagaaaaaccattttggccacacacattcttcccacaaaacttcaaagcagttttctgccctggtgctgtttggcgtgctggcatgcagacccgtcatcacaagctaccggaagacagaggggcttgcagcagagtgtcagccagctctgcactgagcacgtgccactgacagtttttccctggccaaatattcccgaggaaggaagcagtgcgttcgcttatgttctggcacaaatgcctctgtcttctcacagttgaccttcttgactgtcttggtccccacgacagcacgttctcttttgcctcactccttttctctgagtaccccatgcttgctcttccccttcctgccctgtagctgtcagggtgaaaggactcagtcctgggccctttctctgcctgccttggacatgatctctcttaatccaatagttgatgacttccaaatacagatcttcagcccagacccagctcctgactcatttatccaattgcctccttgatattatttccatgacgatgtctaagaagcatcctcacatgcagagcactcaatgcgcttcttgagtccgcccttccccagtgcccatgccctccctggctcaggccactctgccctctgcctggtgctcttcccagcttttttcctggttggtcccttttcaccatagggtcccctccccagtcgttatctcagagatgctttcccttgctgccccagctcacaggtgagtgagagcagagacgctgctcctcctgaagcctgatgaagtacccaggattcagacgggcatgtttgccctttaaatcctgaccagaccggccctggccccagcagcttgaggcttttttccatgcctccaggaacttctgaatgcatcttacaaatgttgagaactggtcattgtggaggctggggcctttgaatgtcaactacacttgtgtgggtggatgcagacagcagcatgaagtgcaggagggaagtcaggcccagcactgctagccagccagccagggcatggctagccccaggcctggggtgccacctgccagtcctgtgaggaatttgggagagacagcagcgggctccgacaggccattagctccacaaggaaatggccacgaatcagagtgctgctaatggcttgtttctttttaaacaatttttttgaggccgtgtcggagagaataggctgccatttgcagctttgaacaggaatgctgtccattgctctgttagaagccatggggtatttacaaactgggtgactgttggcaagacatttttcccctttgctccttggtttcctcccttccgtgatggggataataaagcctgtctgtctgactcacagggccgttggggtgtgttccaggtgttggtatgtcagctagcacgaattcgccgcccgctctgtgccaagccctgagttatacagcttcctactccatcctcaccacggtcccgcgaaggtgggcatcactcaaggctgcagtcaggcttagaggagctcagtgcacccgtccctgggccgcccacgggtatgggtggagatgtctcagcccacctgtaccgcgtccctgcgggcgggcagagctctgggtacagatgcatttgttttccagattctcacagtcatcctttaagacaagctgttctcattgttcagatgatggcatggaggcctagtggagttaagtgacttgctcaaagccatttagcctgtaagtgattggtcctggatttgaaggcaagtctgcctggaagtcctttggaagacttgaaaaggagaattggtaaagccaggggttcctatacctttcaggccttaagaaagtaatagtaggtgtttttttttttctctctgttccttatttcatgaaggaaattatacatttgcccaaatggcgcttcccttaatatttgctgaaccttaatgtttgcttttgattggcattatgccatcctagcacaataatatttgtcatctcataccttaggaaactctgcctgattttgaatgatacaaaaaaggttttggggtctaaatggagtgagaggaatggtaagagattaagtatccctcataaaaacaggatggtgtcagtaagacctttcccaactctgagttcacattctaccacctcggtcacttaggtgtaaatgtcatcttcctcctcaagatgatgacaggccacccactaccctgggacaaaacagggcagacagtatacagcataggtccctctgctagaggaacattggtattcagtgctcttctgcttccaagaacccctcactccatgctactctccgagaatattgtaatggacatctgcctttgatatagccctgatacccaaccccactccgtcactgtgtttgaaaagtactcttcctgctgtacaaattggaaggctaggctgtgggcatatgggccggggcttggctagtcacacatgcatggaagctggtgatgcagaatgctggggggtggcgagttcatctggagactgtgccagcagccacatctagtttttgggggtggtcatggtggctcggcacctcctgctccagtgcccatgtccagtgctgacggtggtgatgcaggctctggcatcctcacactgggagtgtgagttgggctccagttatggcagcacagcataatgtcctgcccattttctgagcctggttctttggcttttctgggaatcagtgagatgccaaaggcctttaagtaaactcgatttaaatcagctgaagtctgcttcatctgcttaaagctaagaagccgacttttatagagatgttcctctgtagttatccaaacatttgtattcattcttctggcccctgaaagttctacttcacctgttaggcacctccgtgagctacagaattaacaggagaatcccaggttgagtgggtggcaggactgtgggctcagccgtctcccttcattattactgtgacccgggtctccatcatgccccctagacggtgacctctgtggggacacaactgagtccttcatctctatcctcagctccttgagtaatgcttggcacacggtgggtgcttgggaaggtttggatgaatgggccaaggaaccaacaaagagatgagagaagttgatgcctgtgggctctctgcagccttaatgaggctggcctggcttgggcaggaagggggctacgtgcctggagactgcaggctgcctgcagttccatgctggagatgggctggggagatcatggaacttagagcaggaaagcaagtagctagagccacgaaagggagagccgctcctctgagtggaggcggcgtagttggtgcttcccaatcctttcacctcatggcatgtacagaacacagtattatttgtctggtacccagggctttgtccagctggcgctggagcggaggcccctctcacagcacaccggtgacccagtgcccactacttagagcgctgatcccaagagaacttagagcctggtgtggcctctgttcttagccctttgtcatgtaagttgcagatatttttcctagttgtgtatttgcctttaagtgatttattttttcttctatttggtttattctctactatcacagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaa

SEQ ID NO: 38564 - DNA, 18672 bp, Homo sapiens
ccggggagtaggaaggagccggggctgtagccggagtggagcggctgccagccgaggagcaggcgcggccgcggcgccatattgcggccctcagcggccgcgaccgagtcatggctgagacctacggtgagggtggtggacgaagctggggtcctgggtctgggcccagggaggatgcggcctgtgggaatgggcggggctttgtagatcagggggcggggtctggtgtgatggaggcaggacctaagtggatgctgggaggggtttagtgggtctgaggctgagcttaatcgatttaggtggagcctgagggtctggtgcgtgggttaaatagatctggggcgggatttgagggagctggtcctgaggggttcagggaggccctgagggaagaggtgggccttaatggatctgggcggagcctgagtgaaggggcggggctgactgcatgaatggcaggagtcgggcttatgggctagagggaacactgaatggaagctcgggaccctggggctgatctggctggagagagctctggaatgggtttggggatgggctgtccttgagttaggggcaggacttagtggcaaagggtgggacttatgcatgagaatggagccgggttctgggcagagggagggaaggagaggtcgggaagtggaaaatcagtagggatgcaccataggaggtggtgattggaggcaggggaagtgcaggtttaggagtcagagggagccgcattcactcaacaaatatagaagagaagggagaagagtgcaaagaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcctatgtctgtttctctccctctaactgtgatggttagagagagagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtaggtgggctgggctcccaagggtgatggggagagagagtgagaaggaaagagagagatgtgtgtgtagagtcacttggagacactgagagggcagacaaggcagacagagagagatgagacaccgtagttagcaggtatatatatccaaggagagagggagtactggagagataaagagatggtggaagaaaaagaggtaggggccaggcgcaatggctcatgccggtaatccccgtgctttgggaggccatggtgggaagattgcctgagcccaggagtttgagaccagcctgggcaacatagtgagaccccatctcaaagaaagaaaaagagatagagaaaagtggcttgggggtggggaaagggatggagactgagagacaccgaaacagaaagagaaggggaaacttgagagactcacactcagaaaggaaaagagcaagagagacagagactaagagagttgaagagaatgataagggaggtaaggaggcctggcacggtggcttacacctataatcccagcactgtgggaggctgaggcaggtggatcacttgaagtcaggagttcaagaccagcctgccaatatggtgaaaccgtgtctctactaaaaaaaaaaaaaaaaaaaaaaaatcaaaaaatgtagccaggctgtggtggtggatgctagctacttgggaggctgaggcaggagaattgcttgaacctgggaggcagaagttgtagtgagtcaagatcgcaccactgcaccccagccggggtgacagagcgagactctgtctctgaataaataaataaataaataaatgaataaataaataaataaataaataaataaataagggaggtgaggagacacagagaaacagaggtcagaggcagagagggagacagggtgagtcagacaggtgtagttggacgttgaatgaatgaatgcacgaatttacgggaaggcaagggtgagcatgagagccacagagatggaacagaaagagagacagtgagaaatagggaactgaagacacacacgccaaggcaggagaaccgcttgagtccaggagtttgagaccagcctgggcaacattgtgaaatcccatctttccaaaagagagatggagaaatggacgtgttgtgggagagagagagagagaaatgcgtagggctcaacacactgtaggtcttcaggaaatgcctgcagagcagaaaagttgatagacacatagaaaccttaggagaggccgggcgtggtggctcatgcctgtaattccagcattttgggaggccgaggcgggcggatcacgaggtcaggagatcgagaccatcctggctaacatggtgaaaccccgtctctactaaaaatacaaaaaattagctgggtgtggtggcagacgctggaagtcccagctacttgggaggctgaggcaggagaatggcatgaacccagaaggcggagcttgcagtgagcccagatcgcgccactgcactccagcctgggcgacagagctaggctccgtttcaaaaaaaaaaaaaaaaaaaccttaggagagtcggagaaacagagagcagggagagaaatagagggaattcagtccacggaaaagtgtgatctatggcagcatctagtagctgctgagttaattcttgcgtatggattaactgcctgaggtgcacagagcccaaaggcagagagaggggctgaaggatagacaggtgtgtagcatgggctaggtttacggtgagtgcttagtaaatgctgtggaatgattgcatgagttccagaaggacccagactggtgagacagagaatgcagaattggctacactgggaaggagactccacctgacacagcaggagaaggataagcagatgttgtatagtgcttgggcagggccaggcaaaggggagatttgctcagaaaatgttgaatgaatgaatgcacaaatgcatgggaaggcaaaggtaagcatgagagagccacagagatgaaacaaacaaacaaaaaagacagaaatagggaattaaatagggccaggcacggtggctcacgcctgtaatcccagcactttgggaggcctaggcgggcagatcacttgaggtcaggagttcaataccacactggccaacatggcgaaaccccatctctactaaaaatacaaaaattagccgggcgtggtggtgcatgcctgtaatcccagctacttgggaggctgaggcaggagaatcacttgcatccggggggcaaaggttgcagtgagccaagatcacgccactgcacttcagcctgggcgacagagcaaaactccatctcaatcagtcaatcaatcaatcaatcaatcaataaaagacatgtagggccgggcacagtggctcacgcctgtaatcccaacactttgggaggccaaggtgggcggatcacttgagctcaggggttcgagatcagactggccaacatggccaaccccatctctactaaaaatacaaaaattagcctgatgtggtggcgtgcatctgtaatcctggctactcgagaggctgaggtgggagaatcacttgaacccgggaggtggaggttgcagtggttgcagtgagccgagatcatgccactgcaccccagcctgggagacaagagtgagattcctactcaaaaaaaaaaaaaaaaaaaaaaaaagaaaaaggaaaaagacacataggttaaggcaggagaatcacttgagcccaggagttggagaccagcctcggcaacctagcaaagccccatctttacaaaaaatattaagaaattagccaggtgtggtggtgcacacttgtagtcccagacactacataggctgaggtgggaggatctctccgttgggatactgagcctaggaggtcgaggatgcagtgagccaagatcgtaccactgcactccagcctgggctacagagcaagaccatcaaaaaaataaaaaataagacacacatgaaagagacacagagagaaaaacagacgaatggaaagatagggacacagggagagacaaaaatggagattcataaatagagacagctggccagctaagtgagatagaagctgagagaggcgaagagagagggacttcaaggatgcaagaagagagaggaattgcatggtgacccgaccaaggccaggttttgggggatgggccagcagtgaaggggggggcctccgaaccaccagtctgtctctgtagaggggggcattctcggggcagaccccagccttgggggtgactgggtccccctggccccacaggtcagtgacgcggagttattaccgaggggcggctggagccctgctggtgtacgacatcaccaggtgggtgcccggggtgggtggggtagggcatgggtggttcctctcctgcactgcctccctcccttctcccttctccacagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatggtgagggctgtgtcgtggaccaggtggtggtgggggtggacagtccacagggaccatgggtttactggctctcagtggctgtacccagcaggggaacgtggaggttcagaagtctgggttcaaatttgagtgttggctgggtgtagtggctcacacctgtaatcccagcagtttgggaggccaaggtgggaggactgcttgagcccaggagtttgagaccagcctggacaacacagtgagatcctatctctataaaaaatttaaaaaattagctgggtgtggtggctcatggctgtagtcccagctacagtggaggctgaggcaggaggatcacctgagcctgagagtttaagactgcagtgagctgtgatcacgccattgtactccagtctgggagacagagcaagacactgtctccaaaaacaacaacaacaacaaaacaacaacaaaactaagtgttgccatcagtgagctatgtgattacactggttctcagtttcttcatctggaaagtgggatcacagtgtttctgccccacagtgtgctgtgatgattaagggagattgtggaaagtccttagcacccgccacagagtgggtgctagattaatgttggccgctaaggtttcgcctaccgtcaggaggccgcacagggtattggttttttaaattaattattttatttattttttcctcctaccgcaccttcctgggtattggtttaatgtagagattgcaaccctagatggccctaggtgaaaggcacttttttttttttttttctgagacggagtcttgttctgttgcccaggctggagtatagtggcgcaatctcggctcactgcaacttctgcctcagcctcccgagtagctgggactacaggtgtgcgccacaacgcctggctaatttttatatttttagtagagacggggtttcaccatattggccaggctgatctcgaactcctgaccttgtgatccgactgcctcggcctcccaaagtactgggattacaggcgtgagacactgcgcccggtgaaaggcacatttttgaatacaggagatgggatggggtagatccttgagtaacaggtactggtgttaaggggagtgcagcatactgacaacccacaccaaaaggtttgcaagggccaaccacaatggctcacacctgtaatcccagcattttgggaggccaaggtaggagcatcacttgagatcaggagttttagaccagcctgtgtaacagagtgagaccctgcctctacaaaaaaaaaaaaaaaaaaaaagcctgggtgtggtggtatgtgcctgtggtctggggtactcaggaggttgaggcaggaggatcacttgtgcccagaagttcgaggctgcagtgatctgcaatcacaccactgcactccagcctgggggacagagagagactttgtctcaaagaaaaaaacaaaaaaggtttgcaagtataaactcatttgaaaacattgtgttggccaaaccacccacatctggtggcttgagatctgcctgtgttcccctgttttgcaacctccaggtttaaaggaggttttgccatcagagaggtgtgggtgtgaattcagctctgattttctgactgtggggccttgtcatgctgctgatgggtagactctggttggcctgttcctgtcctagatggtgctagagacacagtgttggagacagccctaggcccaaccttcatggagctcacagttcagtgggtgagggtggaaggacagacccacttccagacagtgacacctcaggaaggtcagggcttgatggtgaagcaccgggagacaggggtcagagccagcaggggagagccccagagggtcagggccagtactgggggggcaggcagagggatcggggtgggatggagaacacaggcagaggggtcagggctgggatagggcaggcagaggcagaggggtcagttgggatgaggggacacaggcagaggagttacatgggatggggggcaagggcagaggggttggggtgggatggggggcccaggtagaggggtcaaggccaagtttgggaggcacaggcagagcggttgcatgggatgggggagcatgggcagagggctcaggggtggaatggggcaggcctaggcagaagggtcaggggtggaatggggcaggtccaggcagaagggtcaggaaaggaatggggcaggcccaggcagaagggtcaggggtgggatggggacccaggcagagggttggggccaggatgaggaagcacaagcagtggggtcagggccaggatagggggccacaagaagctgtgggagccctaagtcggtacctgactcagcccaggaagtcagggaggacttcttggaggaggagctgtgtgagctgagctctgaaggaagagctgggtgggcatatcgggaagcggacattagtggcagggaaatggcatgcgcagaggcctgaggtgagggtaaggggggatggaacattggaggaacaggatgagagtcagcaggtgagagctcagtggagggtggggactaactggggccctgacctcagagtgtgtgcccctgcagagctgatgttcctggagaccagcgctctcacaggcgagaacgtggaggaggcgttcctcaagtgtgcccgcactatcctcaacaagattgactcaggtgaggccccgaccggcccgagtgggagcgaagggcaggcccgggggtctccaggcaaccaatgctgacctctccccttccccacaggcgagctagacccggagaggatgggctctggcattcagtacggggatgcgtccctccgccagcttcggcagcctcggagtgcccaggccgtggcccctcagccgtgtggctgctgagctctgtggagccaggtgggacactgggggctttagggaggcagggcggcctcttgggcatgggggagatggtgtggagatagacactgaacatgtgatgacaagagaaacagagtgagagaaagatgcaaaaacacacaagctaaaggaggcatctggctgggcgcagtggctcacgcctgtaatcttagcactttgggagtccgaggcgggcggaggcagttcattgggtgggggtggggagacagacccacttccagacagtgacagctcagaaaggtcagggccaggcctggctcggtggcttatgcctgtaatccctgtactttggaaggccgaggcgggcggatgacctgaggtcaggagttcgagaccagcctggccaacatggtgaagccccctctctactaaacatacaaaaattagctgggcgtggtggcaggtgcctgtaatcccagctactcgggaagttgaggcaggagaatcacttgaacctgggaggtggaggttgcagtgagctgagatcacaccattgcactccagcctgggtgacaagagcaagactttgtctcaaaaaaaaaaaagaaagaaaggtcaggaccagatggggaggcactgggggagaggggtcagagccagcaggggagaggcccaggggggtcagggccagggtcagggcacaggcagagggatcagggtgggatagggcaggcagaggcagaggggtcaggtgggatgaggggacacaggcagaggggttgcatttgatggggggtatacataaggtcaggagttctagaccagcctggccaacgtggtgaaacccctcctctactaaaaatacaaaaattagccaggcatggtggtacatgcctatagtcccagctacttgggagactgaggcaggagaatcacttgaacccaggaagctgagggtgcagtgagccaagattcagccactgcattccagcctgggcgacagagcaagactctgtctcaaaaaaaaaaaaaaaaaaaaaaaaaagagacatctgccaggccacagggaatccacctgcagccccaggccagcttcctgccctagaccttgaccctcccattcatagttctccagcgatttattgagcgcctgctgtgtgccaggccctgctcaaggcactggggatatggcagggagtacaacagactcccatcctcatggtgctgacattctctttgggggagacaggtgataaacaagagatgtaagtcgactgggcgcagtggctcacacctgtaatcccagcactttggcagggtgagatgggaagatcactttgagaccaggctgggcaacaaagcaaccttatctccacaaaaagttttttaaaattagcgaggcgtggtggtgtgcacctggagtcccagctacttgggaggctgaggtgggaggatggcttgagtccaggtgttcgaggctgcagtgagctgtgaccatgcgccactgcattccagcctgggtgacagagcgagactcttaaaaaaaaaaaaaaaaaaaaaagtaaagtatgtagtagtgagggaggtaagaactatggggaaaaataaaacaggcacagatgagtggatagggtggaggagtgtacttttttttttttctttgagatggggtattgctctgttacccaggatggagtgctgtggcgtgatctcggctcactgaaacctccgcctcctgggttcaagtgattctcctgcctcagcctcccgagtagctgagattacaggcgactaccaccatgcctggctaattttttttaatttttatagagacagggtttctttttttttttttttttttttttgagatggagtcttgctctgttgcccaggctagagtgcagtggcacgatcttggttcactgcaacttctgcctcctgagttcaagttgcctcagcctcctgagtagctggaactacaggcgcccgccaccacgcctggctaatttttatgtatttagtagagatggggttttaccatattggccaggctggtctcgatctcttgaccttgtgatctgcccgcctcggcctctcaaagtgccgggattacagtgtgagccaccgcacctggccgacacagggtttcatcatgttggccaggctggtatcaaactcctgacctcaagtgatccacccactcttggcctactaaaatgttgagattacaggcgtgagccactgcgcccggccaagaatgtacttttttttttttctgagatggagtttcactcttgttgcccaggctggagtgcaatggcgcgatctcagctcaccgcaacctctgcctcctaggttcaagcaattctcctgcctcagtctcctgagtagctgggattacaggcatgtgccaccacacccagctaattttgtatttttagtagagacggggtttctccgtgttggtcaggctggtctggaactcccgacctcaggtgatctgcccgcctcagcctcccaaagtgctgggattacaggcgggagccaccacgcccagcctttttttttttttttttttttgagacagagtctcactctgtcgccatgctagagtgcagtggcacgatctcggctcactgcaacctctgcctcctgggttcaagcaattctcctgcctcagtctcccgagtagctgggactataggtgcgtgccaccatgcccagctaatttttgtatttttagtagagacatttcaccatgttggccaggttggtctcgatctcttgacctcgtgatccgcccacctcagcctcccaaagtgctgggattacaggcgtcagccaccgcacctggccaagagtgtacatttaaacaagatgaggagggaagcctcgctgagaagatgacatttgagtgaaggaagggagatagggaggcctgtggggatctggggcaagagcactgctggagagcacagcaacgcttctagcgaggggtatgcctggtgtcggtgagggtgaccaaagcagccagtgtggtcatcatggaggacctgtgtgtgttttgtgggtacagcatgagatggggtcaggggttggaggaagcagatcagttagggcctgtgggccctggggaggcctctggcttataccctgtgtgggagccatgggaggcttctgaacagaggaaggacaggatcagattcaggggtgcagagagttcctctggctgcataaagggaaggggctgtgagggacagaggaggtcaccaggacaccagagaggaagctgctgcaaagtccagggaagatggtggaggacaggacaagggggcgggaagaggagtggctgagaagggaatagggttcatgtcctccctagactctctgtcttccagtcttggcctctctcttttttttttttttggttcctgtctttttattttgagacagagtctcgctctgtcacccaggctggagtgcagtggcgcgatcttggcttactgcaagctccgcctcctgggttcatgccattctcctgcctcagcctcctgagtagctgggactacaggcacccgtcaccatgcccggctaattttttgtattttttttagtagagatggggtttcacggtgttagccaggatggtctcgatctcctgacctcgtgatcctcctgcctcggcctcccaaagtgctgggattacaggcatgagcctttcctttttttttttttttttttttaattttagagagaatctcactctgctcactctgtcacccaggctagagtgcagtggcgccatcttggctcactgcgacctccgcctcccgggttcaagtgagtctcctgcctcagcctcccaagtagctgggattacaggcatgtactgccacaaccagctaatttttgtattttttttttttttttggagatggagtctcgctttgttgcccaggctggagtgcagtggtgcagtctcggctcactgcaacctccgcctcctgggttcaggtgattcttctgcctcagcctcccgagtagctgggactacaggtgcgtgccaccacgtctggctaattttctgtatttttagtagagatggggtttcaccatgttagccaggatggtctcgatctcctgacctcgtgatccacctgcctcggcctcccaaagtgctgggatgacaggcgtgagacattgcgcccggccaatttttgtatttttaatacagacagggttttgccatgctcgtgaggctggtcttgaactcctgacttcaggtgattcacccgccttggcctcccaaagtgctgggattacaggcctgagccactgtgccctgccaatcctgtctccttttgatgcagccactgggtctttctaacacacatatctgctcctgtcgctccctttttcaaaaccatccatgcatctcagggccccaggacacaaatgaactcctcagcctggtgtttgaccctctgcagggactggcccctgccagcccagccttaccggcctcagccacttgtcggtctccctacctctcaggccactccagccacactgaagttcttcccattcctctgggcccttgctcatgctgggcctctgcttggaacattcctaccctcttttccctggcaacctccttcctccaggcagcactacttgttcctccaggcttggtccaaacttttgtttttttttgagatagagtctctgtcactcaggctggagtgcagtggcgtgatttcggctcaccgcaacctccgcttccaggttcaagcaattctggtgccccagcctcctgagtagctgggactatgggcatgggccaccaacgcctggcaaagtttttatatttttagtagagacagggtttcaccacgttggccagctgctcacaaactcctggcctcaagtgatccacccacctcagcatccaaagtgctggaattataggcatgagccactgcacccggccccaaacttcttgacaggctttcaaaaccctgcaggatttggtcccatccctccttctctgggggatgtgtatgtcttgccagttctcccttctatacttcatgctaaatcccctcccagcccttggcagctccagggtgggacaggtggggaacaagtggttagaccttggatctacttggaaggcagagccaacgtgatttcctgatggaatggatgtgtaatctgaaagagagagaggaatcaaggatgatgtcttcagacagtgctctcttgtctttccaggactttgcacctgctgtgcctgagcctaagtttgctcatctgtaaaatgaggctaataatagcacctgcttctatagatgttgagaagaagaaatacattaattcacgaaagtgctcagaatggggcctgatggtcaagacttgatcgatgagggctgtttttaaagttttcttcttatccatctttgggctgagctcaaatgaatgggtgtgtcttcttcacctcagggcttagcagagactctgtcctagagagtttgccctcagtaggtgaaatgtaacaaggcaaggcaaggctttttcacactttgctgactgcaatctacaggaggaaatatattttatgtgttaatcaaggactgactgtagcagatcccacccacatataaaactcaaacacacattttcctaccaccagtattctttcgtttcttggcactaaaatgaaagtcacataacatacatttacgtgacttttcaaagtgtacaattcagtggcattcagtacattcacagggttgtgcaatcaccacttctgtgttgttccagaatgttttctttttttttcttttcttttttttggagacagagtctcgctctgttacccaggctggagtgcagtggtgcgatcttggctcattgcaagctccacttccagggttcaagcaattctcctgcctcaacctctggagtagctggaattacaggcatgcaccaccacacccggctaattttcgtatttttagtggaaacggcatttgaccgtggccaggctggcttgaactcctgacctcaggtgatccacccgcctcggtctcccaaagtgctgggattacaggtgtgagccactgcgcccggcctcagaacgttttcattactctcagaggtgccatgcttatactgctttgtaccttatacctttgtacccatatttattaagcagtcactctccatttcccccaacccctagcaaccaccaatttgttttctgtctcttttggccaatatgatattcttttccttttccttttttttttgagaagggtctcactttgtcacccaggctggagtgcagtggcaccatctcagctcactgcagccttgacctcctgggctcaagtgtttctcccacctcagccccccaagtaactgggactactggtgtgcaccaccacgcccagctaatttttatatttgtattttttgaagagatggggtttcaccatgttgctcaggctggtctcgaactcctgagctcaagtgatccacccacctcagcctcccaaagtgctggaattacaggtgggagccaccatgcctggcctcttttccttttttcttttcttttcttttttgtttttttttttttttttttttttagatatggtctcactgtgttagcggggttggtcttaagctcctggccttgccgggcgcagtggctcacgcctgtaatcccaccactttgggaggctgaggcgggcagatcacgaggtcaggagttcgagaccagggtgaccaacatggtaaaaccccacctctactaaaaatacaaaagttagccaggcgtggtggtgtgctcctgtaatcccagctactcagggggctgaggcagaggaatagcttgatccctggaatcagaggttttagtgagccgagatcgcaccactgcactccagcctgggcgacagagctagactccgtctcacaaaaacaaaaacaaacaaaccaaaaaaaccaaaacaaaacaaaaaaactcctggcctcaagcaatcctccacctcagcctcccaaagtgctaagattacaggcatgagccaccgagcccagccaaccaatataatatatctttttaaattattattattattttttgagatggagtttcgcttatgttgcccaagctggagtgcaatggtgtggtctcggctcactgaaatctccgcctctcaagttcaagcgattctcttgcctcagcctccctagtagctgggattacaggcgcccgccaccacgcccagctaatttctttgtatttttagtagagacagggtttcaacatgttggccaggctggtctcaaactcctgacctcaggtgatccgtctgtcagcctcccaaagtgttgggattataggcatgagccactgcgcccggcctatttacaaaatttttttttttaaataatgttttaattttgtagagatggtgtctatgttgcccaggctggtcttgaactcctgggcccaagtgatcctctcttgcccttgcctcccaaagtgctaggattataggtgtgagccactgtgcctgcccaaccaatagaatattcttattatatatgatgcactctggtatttgccgttctgtgctattctgtttgaatttaaaaattggtcaagacccaccaaactgatttccccaccaaggcagtgacacacattagaatgacctggagaattttaaaagatactgatgcccaggcctcaccctagagattctgaagtggtttcaggactttttcttaattaaaagataaatagagatgaggtctcactatgttgcccaggctggtctcaaactcctggcctcaaacgatttctcccaccttggcctcccaaagtgctgggattaaagacgtgtgccaggctgggcatggtggctcacgcctgtgatcccagcactttggggggctgaggcaggcggatcacaaggtcaggagatgaagaccatcctggcttgatctgtagatcaagtgaaaccccgtctctactaaaaatacaaaaaaaaaaaaaaaaaaaaaattagccaggcgtggtggcaagtgcctgtagttccagctactcaggaggctgaggcaggagaatggcgtgaacgcaggaggcggagcttgcagtgagcctagatcgcgccactgcacttcagcccaggcaatagagcgaggctccatctccaaaaaaaaaaaaaaaaaaaaaagatgtgagccagccagttgcaggatttctggaagctcccaggtaatgctatatacaaccaaagtgagaaccactaacctaacgttgtctccccagcttggggaacagtgaaatgagacttagagccagggtgatccaggaacatagagggacacagaaagatacaaaggcaggttcattttatttatttatttatttatttatttatttatttatttaaattttttgagatggagtgtccctctgttgcccgggctggagtgcagtggtgtgatcttggctcactgcaacctccgcctcctgggttcaagtgattctcctgcctcagcctcccaagtagctgggactacaggcacctaccaccacgcctggctaatttttgtatttttagtagagacggggtttcaccattggccagggcggtctgaactcctgaccttgtgatctgcctgtctcggcctcccaaagtgctgggattacaggcgtgagccaccgtgcctggccgatttatttatttatttatttatttattttgagatggagtttcgctcttgttgcccaggttggagtgcaatagtgcaatgtcagctcaccgtaacttctgcctcctgggtttacaagattctcctgcctcagcctactgagtagctgggattacaggcatgtgccaccacacctggctaattttgtatttttagtggagatgaggtttctccatgttggtcaggctggtctggaactcccgacttcaggtgatctgcccgcctcggcctcccaaagtgctgggattacaggcatgagccaccgcgcccggcctatttatttttttgagacagtctcactctgttgcctaggctggagtgcagtggcacaatcttggctcactgcaatctccacctctcaggctcaagcgatgttcccacctcagccccccaggtagctgggactactggtgcatgccactacacctggctaatgtttgtatgtttttgtagagacggggtttcgtggtgttgcctaagctggtctcaaactcctgggctcaagcattcctcctgccttggcttcccacagtgctgggattacaggcgtgagccactgcgtccatccagattcatgatatttagatgttgaaatgtggctttacagactcagacagctctctgaggcaaacaaagagggagatgcaggtaccctcagcacaagccccaaattacctgcaggggagaggcggaaaatcagacaatgtagaaaccgggagaagaaaggtatggacagaccgatgcagataggaggggaaggaaatacctggaaatgagatagagaccggctggacagaccccggggaccctgcaggtcaccacacccttctctttcagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgtttac

SEQ ID NO: 38565 - DNA, 7508 bp, Homo sapiens
aggctactcctcccgcagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtgtgagagcggggcagggccggggcgccgggtctggaagcttcccgggggtggacctgggaacaggagagatgagagaaagttgcagggagacaaattttgcaagattctttgggtccaatttattcagtaacattcggctcttctatcacaccaatctgttgaaagaactggaatgtcgtgacagagcccagataccgtagtaggccaaaaagccctttaaggccttgttatttcccaccgattattatttatttacttacctatttatttttgagacggagtctcgctctgtcgccgaggctggagtgcagtggcgcgatctgggctcactgcaacctcccccttccgggttcaagcagttctcttcctcagcctcccgagtagctgggattataagcgcccgccaccacgcccggctaattttttttgtatttgtagtagagacggggtttcaccatcttggccaggctggtcttgaactcctgacctcgtgatccacctgccttcctcccagagtgctgggattacaggcgtaaaccaccgtgcccggactcctaccggattattatattgtgcccgagacaggctcagcaggcccctttaagtgatttttcaaaccacaaatcttggctcacgcctgtaatacccgcactttgggaggccgaggtgggcgggtcacctgaggttggagctcgagaccagcctgttcaacatggtgaaaccccgtctctactaaaaatacaaaaattagcccggtgtggtggcgcgggcctgtaatcccagctacacgggaggctgaggcagaagaatcacttggattcgggcggtggaggttgcagtgagccaagatcgtgccactgcactccagcttggacaatagagtgagacactcccttgattaaaacccttcaatggtctgcttttaggatttagtacaaatttctcaatcctgccttcaacgccctgaccatctgtgctcattcatccataccttttaaaaatacgtcttgggccgggcgtggtggctcatgcctgtaatcccagcactttgggagaccaaggtggggtatcacctgaggtcaggagttggagaccagcctggccaacatggtgaaatcctgtctctactaaaaatagaaaaattagctgggtgtggtggcgggcacctgtaatcccagcttctcgggaggctgaggcaggagaatcgcttgaacctgggaggtggaggtggcagtgagccgagatcgtgccattgcactccagcctgggcaacaagagcaaaactccatctcaaaaaaaaatctcgaaacctcagcccatttgcatgtgctattctgtccggaaaactcctttcccctcacttttacctactatctctgagtttccaggatctcttccctcttcctctctccccagactaaaattggttacctgttagatgctgccatggcaccaggtgccatggtacctttcccttaataatgaatggttggtaaccatatgtccatttgtgtaattatttgaatgctgtctccttcactaatgtttttcaaacgtctttgaccttgcctcacagagaaataccttttacattatatatgatgctctgtgatacaattgctgattttattctattattgtgtacatgtacacaaaatgctgatcgtagcttactagtccgttatatgactagaatgtgaaaaaacactgttctggagtgtaatctgtcatcggttttgttctctattttatctccaacctctagtctagggtagatgctcaacacatgtttgattttgaacaaaagatacaggttagaggcagtggaaaagttgaagatgttatgcttatcagatttacttaatgaatttaaacctcaacccctcattagctgtaatggccttgagcgtgttaacttctgtattttcatctttgaaagggggaattatacctacccttgcagaggggacaagtttgcagtacagcacctaagcagctcttcaacaaatgtaggttcccttctactactatccatatttatggtgccaggcacttgggagttgccctagacatccacctttcttcacattccacacaactttgttgcttcccttgtcttaaaaaaggttctggaggaaaattcttggttctccccttccccaccctcagccatgactattgtgaaaaggttccttttccgaggattaaattcaaacttctgcttggctcatgtggtctcatgcccaccccagcccatctttctagattcagtcatgctactctcctgctacaaggaaccctcctcattccttatctctgctgcctccagtatctggcccttgctctctgccaggcaaattctactcttgtatgatccaacccacatgtcaccaccttagctttccagggctctcttctcccttcccaagtattcattcaatttgtgaatgtttattaagctactttttcacgttcagcactgggatagagaaaatgagcaggctcagttctgcctacctggaactcactggcaattaagcatgtattcattctgccctttttgaggatctgctctgaggcaggcacttgggggtattccataaacagtactcacctcaaagttgtttacaggctggtgcctctcccccacctccattttgatcttgcctctttttcagcacgtactctcaatgtactgtaattaattgtggctttctctagctcctgcagacctgaagtgcaagagcctgctctaccttactgatttttagatttctaacttctggggctggtcttttgtcattgatgtaacaaatatctcctccacagtggtccagacccaatctttgtccaggctggggctttcaaagatgataaagaggggttgggtgggatcacaaagaaatcttgcgcaaatataccttgaactaacatatattgaaaaaagcaggacctaacatttcaaactcactgaaaatggagaaatgagatggtaaactttttgggcttagaggtgtagaagcaggaactcttaggtaggtgggaaggctgctctgtctagttggtctctgcactcaatgcaacccaggctgggtctggagtcatttaccctccttgccctctccccagcttttcctactcttgccaagagggagaaaccaaggagctctggtcatcaggtcaccatctcaaggcctgccgagctgtggccttctctgaagatgggcagagtgagtactggggaagacaaccagcaatgtggtggaagggagcagtgagcagcaccatgacctgggcaccttttccccagagctcattactgtctccaaggacaaagccatccatgttctagatgtggagcagggccaactggaaagacgtgtttccaaggctcatgggtaaggagagcagccaattctgtgtatgtgcatggaggtgaagggtaaggaccaggaggtccccactgggacagagatgctccaagaagttctacatctgtgtctctagtgcccccatcaatagtcttctgctggtggatgagaatgttctggccactggggatgacacaggtggtatctgtctctgggaccagcggaaggagggccccttaatggatatgaggcaacatgaagagtacatcgcagacatggctctggatccagccaaaaagctgctgctgacagccaggtacaacttcaaagctgccttgcctcccctcccctccctgtgtgaaatgtcttcctcaaatagaccttgcgtctaagcctactgctctactctctacagcggggatggctgccttggcatcttcaacattaagaggcgtcggtttgagctgctctcagaacctcagtctggggacctgacctctgtcactctcatgaaagtacagctggttatggtgggatggaggggtgtgtgctgggggcttagtctgaggcagcttccacattgttttctctatttccctgcagtgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcaggtgagggaagcctggacagcccttaggtcacaggaagggcagacccagctagccagtactcaacactgttctttccctgcccagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaattttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggc

SEQ ID NO: 38566 - DNA, 49269 bp, Homo sapiens
cgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgaggtggggaccttccctgaaccctgctcggccagaagtcactcttccaggctctgacaggtttctccttgacccaagaataggccctctcgcgaccctcccggccctgacactaggagccttcccgggccgtgccccaatggcctccgccacagagctggagaatcctctccccaggcctccatagactgagagtccattctcttaagcgcttggaaggctctttatcctggagccgcttaccccaggggcagtcgtagatatttttaccttctggaaaaataggaaacgcgcacctgcctttcctccttttgcgtttccagccctattctcatggcgcctccacccccaaatccttaagagcctcctgttccattccaggtggaatcaggtgctagtcctctggaaacgaaagcctggggtcttcttgtattttttttcttatttctttctttattttttttatttcattttaaaaaacctgtaagttcccttgcagagggcggtttatacttccgaagcctccagagaggggtgcgtctgaagctgccctgctgtctgccttgcttggcttttttttttttttccatttaattttttttttttagagacagggcgttgctatgtggcccaggctgatcttgaattcctggacccaagcgatgctcccgcttcgccctcccaaagtactgggattataggcgggagcactgtgcaccacgcctcggcttttggagagcaattccaaacccactgcccagtttctggtgtctgtaatcccttggtgctttaggtccactctttgccttattttatttatttgtcattacttttttttttttttgagacagagtctcgctctgtttcccaggctggagtgcagtggtgcagtcatagctcgctgcagcctcgacctcctgggctcaggcgatcgtcccgcttcattctgccgagtagctgggactacaggtgcaccaccacacctggctagtttttttggttttggtttggttttttcgtagagacaggatcttgctatattgcccagactgattttgaactcgtagggttaggcagtcctcctgcttcagctgctcaaagtgctgggattccaggtttgagccaccctgggcaccttgcctttttttttttttttttaattatgagttaaattcccttgcagcaggcagtttacacttctgaagcctctagagagggctgtgtctgaagctgccctggtgtgtaccttgcttgggttttgtttttttttttttgggtgtgtctcatgttgccaaggctggtctcaaactgctgggctcaagcagtcctcctgtctcagcctcctgagtagctgggaccacaggtgtgcgcaacaacacctagctagtttttgcttattttttgtagagatggggtcttgctatgttgcccagattggtcttgaactactgggctcaagcagtcctcccgcctcagccgcctaaagttctgggattacaagtatgatctaccacacccagtgtgcaatttttttttttaaagaaaatacctatgagttaaatttccttgcagtaggcagtttgcacttccacagcctctagagagagatgtgtctgaagctaccctggtgtgtgacttcctcagcttttggagagcaactccaaacctgctggccagtttctggggtgttgttgtgcttaatcccttgatgccttaggtcagctctttgtcttatttatttatttattttgagatggagtttcactcttgttgcccaggctggagtgcagtggcacgatctcagctcaccacaacctccgccttctaggttcaagcgattctcctgcctcagcctcccaagtagctggaattacaggcatatgccaccacacccggataattttgtatttttagtagaaatggggtttctccatgttggtcaggctggtctcgaacccctgacctcaggtgatctgcctgcctcgacctcccaaagtgctgggattacaggcatgagtcactgtgcccagccatttgtcttatttatcattactatttttttgaggggggacagggtcttcttctgtcacccaagctggatggagtacagtggtgcgatcgtagctcactgcagccttgaactcctggactcaagcaatcctcccacctcagcctcctgaatagctgaatacaggcatgctctaccacacctgactaatgattattattattttttttttagaaatggggtcttgctgtattgcccaggctggtcttgaactcctgggctcaagccatcctcctgccttggcctcccaaagtgctgggattataggcatgagccacggtgcccagcctttgtcttagtttttggtccccctcacctgaccccagagttctagaaccattcccttggaaagaaagggactggtcagggctggggatggagaagtgctgtggtaggagccctttcttctctttcttccccagctggatcgccatacctaccctgtggtcctcatcttcctggcctcatagctcctcctctccaagcatgtcttccccgttgcaaagagctgtgggagataccaagagggccttgtctgcatcttctagttcctctgccagtctaccctttgatgacagggactcaaaccatacctcagaggggtaagtagatgttgcattgtgtggccacttcctgtgtccctggcagccttccccctcgttttcccacattgatgataatatgcgtgggactgtgtgaaaacaccagaagtgctatactcgttcagcacagtgacaccctccctccagctccaggtgttttttttggcggtcctagatgttgtagacatcaaaatagtagtacatcctgtttttttttttttttttgagacggagtctcgccctgtcgcccaggctggagtgcagtggcgcgatctcggcttactgcaacctccgcctcctgggttcaagcacatcctgtttttaatccatcatccatcttgtctaaacctctcttaaacacatttctatgttcagcatgtaccaaccctggtgggggctgagagctggcagatgggggagtaaagagttctttatttgttgcctggtaaattgtatatactttttggctagtgtcccctatttcttctacttggggattttgtaaataggtctgtgtatccttatttattaccatatatgagtttattctgtgtaggttataataatatatcttggttttttacctttccagaaggaaaaaagcgaatttcatacagatctgctttatcccctggctgttttaattggctttctctgaatcatttctgtttctgtcagtgctgctgtgggggaccagattatatcaaagttataaacttgaattgataagacatgtggtttatgtttcaagggggtgaaatttaactctagatacatattactctcccatttatggatgaatgatagatgacttcctgagccatgattatctttctctacaaagagcagtgatctcgctacctgctaagtgagtatcatttgattctcttcttcggagagaatactaggaagagttgtccttctcctgcctcatttcctcattcttcatctccattgctttcatgtgaaagttttcctttaaggctttgtcccggccgggtgtggtggctcatgcctataatcccaacactttgggaggccgaggcgggtggatcacctgaagtcaggagtttgagaccaccttggccaacacggtgaaacacctgtaatcccagctactcgggaggctgaggtaggagaatcgcttgaacctgggaggcggaggttgcagtgagctgagatcatgcgattgcactccagcctgggtgacaagggtgaaactccgtctcaaaaaaaaaaaaaaaaaagactttgtcccaacttcctactaacaataagctcattttttcttaaaatctggatatgtttttctcatggagatggggtgcggtgagagacagagaaaccataattaattagccttttatatggagggaatagggtggttatatttaaagagaaccatactttctcacaggaatggcgactctttgttagctgatgaagacactgactttgaagacagcttgaatcgcaatgtgaagaagagagcagcaaaacgaccaccgaaaacaacaccggtgagtcagccagttttcttttgtttttgaatcttgtgggggaagcagcccagctacttgggaggctgaggcaggagaatggcgtgaacccagggggcagagcttgcagtgagccgagattgcgcccctgcactctagcctgggcgacagagcgagactccgtctcaaaaaaaaaaaaagaaaagaaaacctaaaagaggttcaggtgatacggttcataaaaggacaagatttacaaagtattaagggatggaaataggaagaagagaaattttgaagagaaaagaagagaaaaggacgttaggatgtagagatacaggaaggggactcaaggactttttttttaagggaaaaaaataaacttcataacaatataaaaatcaattatttcaggactgagtctaactcagactctgctgtggaattggcagcttaagcctacttgtgtgataatgatgaaaccaagcgttaatgtcactgttaccttttttgtttttttttcatatttctgatctttttatacatattaggtggcaaaacatccaaagaaagggtcccgagtggtacatcgtcatagccggaaacagtcagagccaccagccaatgatcttttcaatgctgtgaaagccgccaaaagtgacatgcaggtaaagcagtgtctcacctctgttgataccatctcactttttgtaaggtggtaaggacaagtgtctacaaacttgatttgacgtgaacattttagtgagtgtaacatgtcaagaaagataaggttatggggtgaatccttggagtgatagaagggtaaccttgaatgagagagcatgttctttttttttttttagacagagtctctttctgtcgcccaggctggagtgcagtggcacagtcttggctcactgcagcctctgcctcctgggttcaagcgattcttgtgcctcagcctcccaagtagctgggattacaggcgtgtgccaccacgcccagctactttttgtatttttagtagagatggggtttcgccatgttggccaggctggtctccaacttctgacctcaggtgatccgcccaccttggcctcccaaagtgctgggattacaggcgtgagtcactgcacctggctttgagagagcatgttcttttcttaaaggtatcacaggagtgattatgcctttattgattgatggagcagatgaggagaggcattgcatgacacaggaaggaagcttggatgtgggtggcaccttgttcacccatgttattttttagctccatcttgacaattatacttaattattttttccttgtttctttttttataattttattgaagttctaatacccgaaagtgtacaaagcttatatgtagtttaaaaaataaaaatgaaatgattactcagatctctagccccagctcaagaaatgaaacattaatagtgctgtagagatcctttgtgtaccttctttctactccatttcacagtctccttattacccacaggtaaacactagagtgaattttgtgttaatctttctcatctctcattatagtgttaccactatgaatatgttctttaattatgtaaatgaatccattattcaggcttctatgatttaattatttgagttaacattgtttgagatttacccacattaatgtgtaattttatagtttctgggaaaatatttaaaattttcaaacatatagaattttgctagttatattttcgttatttgatttctaacttcattgtgttgtagtcagggaatgtggtgtttgaaatttatgtaggggccgggcacagtggctcacacctgtgatcccagcacttggggaggctgaggcgggcagatcactcgaggccaggagtttgagaccagcctggccaacatggtgaaaccccatctctactaaaaatacaaaaattagctgcatgtggtggcgtttgtctgtaatcccagccactttggaggctgaggcatgagaattacttgaactcgggaggcggaggttgcagtgagctgagattgtgccacggcactccagcctggatgacagagtgagactctgtctcaaaaaaaaaaaaagaaagaaatttatggagacttagccttatggcctagtattgagttggtacattcgttttatcttttctgtttctttttccacctttgcttgccttcctttggatttcttatcttctgcaaggacctgagcacattttaattccaaatgtcttttccaccttatatgcagttgtacagcgtgttagtttttttttttttttttttttttgagacggagtcttgttctgtcgccaggctggagtgcagtgacgtgatcttggctcactgcaacctccacctcccgggttcacatgattctcctgcctcagcctcccgagtagctgggattacagatgcatgccaccacgcccaactaatttttgtatttttagcagagatggggtttcaccgtgttggccgggatggtctcgatcttttgacctcgtgatccgccggcctcggccttccaaagtgctgggattacaggtgtgagccaccatgcctggccttttatttcttttttttagcccattctcccccttttatttttaaaattttattaaacatagtcattttataatctatgataaattattatctaaagtctttgtgagtataattctgtcagtgccttgtttctttatatgttttactaggttttattgtgagccactcattttccctggagttcttatgtgttggaattctttggggcctaggccaaagctgggtttttaagaaaggaacctgcttttgctttgacagttgtctggggacactccagaatcacttttttttttttaagacagggtctcattctttctaggctggagtgcagtggtgctatcacggctccctgctggtttgacctccctcagtggcgaggtggtgatcttcccacctcagcccctctcatagctgggactataggcatgtgccaccatgcctgactaattattctgtttttggtagaccagcctgggcaacatgagtttcactttacttgggttactgctcccagcctgaatcgcttttaattatctgaatgattattctgggctgggtgtggtggctcatgcctgtaatcccagcactttgggaggctaaggtggatctcacttgaggtcaggagttcgagatcagcctggccaatatggtgaaaccctgtctctactaaaaatacaaaaattagccattagccaggcgtggtggcgcacacctgtaatcccagctacttgtgaggctgaagcaggagaattgcttgaacgtgggaggtggaggttgtagtgagccgagatcacaccattgcactccagcttgggctacagagtgagactccatctcaaaaaaaaaaaaaaaggaaaagaaaaaaaaagattattctgattattctgatcatgtatgtggtgtgaatcttgattgcaaatccagatctgagggctcactatggttatgaattctcaagaaagaattattttttttccctccactgtaccctcaggtcataacaagctagttttcttgctgtctctatctgcccggtaggtttagtgttcaatctgacttccttgaggatctgactctttgcaggacccagctttatttaggtgcctcctcttggactactcgtcttggaaaaagcttaggctctacctcctgtgctctgcattccatgcagccatctggatacaaagtcataaatccccagggattaatgaaacctttagggcaaaagtcagtttgtttacctcccagggttgctacttacacctcatttttggcctatatgaaattttacctttcattctagttcaccagtacattgtgaaagatgttttaaatgttttacagaagtttagatggttcaactgggaagatcatataggatttctattctgtcatattgccagaaacagaagtcatctacattttttttccctagtctttggtagatgagtggctggatagctacaagcaagaccaggatgcaggatttctggagcttgttaactttttcatccaatcttgcggatgtaaaggtgaggaaactgctccccctttctaattcccagccttttgttcctatgttatgaaattctttctccatttagataagtaggattagacatttcctaaataaaggaagatggtaaagcattagaaaaattttacttatttaggccgggcactgtgactcacacctgtaatcccagcactttgggaagctgaggcaggtggatcacttgaggtcaggagtttaaaaccagcttgggaaacatggcgaaacccctactaaaatacaaaaaattatctgggtatggtggctcatgcctgtagaattgcttgaacccaggaggtggaggttatagtgagccaggatagcgccactgcactccagcctgggcgacagagccagactgtcttcaaaaaaaaagagagaaaagtttcacttctttaactaaattttttattgataaatatgggaagtgatccagtagggaaccatgttggtttagaggcaagacactttagggaaaaagaagtaatcacgcttatgttatggcacaaatttgaagacaccctttggtctttctggatgcaataatgttactctttgtttcccagctactttgcccatatttctcctctgtagctgtggtacccccagaactcttattgccatggcttcgtttattgggacagatggtctcagtcaggttgtattatataagaaatcagcatctggcttagttttattgctgtctttgttttgtttttttttgtttttttttgagacagagtctcactctgttgcccaggctagagtgcagtggcatgatctcggctcactgcaacctctacatcctggatttaagcgattctcgtgcctcagcctcccaggtggctgggattacaggcgagtgccaccatacgtggctaatttttgtatttttagtagagatggggtttcaccaggctgatcttgaactcctgacctcaggcgatccccctgcctcgacctcccaaagtgttggtattacaggcatgagccatcgcgcctggcctgttttttggtttgttttttttttgtcgttgttgttgttgttttttggcagtttttcactgcttgattcctttttttttttttgaaacaaatcctgcctcaggtttatttgtacaaatagtgcaaggggacaccagtcctgacctcatgctggcagagagagatctctactctgaagcctttgtacaggcctgggtacttttgggagcctgagctggaactgaaggtggaggtgcagcctggcccttcatttgatccttggcctttggctggcacagcctgagccccttggcattgtgggcacaagcatgcttctcaagcttggggtgggcagtgtaggcaagtcggcttaacctccttgggctttatgagggacttgatagcctcagcatgtgcactcatggccctatggccctggcattgttgccctgcatcatcttttttttttttttttttgagacagtctcacttgttgcccaggctggagtgcagtagtgcgatctcagcttactgcaacctccgcctcccaggttcaagcgattctcctgcctcagcctcccgagtagctgggattacaggcacccgccactatgcccagctcattttttgcatttttagtagagacggggtttcaccatgttggccaggctggtctcgaattcctgaccttgtgattcacccaccttggcctcccaaagtgctgggattacaggcatgaccgactgcacccggctggcctgcatcttctttaggccgttcttgttgtgcttcttggcaaagcacatattcctcaggaatttgggtccatccgcttaagagatttgtatctttgtgattggggtttcttgatgccatttctgtgcagttttcagcctggttgtgtgaggtgtggttcttggatttggccatgtctacaccataacctgtggctcccttcctttgggtttttagagagattgccttatagcagatacatggttggatgttggcagactgttgaccagggggtcttctcattccccacctaagctctttgcagaatgtttccttgctcatcttcaggtatatctgtaaatgatcaaagcatcctgttattttccttgtaagcacctcatatccttcattctttaggcattgtgacccctgagatgttcaagaagatgtccaactcagagatcatccagcacctaacagagcagtttaatgaggtggaagaagatgaccaggatcctcttacccctcttatttcaaaacacaatgcctattatccccttctttttgattctgtgaaatagggtagcttttagaaggaggaattcagtctcttgggggtaaaagagatctgaatatgcctctcaaattggggagaataccaggaaatgaggtataacagatatttttactggactgttgagttttgacatccaagcccctatgacttcatggacctggtaataactttcccatccttttcatacatccttttgtaggactcgggggactaccctctcatagctccaggtccatcctggaagaagttccagggcagcttctgtgaatttgtgaggacattggtctgtcagtgccagtacagcctcctctatgatggcttccctatggacgacctcatctccctgctcactggcctctcagactcacaagtccgcgccttccgtcacactagcaccctggctggtgagcattcatttttactctggacattctcctggggatttataggactttcctctgttctctgattcaggatcttctttcctacctgcatcttggctcttcacttcaaggccatgcctcttttatcctaaacttcaatccagtttctcactagtggagttttgagaaggggtagatcacagcaacaatttccaggtttaatatttttgtcagagctcaccactaggggtatgctgatggttaaaagaagaccacaagggttcgagggaaacagtccactccaggacaggccgtcttaggattttagggtcatcctgctctgacgtctcattttcattgcccttctttccttctattttttccttctactcatcctctctcctctgacctcagtaatgatttctttatctctttttcctttctcaaagctatgaaactgatgacctccctggtaaaagttgccctccaactgagtgtgcaccaagataacaatcagcgtcagtatgaggctgaaagaaacaaggggccagggcagagggcacctgagcggctggagagcctgttggagaaacgcaaagaggtgaggagtgttccctgcttcttccttccctttttcccaacttgcacccacttctgccacagacccccttatcaggccctgggcagtctttcaagatcatgaataatggagtctggcaatagtttcatagacccatcctgtaaggggtcattacatgctcatcttgtttctgggttgtgggctcaacaaataatgtgtaatttagagttctctctaattccacttttgctcagtttttttttttttgtcagcactcattgttaggagtgtttaagtgctgtacctgcctgtcatgcagggaattaagttttgacctacttgtcaagtgtgcagtgtgcaagtgagtgcaggagtactaaaagccaaccattgacaagggaggccaaattttcaaggaatggaaagaaaacaggcctcccagtgaactcgctttaaattctgttgaatttagtcactagctccatagccttatgtaacctctcttcagttttcttttctttaaaaaaaggaataatctcacctttttgtgaagaataaatgagatgagtaaattgcctcgcttggctcatagtagatacttgttttgtttccttttaaacttaaagatgaccactggggggcataagccatagcaaaatcttttacgctgatgaaatctttaatcagctgggtctgtcataagagtaacactactggtgttttctcctcactctctgttagtgtctaagacccctcctatgaggttggcaggactcaccatgtctgaccatatcatttggctgtttctctagccctcacaaaagatctcttccattctaaatcactagagaaggaaactttccacttcccttattctcttttgttattttgcattgtcaggttgatcttaaaagcttgaatattaatctatcccggattttaaattatgtacactagtgcgaatcttttcttttctttttcttttttggcttctctgggctcttgcttaatcaattatcattataattcccccattttatcctaaatttcttcctccccactattttcttctctccacttataaatgtatataggctcttgaatctttatttcactctgctcctttgtgagttactcttttttccatccttccttttaggatagtatttccttacttccttaatgtccaactaactgaatcctttttgctacctagcttatttccccattttctttgaaactgttctttctaaaccaatgacttcctaattcctaaagccagtagccttttctcagtctccctttcccaaatattttacatatttgctttacctatttttgctattttagtgtaaaatatggacatataggtacttcagccctaaagacttaagtatgtcctgtcgaaaatgatatgttgttcttacataattgaagaggtggggcctgttgtcttaaaggatgttccctttctccttataattctgtttccttggtgtctattgttcatgtgatccaggatttttcaataatggcactatggacgttgcggggctgtcctgccatggtaggatgtttagcagatctctggcctttatctactagatagataccagtagtaccctgctcccccagcaagttgtggcagccaaaaaaatctttagacactgctaaatctcccctggggaacaaaattagcctcagttgagaaccactgatctaattcctttcttctcatttttgctagttccacttctattaaactgcaacttactaaaaatttgttttccaaattgttagaaacatatacgggcatcatacctcaaagatattgcagattcaattccagaccaccataataaagtgaatattgaagtacagtgagtcacacaatcaaaaaatcaaaatttttaattctcagtgcatatgaaagttgtgtttacactgtagtctgttaagtgtgcaagactattgtctaaaaagcagtgtatgtaccttaatttagaaatattttattgctaaaaaatgctaatgacaatctgaacctttagcgagttaaatctttttgttggtggagggtcttgcctccatgttgatggctgctgactgatcagggtagtggttgctgaaggttagggtggctgtagcaatttcttgaaataagacaacagtgaagtttgctgcatctactgactcttccttttacaaaaaatttctctgtaacatgaaatgctgtttgatgacattttacccacagtagaaattctttcaaaacaagagtcaattctctcaagccctggtgctgctttatcagctaaatttaggtaatagtctgaatcatttgttgtcatttcaacagtattcacaacctcttcaccaggaatagattccatttcaggaaaccactttccttgctcattcataagaagcaattccttatttgttcaaggtcatgaaattgcagcaattcagccacatcttcagtctctacttctagttctcttgctatttccactgcacgtgtagtttacttcctctactgaagtcttaaacctctcaaagtcatccgtgagggttagaatcaacttaactcttgttaatgttgatattttgacctcttcccatgaaccacaaatgttctttatggcatttaaaatggtgaatcccggccaggcacagtggctcacacctgtaatcccagcactttgggaggctgaggcaggtggactacgtgaggtgaggagtttgaaaccagcctggccaacatggcaaaaacccatctctactaaaaatacaaaaattagctaggtgtggtggtgctgcttgtaatcccagctacttgggaggctgaagcaggagaattgcttgaacccaggaggcagaggttgcagtgagccaagattgcgccaccacactctagcctgtgctatggagcaagactccatctcaaaaataaataaaataaaataagataaaatggtgaatccttcccggacggggggttgagtttttctggttttgttttttgttttgaagacagggtctcgctctgttgcctagaccggaatgtactggtgcagtcatggctcactgcagccccaacctcctgtgctcaagtgatgttcctgccttatccttccaagtatctggtactacagattgcataccacatctggctagtttttgttttgtttctgtagagacagggtctcactgtgttgcccaggctagtcttgaactcctgggcttaatcagtcctcccacctcagcctcccaaaaagttgggatagtaggcatgagccaccatgcctaaccccaggaggttttaaatggactttgcccaaatcatcagaggaatcactgtggcagctatagccttatgaaatgtatttctgaaataataagacttgaagttgaaattactccttgtttcatgggctgcaaaatggatgttgtgttagtgggcatgaaaaaagcaacatggatctccttgtacatcttcaccagagctcttgggtgaccaggtgcattgtcattgagcggtaatattttgaaaggaatctttttttctgagcagtaggcctcacccatgtgcttaaaatattcaggaaaccatactgtgaacagatgtgatatcagttaggctttgttgtttcatttatagagcataggaagagtagatttagcataattcttaagggccttaggatttttaaaatggtaaatgagtattggcttcaacttaaagtcagcaactgcattagcccctaacgaggagtcaggctgtccgttgaagctttgaagccaggcattgacttctcctcaatagctgcgaaaatcctagattttccaatataaggcgttttccaattataaggcagtttagtccacattgaaaattcattgtttagtgtagccaccttcatcagtgatcttagctagattttcttgataacttgttgcttctctatcagtatttgctgcttcaccgtgtacttttatgttatggagagggcttctttccttaaacctcacgaactaacttctagcttcaaacttttcttctgtggcttccttactttgctcagccttcatagaatggaaaacagctaggacattgatctggattgggctttggccaaagggaatgttgtggctggtttgatcttctgttcggactactaaaactgtctctgtatcagcaataagactgtttaactttcttaccctttgtgtgttcactggagtagcatttttaatttctttcaagaatttttcttttgcattcataacttggctgtttggcacaagaggcctagctatcgattggcctgtcttggttttcaactaagcttaatcatttcttttttttttttttttttttctttttcagacggagtctcactttgttgcccaggctagagtgcgatggcgtgatcttggctcaccacaacctccatctcctgggttcaagtgattctcctgcctcagcctcctgagtaggtggggttataggtgcccgccaccgcacccagctaattttctgtttttagtagagacggggtttcgccatgttggtcaggctggtctcgaactgacctcaagtgatttgcccaccttggccacccaaagtgctgggattataggtgtgagccactgcacctggcctctaagcttaatcatttctagcttttgatttaaagtgagaaacatgtgactcttcctttcatttggacacttaaaagggttattaattgacctaattacaatatttttgtgtctcaaggaatgaatagggaggcctgaggagagagagagagacagagaaactcttgttggtagagtagtcagaacacagacattgttaagtttgccatcttatatgggcacggtttgtggtaccccaaaacagttacagtagtaacattaggctgggtgtgatggcccatgcctgtaatcccagcactttgggagagtgaggtggaaggatcgcttgagcccaggagttcaagaccagcctgggcaaacatagggagagcccgtctctacaaaaaaaaaaattttttttaactagctgggtgtggcagcatgcatctggactcccagctagttgggaggctgaggcaggaggattgctcgagtccaggaggtggaggctgccgtgagccatggtcacaccactgtactccagcctgggtgccagagtgagaccctgtctcataaaaaaatatgtaacattaaagattactgatcacagataaccataacagataccataatgaaaaggtttgaaatattgtgagaattaccaaaatgtgccacagggacacaaagtgaggatatactattagaaaaatggcactgataggtatgctcaatgcagggttgtcacacacctttagtttgtttaaaaaaaatccacaatgtctgcaaatcaataaagtgcaataaagcgagatacacctgtataatgccagctagggcttctgaatagtccgaataaccacatgcagaggggttattatttttactaaacacaaacctctgaggcattagttgactatacagcttcttccagaattagaaggtttaaaagagagcataggattacgggggttcacactatcctataataaacaggaagtaggtggaagttgtagtttttctgtatcttcagggccttatgcttgttagggtacaagaaagattaacccgtttctccctgtcctccagctccaagagcatcaagaggagattgaggggatgatgaatgccctcttcaggggtgtctttgttcatcggtacaggtgagctaatgggcctctctcattgaagcagctggcctttggttatggaatctgaggaagtgaataaggttttcccccctccaacccttagttatttggttagtcccagaattaatgcagctggagcaaaaattcttgacaacaaatgtttcaaattggtgaggtttagtttatcaccacctacaaaggatcttgtaagtgcttctgggagaaaataagagaataaagcattgctgagtattttcctgctctggctttgccccagatctgccccaactcctcatctttctggggttggagacttgaggataagagcagagaatagaaaggcggggcttttctgagggatgcctgctgcctggtgagccttctcctggcccagcctgctgtctcactgtgcgaagggcaggggagttttatactgtttaatgacctgatcaaattaagttaaaaagaatatatgtaggccgggcgtggtggctcacgcctgtaatcccagcactttgggaggccaaggcaggcagatcacctgaggtcaggagttcacaaccagcctgaccaacatggagaaactccatctctactgaaaatacaaaattagccgggtgtggtggcgcatccctgtaatcccagctgctcaggaggctgaggcaggagaatcgcttgaacccaggaggtggaggttgcggtgagctgagatgacgccattgcactccagcctaggcaacaagagtgaaactccatctcaaaaaaagaaaaaaaagaaaaaaaaaattgtagatgtttctcactcttacctaggtttcacttctgcctctccagagcctttcagctgatgtaaccttttcttaatgtggaattaaaacacactcacacactttggccaacagttgaattaacttttttttttttggcagggacggagtctcactgtgttgcccaggctggagtgcagtggtgcgatctcggctcacggcaagccccaccccccgggtttaggcgattcttctgcctcagcctcccaagtagctgggactacaggcgcccaccaccatgcttggctaatttttggccaccatgcccagcctgaatgaactttcaaaattggtttttaaaagaggtatggagaccgggtgcagtggctcacacctgtaaccccagcactttgggaggccaagacaggcagatcacttgaggtcaggagttcgagaccagcctggccaacatggcaaaaccccgtctctactaaaaatacaaaaaggaagctgggcgtggtggtgcacctgtaatcccagctactcgggaggctgaggcaggagaatcacttgaacccgagaggtagaggttgcagtgagctgagattgtgccgctgcactccagcctgggcaacaggtggagtggagaattaggctgtacaaggctggtgtttaactattttatggtttggtaacagaaagaaaatatttactaactgggtatggcacatttttgtagtcctagctacttgagaggccaaagtgggaagatgacttgaacccaggagttcaaggccagcttgggcaacatagcaagagatcctatcccttaaaaaaaatatttacatgtattttactatatatatagtatttacatcgggaggaagaaatgaaaggcatggggtacatggcatttcaagaaaataaattcttccatgagagggagttatctggtaggatggaaagtgagtttggagagagggtggctctaagagtcaacttatctgtctgtgtctagggatgtccttcctgagatccgtgctatctgcattgaggaaattgggtgttggatgcaaagctacagcacgtctttcctcaccgacagctatttaaaatatattggttggactctgcatgataaggtgggattcgagtcagtttccctttccgtttccttcatctttttcctgtcctaggacatttcaccttttcctgggcctgccactgagatattttacctagtgaccaatgatgaacccatcaaggcgctgaaccttgaaattcccctagcactggggagagtaggataaggtagagagagacatacccaggagatgaaatgactcaaaacctgaggtacggggagagagactttcccatggaagagagttattgatggatggtaatgcaggtgctaaggggcagccaaaggatccttctcatcatgagtactgctgtgatccttttgttttttaagtaagaagacagctgttcattgtttctgacatcttaagagtcctcagtagaggggacacccaagctagaatgagggatcggagaggggagtctggaggcttagtaggggcgagtagagtgtggttagtcttatttccattctcctggttttccctcctcaccagcaccgagaagtccgcctgaagtgtgtgaaggccctgaaagggctgtacggtaaccgggacctgaccacacgcctggagctcttcaccagccgcttcaaggtaaaatgggtggtgctccatggcttggctctttgtcgtggttcctatttccccaccttgtatctttctacccctcatgctctaagatgtcttggctatcccagcatctgcctctacgtaggcactctctttaggagtctctgattctaagagaacagaatgtttggaatgggtgtaatgagatattgagtgactttctcctttctgcaggaccggatggtttccatggtcatggacagagagtatgatgtggcagtggaggctgtcagattactgatacttatccttaagtgagtcctgggaagaggggaggccagtgtctcagacctttgcccttccagggtcatctccctccacctgtcatagctgactcttccatctgtgcaggttgactgaggtcattcctgagttgcagtatgttgagggggtaatatttctgtcttctctaactccccatactcctttgtcttccgctcttcatttagaagttttttgtgagttatgtccttgttgcttttgcctctttttgtttctagccttggttgtgccagaagacaatgtccctattcacatactctttctgcttttctgtgggcaggaacatggaaggggtgctgacggacgcggattgtgagagcgtctacccagttgtgtatgcctctcatcgaggcctggcctctgccgcaggcgaatttctgtactggaagtgagtggggctccttttatgtttctttaacaccacgctctcggtttctctcctccatctgctgctgccctacctaaggcttccccatctctgtgaaagtctccctggtgtctcctttcttctcgcagctccttggggctttccttagctctcacctccttttcctttatcatctccttgggccatctcctccctctgtggtcgttacacctccttgtttcctgttgtgctgagccctttcctcgtgtccattccaccagactcttctaccctgagtgcgagataagaatgatgggtggaagagagcaacgccagagcccaggcgcccagaggactttcttccagcttctgctgtccttctttgtggagagcgaggtgacatacacagagagaagtctggctgttgtgcataggacctacaagtgggctggggttggtggctcacgcctgtaagcccagcactttgggaggctgaggtgggaggatcctttgagcccaggagtttgagaccagcctgggcaacacagtgagaccctgtctctatcgaaaaaaaaaaaaagacaaatggagaaggatgggagtggacactgtaggaaggagagcgatatttaatcagtaaccacttcgtagggtatttttaacatgctatcattaactccccatgcacgttctcccctagctccatgaccacgctgcttacttagtagacagtctgtgggactgtgcaggggctcggctgaaggactgggagggtctgacaagcctgctgctggagaaggaccagagtacgtgtcacacggagccagggacagggaccttccaccccctagggtgaaactgggagggattgcttgcttcacttgtacaaggcagcaacggtggcatcgggtggggggagcttggagttggaaggtggctaatctttgattctatgtttttgatcctcctggcactccagacctgggtgatgtgcaggagagcacactgatagaaatccttgtgtccagtgcccggcaagcttcagaggggcacccgcctgtgggccgggtcactgggaggaaggtatggtgtgagggtagagtgggtaggtcagcaatactcagtcttgacaggcaatgtgcatccttatcccccaggctggggttagggtgctccttctaccctttaaagaatttcatttccagaaaaaagggccaggcgcagtggcttacgcctataatcccagcactttgggaggctgaggcaggcagatcacgaggtcaggagatcgagaccatcctggctgacacagtgaaaccctgtctctactaaaaatacaaaaaaaaaaaaaaaaattagctgggcgtggtagcgggcacctgtagtcccagctacttgggaggctgaggcaggagaatggcgtgaacctgggaggtggagcttgcagtgagccaagatcacgccactgcactccagcctgggtgacagagcgagactccgtctcaaaaaaaaaaaaaaaaaggagtttcatttccagaaaaaagaaatctcgtgggagctactgagttctcttttccttctaggcagataaggtcatggggaggaggactgcacacaccccctgcaccagtgtttctttacacctcccccacccccaagtgactctcattccagggcttaacctctaaggagcgcaagacccaagccgatgacagggtgaagttgactgagcacctcatccccctgctgccccagctcctggccaaggtaccgctgcccctccactctgcatcacaccaagagaagtgaaaggaaatggcctctgtgggggtgggagtaggaattagcaatgtgtcagcttgtaaggaggcctccctgtcaatcatcacagttctcagctgatgcagagaaggtcactcccctgctccagcttctcagctgctttgacctccacatctactgcactgggcgcttggagaaggtagggagatagatttcctataccttgctgcttgcctgccagggccaaagggttctattgccagtatctttttttcctaagaacttgggttccagaaaaatcagcaagccttttcttaggcatcttatccttgaagtttaatgcttttaaccccgttccacttcccgccagaagagtgtcctcctcccatccccacagcacaccatcttctgccttttcttctcagcacctggagctgttcctgcagcaactccaggaggtggtggtgaagcatgcagagccagcggtgcttgaggctggggcgcatgccctctacctgctctgtaatcccgaattcactttcttcagccgggcggactttgcccgcagccagctagtagatttgctgactgaccgcttccagcaggagcttgaagagctgttacaggtaggagctggggctggacaatgggacaccccaaacaagggtgggaggggctgcaagacgggggatgtggactgatgagttctgggggaaatgctattgtggatcttctttccttctcagtcgtccttcctagatgaggatgaggtatataatctggcagccactctgaaacgcctctctgccttctacaagtgagtggctttcctcctcttccccatcccgtttttactggtgtctgtggagttggttccctctgttcttttccagtataacattcccctttctcccccaaagcactcatgacctgactcgctgggagctctatgagccatgttgccaactcctgcagaaggctgtggacacaggagaggttcctcaccaggtgagtggacaggctagagatgggttgggggctggggggctagattttaaggacctacgttctaggtggccactaggtgtgtcaagtctcagtgcgtggagtggacaaagcgaggaagatcaggtgggtgggggtcacctcttacattcctctcttagaaggtggactctacttccagggtcttcttggatttcctggaagccaaggataatattgagggattctagaagacgtagagtaaattagggagcggtgacatttctacttcgtgtagatgcctctgaagaatgtccagaatatcactcattttccactggaaaaggaattagctctccctttactcattttctctcctcttcactggtgtgtttctggctatctgtctctccctctcctaacccaaacctcatttttcaaaccctttgttgttacaggttatcctgccagccttgactcttgtctatttttccattctctggacactaacccacatttctaaatcagatgcttcccaggtgagtgtgggtcttagatgggataatgggaacagaggagtctgtgtcttcattcttccccttcaagccactgtgcccacagaagcagctgtcgagtttgagggacagaatggtggccttctgtgaactctgccagagttgcctctcagatgtggatactgagatccaggagcaggtgagtactgactcaagtgggagcaacaaggcgagtatccctgcccccattccaaggagaaattgacagtgtcatttctaccttgggaaacattctgtccttttaaacatcctttcttttccccctacaggcttttgtcttattaagtgatctacttctcatctttagccctcagatgattgttgggggccgtgatttccttaggccacttgtcttttttcctgaagctactctccagtctgagctagccagcttcctcatggaccacgtcttcatccagccgggagacctgggcagtggtgcagtgactctatacctggggctcagtaagggctggggcttgggtgtagctcagaaatatagggcaggaagcttaagtctgtgattcccttttgccttccatgtgagccaggtgattcccaggaggatcatttacagatagagcggctacaccagcggcgccgcctcctagccgggttctgcaagctgttgctttatggggtgctggagatggatgcagcctcagatgttttcaaacactacaacaaggtacaccaaggccctacagaaataaaagagaagggagcaagttgagcacagccatgacttggaaacataatagcactacaggtgggggatatccaatggtttcaagcttaaaggagaagtaggagggaaaggcactgggagttcagaataaggggacaaagaaaagagacttaatagtaaataattatggagaaaaagctgtgaagaaattcactggaggggaaatagcttattcttcctgtccagaaatatttatttttctctgaccccagtctatggaatggggtaacataagaaggaaaaaagaataaaagagggatcagtcctcacaggatacctagataggtgccccagtttcctcaacccaccagtattgatttatgcttattgagcacctgctgtgtgccaagcaccattccaggagctaaggccacagcagtgaacaaaacacacaagttcctatttggtggagcttccattgtagttggggagagacaaatagtgaaggtgtcagtgctgtgtgagagggcactgtcaggcttacttctcttctccaagaattgggcttggggcagtgtttatttcttttcttttctttttttttttttttcctgagacagattctagctctgtcgccaggctagaatgcaatggcactatctcggctcactgcaacctctgcctcccggggttcaagcagttctcctgcctcagcctcccaagtagctgggattacaggcatgcgctgccacgcccagctaatttttatagttttagtaaagacagggtttcaccatcgccaggatggtcttgatctcctgaccttgtgatccgcccaacttggcctcccaaactgctgggattataggcgtgagccaccatgcctggcctgtttcattatttgttttttattttatttatttatttatttatttattttttgagacggaatctcgctctgtcgcccaggctggagtgcagtggcgtgatctcggctcactacaaggtccggctcctgggttcacgccattctcctgcctcagcctcccgagtagctgggactacaggcacccaccaccacgcccggctaattttttgtatttttagtagagacggggtttcaccgtattagccaggatggtctcgatctcctgacctcgtgatccacccgtcttggcctcccaaagtgctgggattacaggtgtgagccactgcacccggccttattatttgtttaccgaaactctgatttattttgggctttgcacctgttgattagagatgaagtctagtctgaattattttatgcttcagttcatgtttcctacctaagggagtttgggagggagacatgattagggatgtgaaggaagaaaccaaatggtcttttccaccagtcagacattaccttccccactctttcccctcagttctacaatgactatggtgacattatcaaggaaacattaactagagcaaggcagattgaccgaagtcattgttcccgaatcctgctgctgagcctcaagcaggtgcgcccttctgccttgaggacatgccagccctgttgtccccaagtctctgtctaccctcagccactcagaatgtaagatccttcagagcagtaacttttcttgttttgactcttaactttacgtgataggttccttcattcttagtagacccttgggaagtattttttttttaactgactgggcaaccccatcaaaagtaacttatcaggacattggaacgccaacaaggaagtgatagggagttcctaattatttttcagtctgttctctctcagcctccttcagttactatagacgtttttatttaatgttatggagtagaggtgattggctttgtttgctgcaggggtatcgggagttccctagaaggaaggaaagagtaaaagtagtagatggtgtcccaaggcctttggaatttctgagtagagaagagaatgctggacttctctgtttccgccgtgttcctccctttcccacatgcaccatgtctcctggacacagctgtacacagaactgctgcaggagcatgggccccagggcctgaatgagcttcctgccttcatcgagatgagggacctggcccggaggtttgccttgagttttggaccccagcagctgcagaaccgtgacctcgtggtcatgctacacaagtaggaagtattggttgcaggttgtgtccagggagggctgggaacgaggtcttggagggaggtctcggagggagggtatgtgtgtcaaggcatagcagtcaggttaggggtgggtatgcctttggagacaagctggggacggggggagggtgcatttggacaggatagctcaggcctgggagggaagtgggaagagactttcttcctaaaataattctgcccaaccaagggaaggcatccagttctccttgtctgagcttcctccagctggctcctccaatcagcctccaaatctggcattcctggagctcctttcagagttttccccccgactcttccatcaggacaagcagcttttgtaagttggtgggtggatagagatgtggattagggaagggcctgctgagggcccagtagccccttcaggcttttggttctacctctttcatagactgtcctatctagaaaagtgcctgcagcatgtctcccaggcacctggccatccctggggcccagtcaccacctactgccactccctcagccctgtggagaacacagcagagaccagccctcaggtcctccccagctccaagaggaggcgcgttgaaggtagggtgctgtgtgtgggtatgggggtgcccagcaggtggtcgttggctgcctgcaaacttattttgtcaagtatttcattgagcatctactgtcattcagggtattaatttctttcaaggtttatctagtcaactgaaaacctgtattaaaaatcaaatagagggccaggtgtggtggctcatgcctgcaatcccagcactttgggaggccgaggcaggcggctcacgaggtcaggtgttcgagaccagcctggccaagatggtgaaaccccgtctctactaaaaatacaaaaattagctgggcatggtggcgcgcatctgtaatcccaactactcaggaggctgaggcaggagaatcacttgaacccgggaggcggaggttgccgtgagctgagattgcgcgactgcaccccagcctgggtgacagagcgagactctgtctcaaaaaaaaaaaaaagaaactgatgataaaaccaaatattgaactaagaaatctatacattcagagtaccctcctcaacatcttgtattccattattttcgaaaccttggacacttttacacaaccttcattgttttttaccttcagatcacctgttgtcttataagttgcctaaggttttgtttttgtttttgtttattttttgagatggagtcttgctctgttgcccaggctggagtgcagtggcgccatctcggctcactgcaagctctgcctcccaggttcacgccattctcctgcctcagcctcccgagtagctgggactacaggcacccgccaccacgcctggctaattttttttgaatttttggtagagatgggttttcagcatgttagccaggatggtcttgatctcctgacctcatgatctgcctgcctcagcctcccaaagtgctgggattacaggtgtgagccactgtgcctggctgcctaaggttttttctttgctttttaaaaaacagcttcatattaagcaacattgtagcaatcattatttcatatgcaagtatgtgttttctagtgtacatttttaaatgggactttatgtgacagctttattgagatacaacttacatatcataaaaatcatttttttttttttgagacggaatctcgctctgtcacccaggctggagtccagtggcgtgatctcgactcactgcaacctccgcctcccacgttcaagtggttctcctccctcagcctcctgagtagttgggattacaggcgtccaccaccacccccagccaatttttgtatttctagtagagacagggtttcaccatgttggccaggctggtctcaaactcctgaccttgtgatctgcccacctcagcctcccaaagtgctcccaaagtgctggtgagcccccgtgcccagccaaaaatcacccttttaaagtgtacacttagcatattcactgaattgtacaaccatcacaactatctaattttagaacattttcatctttccaaaagaaaccacatacccattcgcagtctctgcccatcttcccagccttaggtagtatcactaatataattcctatctcttgatttgcctactctggacctttcatataaatggaatcatataatatgtggccttttatgtccagcttctttcacttagtacagtgttttcaacgttcatccatactttgacatatatcagtatctcatacctttttatggccgaaacaatatgccatcgtgtggatatgccacattctacttatccacttgtcagttgattgacatttgggctcttttatgcataatgctgctaaacatgcatgtacacatttttgggtggatgcatcttttcagttatcttgagatatacctgggagtggaattgctggttcgtatggcaattctatgtttaagtttttgaggaactaccacactgttttccaaagtacctacaccagtttacaatcctaccagcaatgtatggggactctggtttctccatgttgtcaccggtacttattaatgtctttttttattttatccatctcctagtagctgtgaggtgtggtatctcattgtggtttaaatttgcatttccctaatgacaaatggtattgagcatcttttcatgtgcttattgacaatttgtttatcttctttggagaaatgcctgttctgatcctttagctattttaaaatagggttgtctttttattgttgagttgtaagtattctttatatattctagacatgagattccttatgatatgcaaacattttctcccattttttgggttgtcttttcgtgttattggtggtgtcctttgaaacacaaaagttcttgaatttggtgaaatctaactttttccttttgttgcttgtgcttttggtgccatatcttgagaaattgttggctaattcatgaggtcacaaagatttactcctgtgttttcttctaagagttatagttttagccgggcatggtggctcacgcctgtaatcccagcactttgggaggccgaggcgggcggatcacgaggtcaggagattgagaccatcctggctaacacggtgaaaccccgtctctactaaaaatacaaaaaattagccaggcatgatggtgggcgcctgtagtcccagccactcgggaggctgaggcaggagaatggcgtgaacccgggaggcggagcttgcagtgagccgagattgttccactgcactccaacctgggcgaaagagcgagatactgtctcagaaaaaaaaaaaaagttatagttttagctcttaatttagatttgtgatccagtttgagttaatttttgtatatagtgtgagatgaggtgtgatttccttttgttgtcttctgtgtaccacctaaaattatgtcttataccaccaggaaactctgctttaattaattaactaatacatagttgttagggacctactatatgaaagatactatgttcagtgttttaggggccatgaagaatccagcagcttattatctaataggaaagggagaaattttaattatggaaaactcgaattatgaacaattgccaataactgcctgagggcttgtacaagtgaatgctgtagaattcagagaatgatgagagctttaccaagaagatggaattgctggagcttaaaaaataagtaagatttttataagctgaacagaggaaggaggagcatcatgggctggcagaatagcacaagcaaagcatagaaggctgtgtgctgggcgaagcatggaggtacatagatcgctctgcctaaagcgtagggtttgtgaaggcaagataaaactgaagagtttgtttttattcattcaatagatactgagcaccgtgtgctgggaatacagcagtgaacaaaaaagctaaacatctctttctttagagagtgtcagatagtagtaaatactatggcaaaaaagcagggaggattgtgaggaatgctggcggggtggggattgcagtcttacaaagactgatcaagggaagactcaacacaaatgttgggcaaaaagcctaaaaaataagttaaaagatacacttaggcacattacaattttaacaggtttatttgagcattcagcaattttatcaatcaggcagtggcagaccgccagcagttcagggcgccaccaccgaggaaaccagaggggacacttacaaggtgtctctgggagcaagacaaagaaactatttgattggttagagtggaaagttcatatttagaggttaactgaccataaatctcttgttagaggttagtcggtagtttctgactggttaagctgaagtttcctgctcctaggttacacacaacactttcactctgagttgagtttcagtttgctgacttaggaacccaaagtgcaggagccatttcagcctattggcctcccagcgaattttttataacaggtgagggagggtgcttagtgtgtatcagaatagcataccaaaggaagcagccagtcctgaggccacgaggggatggggggaatgttcctggaatgttcaaggaacagcagagaagaccattatggccagaatgcagattgtaggacatgagaccaaagagggtacaggatcccagagcatctaaggcagagactggcttttactctgagtgcagtaggaaaaccattggaggattttgaggaacgacaggatcaacctctgtttttaaaggatccttctggctgctgtgtcgaaaacgacaggagatgggggaaggctagaagctgggagaccagcagggaggttgtggctgttgtaggagtccagcccaagatgcaagataagagagcttcttaggccgggggcaatggtggaggtgccgagaaacggccagattctgggtgcattttcaaggtatctctaataggcttttctgacaaactggatgtgggatgtaagacaaaaagagcagttgaggatggctccaaggattttggcctgacagaaggatggagttgacagtatctgagatggggaaggcagagagtgaagatagctgtgggggaaggttggggcattggtgttggccacaggattacaggtggagatgttgaacaaaccatgggggctgttaagatggagttcaggggagagctgaaggcttgagatccctttgggatgtggcagagtataggtgatatttaaggacatgaacgtgagtggctggggaagccagtgaagatggagaagaggagagactcaagggcccagccctcgggcatcacaccattaatagctcagggagatcaggaggacacatctggggccccaaggtttcctctctgggaatccaagcccaggggtatgtctcttccctgttttctgtagccctctgcttaaacccataggctgagcgctcactttgggattattgtttttagtggagaaggggggtaatgggagtgtgactgtttacagttaacagatgttaatgtcaatttgactgatgctttaaaatagtattgcctgggttttctcaggcagtgagaatctttggattctttctcctcctctaccttctccaatctctgcaggagataagtcccccttcatatcatatcagttatactggcattgcaatcacttcatttttttctagcttttagaaaatcctgtctcccattttccggttcctccctggccctcatttgtccactctagcctctggtaccaaaactctattgccatttacagctttttctgaccacagaaatcttggataggatctcagatgtcttcattggctaactcagacctctcaatcttagagactccaaccctccctcatgtttgtgttcacctgttcacctgttacagtttatctgtgaaatgtatatttatatatctttccatcttgttttctaggctgtgtagcaagttcttcttggacaaggcctagctacaattctctaagccttactttttggtacatagggctatgtatttagtacatagggctatgcccatttgagggcaacagaatgaagctgtataagttttccattctcttcctgattgactttcccttactaaatcctgggcaggtcttggaaagagagcacacctgtcgcaggccctgggctgtggttaatgtatgcatctgcttggcagggcctgccaagcctaacagagaggacgtctcctcgtcccaggaagaaagtctgcagctgaacagcatcccgcccacgcccaccctcacctccacagctgtgaagagcaggcagcccctgtgggggttgaaagagatggaggaagaagatggctcagagttggattttgcccaggggtgaggccatggagggaatctgggtgtctgagttcccagtttggtgtctggctgcctccatcttgctgtttctgtttcatggttccctgctgtagcactcccacattgttgggttcttctcaaacccttctccattgtttagctttaaaatgcatctctctgagcttttctccccattaacaccagctgccttacatcctcttcttacccttgatttttatcccatcattgatcctgcttcattcccagcagtcagcccgtcgcaggcaccgagaggtcaaggttcttgggtccacaatatttccagactccacacaacccttcaggtcctggcctgggcaaccagctgatgcggtgagcttttctcatcatctcctgtcttcacttcagatctgtcgcccactgtgaggggattcctgtctcacccattgcctctctgtgggtgctttttggacttgttttagccacagagcacttcctgtcagcacaatcgggaaactactatgctgtacttactgctccccacttcccccaccccgggtgtctgagaaactctcaggggtcctcaaagaacagtttgaaaagccagtctctttgcccctacatcagactcagccttatggaagaggacgaggaagaagagttagaaatccaggatgagtcaaatgaagaacggcaggatacagacatggtgagtagaccaccctgcccttctctctcaagaactaggggctgatgtgccaaagagaagccagggtgtttcccctctctccgctcggtgatgcctggtctggaaaagctgaatgaatctagagtaaaggaggacaggttatatgttggtttggactttgcttggactctacttttattaaagaataaggaaaagaaattacaaataccaaagaaggttggaatagcactctcgctcccaatccctaaataaatattgttgcctccgaaccccctaggaattggaaggagtcctaatgctggaggtgggaggtcattcagtccaagtggcagccccttcagtgtctctccccacaaaacatgaccccctatcctccatctccctactagagggcttcccctccctgtcccttccctcactccctttctaacctagcctgtttccccaggaggaactgctgctggtgtagtgggaaaagcctggcatttggagtgaggtgacatgagtgctagtcctcaactccatgtcaagttagcgcttttacccctcctcagcctccattttctcatctttattttttaattatttttattttttgaggtagagtctctctttgtcacctaggctggagtgcagtggcatagtctcggctcactgcaacctctgcctcctgggctcaagcaattctcctgcctcagactcccaagtagctgggattacaggcacgcgccatcatgcccggctaattttttttgtatttttagtagagacggggttttgccatgttggccaggctaatctcgaacacctgacctcaagtggctccacctggctcagcctccctaagtgctgggattacaggtgtgagccactgcgtggggcccattttctcatctttaaaacagagctgttagcctgtagttccagcaactcgggaggtggagacaggaggatcaatagtccaggagttggagtccagcctgggtaacatagtaaacacgtgtctcttaaaaaaaaatcaacaattcaaaaataaataaaatggaccttttacataaaatataaggtaaaaccaccttataaatggaaaagggctatgtctgagttcaggctactgtaacagaattccatagactggtgtcttacaaacagcaggtatgtatttctcacagttctggaggctgaagtccaagggttgggttctggtgagggccttcttccagcctgtagactgctggcttctagttgtatcctcacctggaggagaaacagcaagctagccctctggcctgggcttagaagggcattcatccatccatgagggctgcacccctatgacccaatcacctcccaaaggccccacttccaaacagcatcacactgggggaaggatttcaatatgtgggtttagggggacacagatattcagtccattacaggctgcgtatcttctgctgttattcttctgttctcttctctgcagggaaggaaaaagaacagaatagaacagaacaggggagtcttgtgctcagaaggagaaaccaaacaatgataccttcaaaccagagactagagagcaaggcctctgttaaaatattatttcctaacatctcagaaaaaatccgttttctggtttccaaaacaaagtcatttaaggggctcagtcagcaggccaagaagcgctctgcagtcaggcctgatcctggtgcccacactgacttccctcccaggaggtgccataggggcctgctgtgcccatatttgttcttatgaggctgggaaaggaactggtttttttatttgcgaagtgacaggagtgtgtaaaggcctttttgacttttaacctcattctctctagcaagcaagtagctactcttccaccagtgagcgcgggctggacctcttagattctacagagctggatattgaggtgagtgtccccagagcaggagttatgtatccttcggaaatgctggcaggcaacccgtgcactcatcaaattgacaggccatagcctgggggtggccctctgggctgtctctggggctttgagggtaacccaggggaggatggtctgcccattggcccgttgctgtgtcctgtgtattcctttcatctttctcattataggatttctgacaggactctgggcccctccccagctccactccctacctcaagaatgtgaccatttggaaaaggcaaagagaaaaggagcaaaatgaagcattcccccaggcttcagccctgggctctgaggggaaagagttgggcattgtttttctaacctaacctttccctctggggtagagaagccgagagaccctgtcctccctaatgcactgtggcccagtccccttgcctttttcctgttctgtttggagtggagaagggcagcacctctgtgtttaatggaaatagcccatagtctcctggatttttggaacatctttctcagcctattttgtgtcctaatgattcgctcaataaacatgtttgaatccacacgttcccaaggtgtggcttgagatcgttaaactgatggaggtcaggttcttggtccgccttgtcccatggcccagcatatagatgtccccacaccctgcaggtgctttgtctacaggctctccaggaagtattgcttagtaactgagaggtggggtgaggcagtagagatggggagagtttgactgcctgtgagtagtttatctagtggccacagcctctgcagtagtaaaagttgtgctgacaggtggcagagtggagcaggaccttgtgaagctacctgtctcacccatgtgagccaggccaggccatgtgtcctggcagccttcacccacgggttctttccaaaggaaattttatcctcatcccaaagatacctgtcataatttggaatttgatcaaatcacagtatctgagagttaaaaggaaactaaggagttactctaaatgtccaaccctaaaatccaagtgacaatgtcaccttcactcttgccttctccagctagttcttcaccaaattctgtcaagacttggtgaagaaaattctctggcctatgtcctccacacattgtcaccatcgtctctcacctagactgccacagtgcagcctcagggccagcctcttgaaactcagacagacttgtttgctcttgttttgccttgtggagcagcacagcacctctgttctctcttgtccctctgacaagcagtatttgaagacggctgttgtcattttgtactttcactgttttcttctgtggtttaaggaatgcttcagcctctctctttagataaaatttccagttcttcccatcatgggcacctgctttagtgacaggttctcactgtggtctcctaggtcagacacagccatccagctagtgatgtgtgcagaaaaagccgtgactccctgcaatcaggtcactcatccaagaccacctcgcccctttcattctccctccccgcccccacctgcccctcccagatgaaagctataagaaattgggttgagtctccttttggaaaggtagccctcggggagtcagagctggggtgtgggggaaggctaactcattgagcgatctttcgcctgtattcaggtagaatagttctggggaaaggagcctgttttgtgggatgagggaacagagtgggagaactgaggagaagatgtggaggtctctcaaaatccaggaggggaaagattcctgaattatttaaatactaaccaagctaagggtgcttcacaagaggataagagcagcttgggggctttgcatcaatatggacacctgtgtacagccaggcagcccagtgcactgggttgagtcacagccttagaatctgggagcttgacaccatgctctctaaagcctttgacactgtttattgagaggctgggtctaggttgtctcctcttgaatatgggctttgtgatgcttgactaatagaagatgatagaaatgatgccatgctagttagtgggcccagattttaaggaaactggcagtttccgtttcctgtctcttcctgtacctgggttcacacttggaacccggtcaccattctgtgagcaaggccagcagccaaaggaaaaggccacgtgtaggtgttcctgccagcagtcctcaccgaggtcccagccaacatccatgttggctgccagattcagtccagatgggagtcagatgattccaaccttccctgtttttcagttttcccagctgaggtccagggatcagggagcagagacagcccatcttttctgtgcactttccaaattcctgatcgtggagcccatgagcatagtaagatgtaaagcactcagtctggaggggtttgttatgtagccatagcaaccggaacagggccttaagagtcataagactcccaacttttggacatttgtatcagttttttaaaaaattgtaagttatataaacatatactaattcttctatattatacacatttaaaatgtaacatgagttgacgaaataagtgttttaaaatatttcattggttaacactgcaaaatgcctttttgctcttaaaaaagggcttagagcaaagtgagaaacattttttaaaatcatggttcaacattttctgaagttcagttgaaagttcagtttagggctgggtgcggtggctcaggcctgtaatcccagcactttgggaggccaaggcgggcagatcacgaggtcaagagattgagaccatcctggccaacatggtgaaaccccgtctctactaaaaatacaacaaaattagctgggtgtggtggcatgagcctgtagtcccagctactcgggaggctgagacaggagaatcgcttgaatttgggagatggaggttgcagtgagccgacccagcaagactccgtttcaaaaaaaaaaaaaagttcaatttattctgatacttttaatgaccttcataactgccaggagtacctctcaaaaacaggcaaatcaagtggattaggtgcctctttgcagttaccgctttttaaatagatccaaacccgctgaaaatcttcatctagaagacttgtgaacaggtcagaggatgatttcccggcacagacaacagtgctctcatgaggacaggcattgtctgggagcacaaaacctgaagtgtgtgagctgcagtgtgtggtgatgggctgggggtttgcctctcttccctcacaatactgatcgtattccaagggaatcatgacttacaatgtttttatctacacttgatcttggccaaaaggccaagaagcgatactgtctttttgtcttaaaaggttagaatgtttctttatttctactgcacaacatctgtggatacttttttgtgcacgccctcaccctgacaggctcagctgtgaagggttcatgccagcaagccccctgctggccgtccaggacagcccagggctctggcttctcagcagcacctcccactggccaggcccaggccaggctggacgagctgaggccagcttaggtagcaggcatggaggcctttgcccagcctggtaagtgatgcagagcagtgcttttcaggggtggcactgtagatgtccagccctactaggtctgtgggtttttctcctcctgtgcggagatgagagatggtagaaatgaagacacaagacaaagagatagaagaaaagacagctgggcccgggggaccactaccacctagacgcggagaccagtagtggccctgaatgcctgaccgcgctgctatttatggtattcaaggcaaagggggcagggtaaggagtgcgagtcatctctatcgatagataaggtcacatgagtcacgtgtccaccagacaggggtctttaccttttaggtagccgaggcggagagagagaggacagcttacatcattacttcttctatgctcttctcagaaagatcaaagactaatactttcactaattctgctactgccatctagaaggtggagccaggtgtacagagcggaacatgaaagtgaaacaggagggtgactgctgaagcacagcatcacagggagacggttaggcctccggatggctgtgggcgggcctgactgatgtcaggccttccacaagaggtggtggagcagcgtcttctctaactcccccagggaaagggagtctccctttcccggtctgctaagtaacagttatcttcccaggcactggcaccactgctagaccaaggtctgctaagtaacgggtgccttcccaggcactggcattaccactagaccagggagccctctagtggccctgtccgggcatgacagagggttcacactcctgccttctggtcacttctcagcatgtcccttcagctcctatctctgtatggcctggtttttcctaggttataattgtagaacaaagattattataatattggaataaagagttatgctataaactaatgattagtaatatatataatcatagctataatctatttctagtataactattcttattctatgtattttctttattatactggaacagcttgtgccctcggtctcttgccttggcagctgggtggcttgcctcccacatggcactgctgggcattgtctgttaatattgaataattgttttaagattattttcaataaggctttaccttttttaacttgcactgtggccatgagctctgctggaagtgacttgttggtgttatctcctcagttataaagtgaagggatttttctttttcagattactgagagtcttccgttactaggtaagtcaccgcatccttataactccaggtgacactgactggggtttatgggatgaaagaggagtgtgtgcttggatgatggggtgtgatagtgaaggggtgaaaggtttcttctcacacatagacatcgtgaggtcttccttgagctctttagagccttccctcgggataggatgaaatactgagatcctagaaaggattcacaaaacgtgtcactcatcagcgcagattcaccgattcacccctagatgtgtgtgggatttggatggcagagagaaacaggcactgaagatttttggtcaggacagggcagagaaataagaagagttgaaaattcaccaaaggatagataaacccagggcgtttagagaaaacctgtagtgtgcaaaggagcccagaatcctggggcaacttggagggaaatatacttaatttgattcactaagttaggcccagtgaagggattgggtggcataggtagaagccgaaaaataaagtatcttgtattgctggagtagcctctgtttctgaggtcacatccaaacttagcgaggcagcttaacctggtgagagacatgggttcaactcctggcttctgcactgctagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggtgcgttcagggtagatcaggaggtatgagtgggtagtgggcgagccaggctgggggttgtgggggaggcctgcattgcaggtgtaagcgtgggacccacatcagattggtagtgggtcatgcatgctgggctggctctcaggtcctccctgctggcttcccactcccaggggctttctcctccgattccttagctgggtgaggggcgggacagagccctttcttagggaagcccggcaccccttgctgtccagggaaggggagtccttctagcccctgacagcttctctgcccctcccctggcctccccaggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcgggtgagtgccggcaccagagaggggcaggggctgcagggagggtgatgtaggacaacagcccaccgaccttgctgctgttccacagggaccccggaggtgtgggttcaagttcggatggaggccaccgagctctcgtccttcaccatccgttgtgggttcctggggtctggctccatctccctggtgactgtgagctgggggggccccaacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggcgaggggtccaggagggcagggaggggctcgggaactggccacccatctgattcttgtctccgtgcccagggctctctgccccgccgactcctgcccccattctgcgggcagacctggccgggatcttgggggtctcaggagtcctcctctttggctgtgtctacctccttcatctgctgcgccgacataagcaccggtgagacctggtccctgtccacgtccccctgacactgggatggccacatgccctgcagagctctgaccatccttgctctctcccagccctgcccctaggctccagccgtcccgcaccagcccccaggcaccgagagcacgagcatgggtgaggaggggacctgctttggggatgaggtgacaggggcaggggcaggggggccagggctgggcccaagctgtgcagactcacttgaccctccttcccccgcgcaggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcacccccttactttaattcttgggcctccaataagtgtcccataggtgtctggccaggcccacctgctgcggatgtggtctctgtgtgtgcgtgtgtgggcacaggtgtgagtgtgtgagtgacagttaccccatttcagtcatttcctgctgcaactaagtcagcaacacagtttctctgatgtcggcctcggctgtgcttcttctttgggggtgaagagagtggggaggcagtctccacccctgggaggcagaagccaggtgagaaccagagtgggttggggcctcattgcagggctggggttggcccagggagagggcagtgtcccaatcttagagatctgtcctggcttctcagagtggcaggggtgttgggggagcttcctgagggacacctgtggctgcctagatagggctgggggatcccagtgggatggtctctgctccaatcccaccatgttctaggacaacagcaagggttcctggggctttggcctgagagaagtccctgtggtttgacctggcttccctctgctgggctccctgctgtggcctgggctggggtcctgatgccctccttccacagctggcgttaggcagggtgtggagagtagggggactcacctgaaatcttccctcaatcacttcccccgcctcctctcggggaaggcagaggccttcacagacatgggggactccccacaaaatgttccatccagagccaacctttctgcttggtagagctgtgtctccccctcagcctagttccagggcgggtccgtgtctcccaccccaaactagttccagggtgggtccctgtctcccacctcagaccagctttggggctggtccgtgtctcccccttcagactatctctggggcaggtccatgtctcccacctcagactagctccagggcaggtctgtgtctccccatttaaactagctctggggcgggtccgtgtctcccccatcagactagctccggggcgggtctgtgtctcccacctcagactagctccagggcaggtccatgtctcccacctcagactagttctggggcgggtctttgtctccccgctcagactagctctggaacgggtccttgccttcccactcagattagttccggggtgggtccatgtctccccgctcagactagctccagggaaggtctgtgtctcttccctcagatgagctcctggcaaagcctcccccgtcagactaagactcctaggcagagccgtgcctccccctggtccagccggcgacccctcatgcccaaggcagccctacccattgaagtaggacatgacatccatgaggagtgtggcaacagcaggcagcgtgtcggggtccaggctggtgacacagaacctgttgctcgggctggacagtgggtggatgaccggcatctggactgtaagagcacaaagatgtcaggcactgaggctgggactgaaagcagcagctctggtgagtgcagggcctgggaagagggctggggagggctcagccgcaggccctgagagactcattcactgctgcttctccagcctctaccaccaattaccaccgtcctgattctccatctcactctcaggcccctgggcctttgcacatgctgtgctggctgcctgggatgcccttcccaactggcaccacctggccccgttcctacctgtgttccaggcttcagcaccacagtccctgcccagggaaacccaccctgacacctgggattgcagcaggagtggcctctggccattgctgtatgcatgcacgtccaccacccttgctagacatggcagcagggcctgcccaggacctttccatcacatttttttttttttgagatggagttttgttcttgttgcccagactggagtgcaatggcacaatctcggctcaccgcaacctccgcctcctgggttcaagtgattctcctgcctcagcctcctcagtagctggaattacaaatatgcaccaccacacccagctaattttgtatttttagtagagaccaggtttctccatgttggtcaggcttgtctcaaactcctgacctcaggtgaattgcctgcctcggcctcccaaagtgctgggtttacaagcatgagccaccacaccttgccctttgcatcccgttctgcctggcactccattcatgctcagtgggcagaagcccgtgctgagagcaaggctggtctacggcttggcctggtaacttcgtgaggtttccccgcacaaacccccgcccccagctcacccagcttgggcttcacgaagccactggtgatgccgaggttctcggctgctacagtctagccactgaccacaggatggtgaactctgatgacaacgtgtgggtgacaaagggcaggtcccgcttgagcacctaggggcaagaagttgaggctgtgtgtgcctggtggccctggggcaccaacctctcaccctgagactctgcccccaccctggaatagcgtggaagggcaaggctgcaaggggtgggagatgggagtgagtgtgtcagaggcgggcccaagtgtgcaaggcgtgtctgtgatggtcagctcaccaggatgaagtctgtctgatacgtggacagcatgaacacggatatgttctggtcagccagtggggcgatgactgacttggcgatcttggtcatgccaataggctgggagctggagaagctgccaccgccggacaccacgttcagggccagccaggtggcatccgccacactcaggtgctccgaggagggcagctctggagggagacacagaaggcagccctgtgactgctgaggttccagctgtcccaagggcagggcaaggtaggccagagaggtggagagtgaggctctggggccagctctaccctgtgccttgcctcactttccaacaggattttttttttttttttttttttgagacagtcttgctctgtcaccaggctggagtgcctggagtggtgcgatctcggctcactgcaacctctgacttcctggttcaagtgattctcctgcctcggcctcccaagtagctgggattacaggcacgtgccaccatgcctggctaatttttgtatttttaatagagacggggtttcaccatgttggccaggatggtctcaatctcttgacctcgtgatccgcctgcgtcagcctcccaaagtgctgggattagaggcgtgagccaccgcacctggctggatgggattgttttttgagagagtcttgctctgtcgcccaggctggagtgcagtggtgcaatctcggctcattgcaacctccacctcctgggttcaagtgattcttgagtagtggagattacaggtatgcaccatcacacccagctaatttttgtatttttagtagagatggcattttcccatgttggtctggctggtctcgaactcctgatctcaaggggtcctcctgccttggcctcccaaagcgctaggattacaggcgtgagccactgcgctcggccttcaacagaatgggatttgaatcaaaggctgcttcctgggaggactgggcagggaaggccctcagatgacacaggacatccccagcagcttagcagagtaggagccatgtgggcaagtggttgatctgcgccaagcctcagtttcctcagccgtaaaacgatggcatcagtagtgggtaatgcccttatctttagttcttacaacccttttgtgggtctgatgctgtcatcacgcccattgtctcgcgtgcaactggctttcaaactgggttcctggagacctcccaggaaggctctgggtggaggggaggccaggaaaaggctgggtggggctttggggtttctcttcccccttcagccagccctgcacattgggcttctctggaagaacaggcaactccaggagggcccctgaagaggctgcatcatggggggcagtgactgtcacccatgtccctcctgagagcctggaagtcccaggggctggcaatggctttggcaggcgggggagtccacagcagcagcaactgctaagcctccttacctagctcatgaaaacccagaatccaaacgctggagccatcccttccaccctgtcctacagacagagtccctgagtagccctgaacgtgggacacaggcacacactatgtgtgaccacacccagccgcagactcgagcccaggctgcatttggggctcttcatacatcaccaggcacctgcataaacccacctagtgccaggccctgagtggggagggggcacggcacagggaggtgaactctgacactgcatcccacaaggaggcaggatttttttttttttgagatggagcctcactctgtcacccaggctggagtgcattggcatgatcttggctcactgcaacctctgcctcctggttcaagcaattatcctgcctcggcctctcgagtagctgggattagaggcacccaccaccatgcctggctaatttttgtatttttggtaaagatggggtttcaccacgttggcctggctggtctcaaactcctggcctcaagtgatccacccaccttggtctcccaaagggctgggattacaagcgtgagccaccgcgcctggccaaggcagggttattttgctcactgtacactcaacggtccagaaactctggacctggaaggctcagtgatttgccgaagatcacttaggaaataacagagccaggattccagtgtgggtctggctcaagaacccaggctctattttgggcaccaaatgaaaaccaccaagtccctaagaaaatagggggctaaaaagagaggtgctgaggctggaggcagtggctcacgcctgtactctcattgctttgggaggccaaggtgggaggatcgcttgagaccaggaattggagaccagcctggagaacgtactgagaccccatctctaaaaaaattaaaaataaatgagccaggcgtggtggcacatgcctgtggtcccagacgcttgggaggctgaggtgggaggatcgcttgagtctgggatttcaaggctgcagtgagctatgactgcaccactgcactccagcctaggtgacacagccagaccctatctcaaaaaataaatcgataaaaagggagacaggggctcagagatgggtgagctaaggcagctgtgatgatgaagattcctggggaaagacgagctgggctctgctggcaggcaagatggcctgagaggagggaaattgagtgaggcccatgcctgttcctacctgcccagctctggtcaccatggtgaccacagcccagggagcccattggtcccgctggctgagaaggaccagtggtcagccagtgggtggctagagaggcaggcagctgcacagaaatgggaaaaggcggccccagtcttgagcagtgggaggcctgtctcttatcaaagccgcaggcttcggactccgaggggccaatcctggctctgtcctccccagcggaagcggctgctgatatagcctccgaggtggtgaagtgctggggtgcatatatgcaccttgagggggtgctgacataaccaagactctgccactaggagtctcttggcaggtttggacgagacccagagtggtcttggggagaagcccaggcctgagaccagctggaaacatggctgtgggggaagaggcggctgctgctggctggaggatttc

SEQ ID NO: 38567 - DNA, 9349 bp, Homo sapiens
ggcgggagggcccggcccgatttcccttgctgctccccttgtggcctggtgagtgggaagtgaaaccaaggataggaccagtggagggaccctctaatttatgggaggagacatgaggggttcatggaaccccagcgggggcaactgggcagtcaccaaagctggaggggacagagggctgggatctccaatcatgggaagggagagatggatggaaggaaatgaagaactctggataggggagacgcggctagaccccaggggctgtgatcagggagggaattggggagtgatgccagagagggcaggtctccgggagtaaaagtgtggcttctctctgcttggggttacccctggctcatcggagcagggagctgtcggggcttgttggaggggccgtggtccctgatcgcgagttgtaatctgaaggggcggggctggactcccggttgattaggaagctcgggcttcagaaggaactctgcagttagtgtttgcgcctttctccttatctttgtgtcatagtctctctgtccctctgtctctctctctctgtttctctgtgtgtgtgtgtgtgtgtgtgtgtgtctctctctctttctgtctccctctccagccccaccctttcagtctcctccgggtgcactgataaggttggaaagtggaatggtgggtaagtccagggatctgggctttataagtagccacacgtctcccccagcccctgtcatacatgggggtctgccccgtgctgagacagagaaaaaagaggcgcgggaatttataacccaatggctcttacccattgcaatgccactcctggaagtccaacctcccttcctcctgcctgggttcatacacctgtgtcctgtctgatcctcattcccactgtatggcttcccttcctggtcctgggatagggctctttatccccatctgtgacagccagaggggctctggaggaaaccaggttcccgaccatggtctgacctgactgtgttaatgagctgattgatctgatctctctctctcttgctggctgtttcattcacgagctggggctttttctctccttcccttataaatccccaaggctcagggacaactgtaggtggggagcgggaggaactggagataagaaagtgatagagcagagacagtagttgtggggccacctaggagagtctgggtatagacaacatccccagccactccccttccctgaaggaggtctcagctgcagcaggagagaaggctgcctctgcctctctccttagacttcccttcttcccccctcatttcccttctagacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggtgagttcccactttgccccaactccttctagacgccccgtacttgctcttccccatcccacctggggctggtgactcctgaggactcagaagcctccatgccctctgtcccttctacccatttgctgctgaggaacaggacactccccctccatctcttcccaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtaaggagtgtcgcagtggtgggagggaccagaaacagatgggctcaggctgacaccaccaagggagggggcccagacctgggggctccccaggcatcatctcaccctaaagttggacataggggccacaaagttgggctccctgccatcctctctacaggtgtcccttccccagtagtttctgggagcccaagtcctcctcccttctctctctggcgcttactccagtctctctctttcaccaatgtatttccctggcatcagtgccttgccaactctgagcccccaactctccctccaggtgccccttactcttctgtttttaaattattttttggaagacagggtcttactctgtcgcccaggctggagtgcagtggcacaatcatagctcactgcagccttgacttcccaggctcaagtgatcctcccacctcagcctcctgagtagctatggctaaggcatgtgccactacacgtggctactttttaattttttgtagagatggggtcttgctatgttgcccaggctgatctcaaacccctgggcttaaataaataaataaatagtcctgggctcaagtgatctgctcaccttgacctcccaaagggttgggattacaggagtgagcttgcccagcctgtgtgtgtgtgtgtgtgtgtgtgtgtgtgtgtgtgtgtgagacagggtctcattctgtcatccaggctggaatgcagtggtacaattatagctcactgtaacctcaaactcctgggctcaagcgatcctctcacctcagcctcccaactagctgggactacaggtgcatgccaccacacctggctatttttttattttattttttgtagagatggagtctcactatgttgcccaggctggcctcaaatgatcctcccacctcagcctggcaagtacctaggacaacacgccccttccctttcttagcctccctttcactgtcacaccagggccccacctcccccactgccttctgacttgtcttcttcaaccccctcacattttgaggatcagctgtatttttagcccgggactaagcccagcactttgggagaccaaggtgggcagatcacctgaggtcagaagttcgagaccagcctggccaacatggtgaaaccctgtctctactaaaaatacaaaaattagccaggcgtggtggcacacgcctgtaatcccagctactcgggaggctgaggcaggagaattgcttgaacccaggaggcagaggttgcagtgagccgagattgtgccactgcactccagcctgggcaacagagcgagactccatttcacaaaagaaaaaaaaggccgggcgcagtggctcacgcctgtaatcccagcactttgggaggccaaggcgggtggatcacaaggtcaggagatcgagaccatcctggctaacacagtgaaaccccgtttctactaaaaatacaaaaaattagccgggcatggtggtgggtgcccgtagtcccagctactcaggaggctgaggcaggaaaatggcatgaacctgggaggcggagcttgcagtgagctgagatcgtgccactgcactccagcctgggtgacacagtgagactctgtctcaaaaaaaaaaaaaaaaggaaagaaagataaataaataaaattgaaaattaaagtggcagagctggaagttgagcccaggtccatgcactccaaagtcgaggcttcttccgaggcttgtgcatgtgtttgtatctggaatggtgagaagaatattcaccaaagaggtgatgctttctggagaggggggtttattttactttattatttaattttgatttttattttatttattttgagacagagtcttgctctttcccctgggctggagtgcagtggcacgatctcagctcactgcaacctctgcctcccgggttcaagcaattctcatgcctcccaagtagctgggactacaggcacccgccaccacgcctagctaatttttgtacttttagtagagacagggtttcgccatgttgaccaggctggtctcaaactcctgacctcaagtgatccgcccacctcagcctcccaaaatgctgggattccaggtgtcagccaccgtgcccagccgagagcggggggttttaaaggaaaaggtggatgtggcttgtggtaaggacagcatgaggcattcttagagggagcaaaacaccagcaaggacatggtggggtgcacgtgtgtgtgtgcatgtaagagggagaacgtctgtactgggggtagaagttccacaggggctgcaaagtcacccttgttgaagctggagctggagacaccagctgaggacatgggcgtgctctgatgggcagcgaaaggccactgccaggagtgaggcaatgacagtgacctttgaggtaggtttctccagaggctaggatgatggccttcactgacgccaccattcactgaatacctaccatgttccagacacttgcacattcttccaggtaagtgttacccagttactcagatttctagatggaggaatgatggctctgagaccttcaataacccgcccaaagtcacagaattagtaaatggcagagtgggattttattccaggtccagatgccaaagactgttttcttcgctttcccctctgccttcaaagagacctgcagggccaggcatggtggctcatgcctgtgatccgagtgttttggatgctgaggtgagaggattacttgagcccaggagttcaacgccaatctgggcaacatagcaagaccccatcactacaaaaaaattaaaaattaacagggaatgttggtgtgtgcctgtagtcccagctattcaggaggctgagattggggaatcccttgagcccaggagttttcaaggctgcagtgagctatgatatgctgcctaagtgacagagcaaggagacactgtctcttaaaaaatagtaagaagaaaataaacactgaaaagctaaaatgctcatttcctgtcctccccctcaaaaaaaaaaaaaaaaaagagagttcacaggctgctattcaggtgtgccatacttgcagagccgattgaggaacaccatgacagacagaagtcagattcaatgatggaagtcatttttggaggcagaaacccttcaaggagactaggagctaggttctgacctgcatcagcctgcagggccacgttagggtgtggtgcagcctgatctccaccttcattcttgcagagcggtgtaatcacgtgtcccagccctcagggcagcatcctaccaggcagccgtggcttcccagtgtcccagcccagggtgttttttgccctctaggatgcccaggagaccctgaagtgctttacccctcagccattctgggcctggcctgcccacctgctgcctatgcccgagatggcattatagttgctcctttgttgccagtgatgccccctcccaggcactcaacaggtttttgctggagaaatgagtacaaaggttggttcctagaggttttactgaccaaggcagacagaaatgcccgaggaaattaatgttctccaggagtttcctatcctccaggtttccgtccctcccttctttctttttttttctttttcttttttttcccttccttttcctcccctcccctcccctttaaaattagtgcccggctaatttttaagttctgggatacatgtgcagaatatgcaggtttgttacacaggtatacatgtgccacggtggtttgctgcacctgtcaacctgtcatctaggttttaagccttgcatgcattaggcattcatcctcatgctctctctctcttcctttgcccctgaccccgacaagcctctcctcttccccctctccctcccctctcccccctcccctcccctcccctcccctcctcttcccttccctccttccctctctggctgcttctttcttttttttttttttttgagacagagtctcactttgctgcccaggctggagtgcagtggcgcgatctcggctcactgcaacctctgccacccagcttcaagcgattctcctgcctcagcctcctgagtagctgggattacaggcgcctgccaccacgcctggctaatttttatagttttagtagagatgtggtttcaccatcttggccaggctggtcttgaactcctgaccttgtgatccacccgcctcagcctcccaaagtgctgggattacaggtgtgagtcactgcacccggcccctttctttcaaggcagggtcttgctgtgttgctcaggcttgtcttgaactcctgggcttaagcaatcctaccacctcagcctcttgagtagctgggactacaggtgtgtaccaggataccgcgctaatttatttttattttaagttctgggatacatgtgcagaacatgcaggtttgttacataggtacacatgtgccctggtggtttgatgcactgatcaacacatcatctaggttttaagccctgcaggcattaggtattcatcctaatgctctccctccccttgctccccaccccgacaggccccagtgtgtgatgctcccctccctgtgtccatgtgttctcactgttcaactcccacttacttatgagtgagaacacatggtgtttggttttctgttcctgtgttagttttgttagtttactggagtaggttagtttgctgagcatgatgatggcttccagcttcatccatgcacctgcaaaggacattatctcattcttttctatggctgcatagtattccatggtgtatatgtgccacattttatttatccagtctatcattgattgacctgctaacttttttagtttttttttttttttttttgagacagagtcttgctctgttggccaggctgtcaagtgcagtggcacgatctcagctcactgcaacctccgcctcctgggctcaagcaattctcctgcctcagcctcccgagtagctgggattacaggcgtgtgccatcacacctggctaatttttttgtatttttagtagagacggggtttcaccatgttggccaggctggtctcgaactcctgacctcaagtaatccgcccgcctcggcctcccaaagtgctgggattacaggcttgagccaccatgcccggctttttagttttatttttgtagagacagggtctcgctatgttgcccaggctggcctcggcaacatagcaatgctcaagccatcctactgcctcagcctcctgagtagctgggactacaggcacacaaaacatgcctggctccatgctccagatttcttgtatgttttatctcatgtatctttcatagtcacttgagaaagtatgattatccccatttgcagataagcaaattgagtctcagagatgttaagtaacttgccactcagcaagtgatggaagctggggattcctagcagagctgggaggaggaggtttcaggaggctggtcagcggacacatggcttgtgcatacttatgcataccttctccccagcccagttctctctcttctgtcttccctcctctgcaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaactt

SEQ ID NO: 38568 - DNA, 3577 bp, Homo sapiens
ctttcagtaatcattcaaccaacgcttccatgtctctactctgtcgtaacaaaggctgtgggcagcactttgaccctaataccaaccttcctggtgagtaaagaatcctgacctggccaggggctctgtgtgggtgttggggactggtcagctggggggcagtgtgtttgaggagcggggaaagaaactacctgccctagtttaattggtctgagtgatcttacagcctttgctggcttttttttttttcttcacattatatgggaagaaaccataaatagaaacccggggaagaggtgaaaaatgatacttggtatagttatcttcccttccttgataacttctactgatgtccacagattcctgttgccatcaccctggggtcccaatcttccatgatgcacttaaggtgaggagtaggtgaggggggttagcaagagcatttcccagaagagataatacccaggaagctaagctgatctgggtctcttgttatcagggttggtcctgctgccgaaagcgaactgtagatttctctgagttcttaaacatcaaggtaaattatttatgtacttggattctgcccccaatagaaggattctatccctaatcctatctccttatctatactagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtaaagaggaggaggcccctggacttttcttattttcatgtagcttcctaggagtgattaatgggtcattgaggactgggaactagggaccagggatgtgaggagggccagatgtcagggtttggatggtgtatatcctgtgccttaggggaaatttgtgtctggaaataacgccctttcctctaaggtggtgtgggatgatgggatagatacctgaatcaacagagtagatagcccctcacaaatacatccttagtgtataacacaaaagggattgttgagaatgacttctctttctagaaaagaactttaagataaatctcatatcaagaaaaggatgtattgtattattggcagccaggagacttcccaaattttgtgggaataataagagcaacagaaggaagtcatattaggtccacgattagataaagaggaagaggatatgactcagttctgcagagaaaagtggttaggtttagagcaactgagtagatgggtaagagaagtgctggggatttctctagggttcaggtatttgggatgtccacagagatgaaaattggcaatggggttgctacccaacctctccaactctgcctcactttcaccaggcttctttaattccattaccatcggtgggagtgttggagctagcaatcatagctaatgggtcagaactaaatcaccacccttaacccctaggtcagagttgcctctgaagctgctgccgctaaatatatcccaagccctggaaatggcattggaacagaaggaattagaccaggaacctggggcaggtaggtgggtctttagtaggatcaacttcatagactggaatttagtggaagtggcaattgagtggggggatggataagttcctgactctgtttcccttgcccaggacttgacagtctgatccggactggttccagctgccagaacccaggatgtgatgctgtgagtgagagttttgaggggctcaagcatatggctgagggatgactgggtatagataggctgagtaggatataccttagaatgacctggttctactttatccttcttaggtttaccaaggccctgagagtgatgctactccatgtacctaccacccaggagcaccccgattccatgaggggtgagggaggggactgggtgggctatgaggctatgagacaggtttctcctaatatttggtcataagataatattgggggtgagagaattcagttgaattatcttcctacttcaggatgaagtcttggagctgttgtggcatccagaccctggattttggggcattcttggcacaaccagggtgcagagtcggtagacatgactgggggaagcaggtaagccccagctttcctgaactcttgattagaacccaatctcagaggtaaattctcctccctctctgtaccacatagccaagctccctgtcttctccctttagtatagaccaaataagattctgctccttatccctcaacagcccagaggttttgcaatatgaggttgtgttaatctttttgagactctctgtctcttctccacgtgcatcatgagaactccccttcagttaagaatttattcttaccacctgcatttcacatcttctctttagctcccagcatcttgccgccatgattggcaccagacagattccttagtagtggtgactgtatatggccagattccacttcctgcgtttaactgggtgaaggccagtcaaactgaggtgagcaatgatctgatgttggatgggaggatagtcaattgggtgatactacaatctcacaggcagagttgccatttgctgttaacctgtaggctccatagtacccttagaggaaaggagagttattaggtcagggctgtctggccaacctgtggatcatacctctgacctggttatctgtcgtaatgacctattctgaccttctgggtttgttactacccctgtaattcttttctctcagcttcatgtccacattgtctttgatggtaaccgtgtgttccaagcacagatgaagctctggggggtaagtgaagaccaggggacacaagagtgggaggcagatgggtgaaagagcggctagactggaatagagggtgtcttgagggaaggagttgtactaggaaaatggaggttttctcttcatttgctttcattttctctctctctcctactcttcctatttccctctttccctcccctcttccttctcccttttcatctctcatttctttcctctctctcccttattgtcttattcctcccttaccttttttcttaccttattaaaaatttctctctctcatttgtcaccactccaccctgaccccaatgcctttgatttcctcattctctctttcttctgttttcctttgctcctcctcaggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatct

SEQ ID NO: 38569 - DNA, 14224 bp, Homo sapiens
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggtgagttaatcactaaccaactattgcttatcctatagcaataggaaggggtttcatgggaaatcagagctacaggggaggggaggtgtccctctataccccagctagggagatttcctctctgttcctcaattctctgagtccattctgggatcagatcaggttggtagcaacttgagattgtagtgtttttgtggagactggggctgggaggcaccttctttttcatttatccctttaggttggataggcatattgtgcaaacaacaagaaaaagaaaatagatttgttttggaaatttccatctctgaacaattgaaattgagttgtgattttagaaaagaacagttgaaatagagggagtcaaaatgggggagagtatcttggttttccatagcgactgtaacaggaaattctcccgtggctttaccaactcggtgtcgatctttatttaaataatgggtgcaatgtgtgtgtgtgtttgatcatgctcatgtgataatggagctctctgtgtacaggtgtgttaggcatgagctgtactaggttgtttgtaaagggatatgaggttggggcacatggagaaaacttcagctaccagctcatctttggaaaacccatggataatctagctgcaaagtcaagtttatttggattctactcaattaactttctgactcagcctgttaatagacacagagactggcaaacagaaagctacctggctgtgccgagcctcacccacatgaatatttcgtggctgcatgtcaagtctagttagagttccaagtggggctcaagccaaggtagtgtggcagagtccacagacagagaagcagaccagggtggtggctttgtttgttttcctgcaggtgtcccagttggcagtttgtgtggcagatttacctgcagaaggaaggcagatgtaggagtcgagtcagagtagcaagttgcctctccattatccatcttggggggtttaaccctttggtccctaactttgactcttttcctcctgctgcagagaagagggaagtgggaagccctcagtgccaggctcaagggcctggcacacgcagccctgagtgaatatatgggttttccagtcctggcaactggagatttaggcttgagctcacctcacaccacagagccaacaccccacactcacagactgagggctgccctagatggtgaatttaggaataaagaccactggcagtgtctaacaaagctctgctatgcagagggtatttctacctgctccttccctcaaacacactggtgaaagggaagatgataatgttgcctaaacacacacagaaacttgcccatgtgttcatggagacagatatgcaaactgtgcaagttttagtcattctgctatttttcttaggatattttccagcccaaggcacatttctgggtagtcaacaagaagcaaagacacctggattgaaagacaggaaacctctttgactagtaggcagagaggcaaagctcttggaggacatgtggggggttcgtgggaggaggatgagagggacctgggtctgattagaaggtacagacaagccaacctggaatggagctggagccctctccccaccccaccatctccagatgccagaacttgaactgttctttatttcctctcctccaaggcttggcagtatttagtattttagtcagtggtgtagttaatatttaatgtgtctttggatgggtggccctgactataggtgctgcatatttcttaacccattccctcctcccgttaagttcccaaagaggtcaagggttaagataccaaactctcaccttgagtgttttgtttgtttctcagtcttcttatcagggtttcgatggctgccctgaaagagccccaaggttcaaggttgtgaagtcggtgaaaggaaatgcagctttcaccattaagattctttaggtcagaaaactaggtatggagatgaggtgacagcgcctcgctcagctttggtttcaggttcagattcctctgtgcagggattatgtaatccctaaagacatgatcttccttggcagttggtgtcatttctttactgtagaaatatctgctgttggggcaatacactggtctggaagtataaagctgaagcagatgatttgcagggtttaaggtatgaagtagaaggagaagggggttttaaggcttttagtattttagtcaggggtggctagtaaccattctcgggggcatgcccctcttgcatccagatagtccctgaaatgccctgtggagggctgccctgtatatgcatgtataggtcattccctgtttcccttaggaagggctagtggtaagagccataactttctcacccgtaaaatgaagaaaacgtcacatcctgcctatgtttccagtttatgctgaagatcgaattagcatatctgagagtactttgcaagctatggcatgctgtgttcttgtgaagcagtgcttttcctaccacttttatctcttccagctacttgaagacatcctaggttctgaaacaaaagtgtgataagcttccctggtaggaaagagagactagaaaacctctgtaaagtctaaagcatacttagaagcacaagggtagtaattttctctgaaagtaagaggcagcatctgctcacccattcatagagaatatgatgttaattacagtgagtcactttaaatatttactgccctgattttacagagaagaaaattggagcccaaaactagacccttagatctacattgactttttgacaacaatgcctttgtcttatacagttttgtaacaccagcgcctattattaggtgctcataaatgttagtttaactgaaaacattgcccaaatttcactgagccatatattatccaggaaattaagtatttaagtaaaagctgacagttataggttagaaaccaagaagaagccttccaaaagctcaacctaatagaccctagaacagatggcaagttcattcattcggcattttttgagtgttttctgtgtgcctagactcacagagatggagctcctttgctatagtggcctcaaccctacacaatgttaggaatgggttagtcctccctgaacttgggcatcattcatggagtgggtagctgagatgactgaacttcatccacatgatttctcatgttcctgtttctttgagcttctgggtattggggagctaacctcatgaagaaaccctaagagcttcctcaccccacatttatttatcattgggcttctttggtgtctctgcccctccagtcccctccttatctcctaggaggatctggacccctatgaaccagatgtctggctcactagggatctctcctgttttccccccagtgttctgcccctccatacctgccccttttaagagactcctcccaagcagaagaggagctccttggggctccatacttgccagctctatagggatggaaagctgactcacccaacccagcccaaacttgactttggcactggaagcaattattaccagaggccaagaggacatctgccctggcatccaaagcccaagcctccagatctcaaatagatcacgttttcttctaggacattttacctagtgttgggagggttggaaagatgaaagaaaatataggatggcattataaggaaaatatggatttagaatcagacaaactttattctaattctggctctcctccaactctctgtttgatcttggaactgtcttttcatcttaattcttttagaatttcattttaacatagcagactcacttctggcctgccatctccagtggagtatttcccacaaacagccacatcaaaatccttgggactttcagagggaagatggcactgccttcctttgctactactattgttacaatgacattgaaactttttttccctaaggaattagagttgggaggaagctacatgggacatttctcttgttcatttgacataggctagggaatctcattgggaatgtgtgcaacaacagaggcactagaaagaaagagattcactagaaagaaaataggtttgtgtcaaccactgcaggtgccctgttcatgcctccaggctagggagttaaagatgggtatcgtagcggtggttgtgatgatgttgatgatattgactgtgatagcaggtgacaatttgctctgtgcaaagtgttttaaacgttctcacaataaccccatgaggtaggtattattaagggacctgtttcttctctcaagtctacagtctcccatcaaaccagaacccttcttttctgagatcctgtttctcttgtttcaatttagtttgatcctagatagatcttgtctttttcttgttacaagaacaataatagttaattattgactcatgaggtcttagggtatttactaccaactaaactgtgctaactgttctctcatttaatccttatactaacattatttaatgaggaaaaacagactcagagtaatttgccccaagtcacataactgtaaatggctaaactgggatttgagcccagacccaactaactccagaacccaaggtattgacgcctgtaatatttattgcttatagtaatgaaaatgtagattaagctccttggttcagagaaaaatgtaagagaagtagtagaagcttctttctgactagactgcctctccaccaactaagtctgtccttctgcatgtatttaagccagcttcagggtccttccatgcaggccgggggtgtcgggcagtggctgttcatgccccccttccagctctctgcttgcttggtgtccttcccgccatgccgcccagggcctgggcagagccttgccgaagcctcggctcatgtgtggctttgattcttctcttttcaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctgtacgtaatactctccctcccgcaacctggtctgctctctgcacacctgccctgccctgccctgccctatcctttcctgccacccatcctggctcactgcaccttctctttcattgttggggagtgattcacaacaccagtgggtgctttctgcctgagtcagccctggctctatagagaataggatgggacgaccttagagagcaactgggcaaatgagactttttccgccgattttcattaggttgggggttgggttgagcagagagagtaggcctgtaatctgaggtcatggtggaaaccagaacatagattcttgtagcacatggattattgaagttctctgcaatgagcagcattactttagtctcttacaaagatcaaagaaaataggtaattaggagcctaggttctggaaccaaacagatttaagttctctacttataagctgtatgaccttgggcaaattacttaatttctctaagctttagcctcctcagttttcaaatgggatacttagtgttcatacccaattcaatttgtggggagtaaatgtgatacaggtaaagcacctagcatatgcctctatatagaaaagaatcagcctttctaggagcagagactgagaatcttccaaagtcactgtgtttagctacttgtgagtggcatttaataaactgtaatttttctgggcatgaatttaaatctcagttgttgtgaggctggtgtgaaagagtaaatctgtgctgcatccagacgcaaacatttgttgttcatgcttgtcacatacataagaatcatagagaatttatgcttttttgcattgtatcctatagaggtatttgaaaatttaagggtgtctactgaatgtcaagatgtttaagacaaccagtggattttgatatgtaaaaatagagtagagaaagaaacacacatgcacaaatccaaagtgcagacaatcatacaaatttcattttgaccctagataatggggctgtggagacgtctttctatgtcttttaggctgaggccaacgtgaatagtcacatagcattggacacagaatgtgacagggattaaaggttttcaaagtgaatcattcatgaaggagaaactcagagtcagcttatccttggcaaggctattttaggaggaagaggacaataaagatatttttcttcaagaaactcttggcgtcagcttcagagcttccaggggctatatttggggcttgctttaacatgtaggcccacatgcgaaaggaagttccagaggcaaatggaagggttattctgcaaccctctcccctccctccaggatatttttagagctgtctcaaaatctttcctggccatctgagtgggcctgaagaatatacaactctgaagtgtcccaaatattaggaaaagggctggagatgccaagaagagacttggcccaaatttcttatattccaatttgcccttttgttttcccttcaacctcctctgtggaagagcaactattccagcaaacttctagccccatacaacatagacagtaactgtctgagatgaccattattattttcttccaaaaacctctatgtactctctcataatgaatatgatctactttaagatctacttaatatttaatactaagctgcttttccctcctcccataccatccagtttctccaccaacctccccctttaagttaatatttgctttagaaatgcacacttacttgaacattagccagagccaaatgtcatcaagaaagtaaatgtacaaggggaaaaattcccgtatggaatgcatttcaaagtcaagtacaaatcatttagtacatttatctgtggccagtcatgccacagttcctactggcctggcagctcatagctggcttcatttcctgcttttcctcatactgcccttgacataccagatcaagtatgcagaagtacttttaaaagttaaaagcaataccactgaagtttcaggtcaaattgttatgttgcacttcttatttggagctaaatcagaggtgctcaaagtgagatgtttgacaaaggctgtcaaacattgaaacttgggactgcttctaatctgtgcccctaagcattcaagccaggactgagcaaaagaaaggcccctgccatgtgcctgcccagctccagagctgggcgctagtgggccagcctcctgacagactctgccctccctggtgcctacagtttcaggaggcaactccagcagctttgcagagtagcaggagggaaaggtttccagctcttcagcattccttcctctctgcagggtggttctcaggccccgccagtttctgcggagggagcgctttctcacagctctctctccctctcctgttcttcttctcgccctcccccccgcctccccgcccccgcccccaaccccaaacccaacagagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggtaaggcagaccctctggggtggaaccccagcaaaacccagaaaatcaatatgtcccctccggccactttctacctcgcctgccctctaccccaagggtcacaggcagaagaaggtgtagccacactcctcaccactctcctggctagaacagagccttgtccctggagggaaggagggacccctggcaagccagcttcctatgtctgtctatgaagtatcagagctctagaagggaaaggggtttgaccagctcccattctcctgtggaaaaattctaaagagatatgaccgcagaggcgggggagggagtcagggagggctgggtggttggctctggagagactgagtcagtctagagagctaatctgggtgacacagaggacaagggtaggagagataaggagaaggaagggctccccagctgcagtgggaagtacctcaaggccctcgttagagagcgtggaaagccagtggtattcaggctcagcagaaggggaacaaaacaacacacaagtgtggccatgactgtggggccacatgtcccagggtgtgagaaaccttttactcctgaggacagtcccgctggtattggggctgcagttttgtgttgtttcatttagcaaatatttattaacaagtagttagaccttccctggagctagagctataaatggggacgtagggctttcctgctccatgaggctgattcactggcccagggggcctgatgtacctgcctagctcactggaaggaaaggagtcactttctggtgtggggacactatggctattacagaattatccacatgctcatagaaagtgcaagtagaaggcagaagcctggttgaatcaagagcaaatcacttattcagaggcttgcattgggctcagttatctgggaggcccaaaatagctagaaggaactgtcccaaatttatctccaaccctggtgcctctgtagaaaactggggagaggtcaagtcaataacttagagcaatcaggggtcactctcttgccgcccatcatgaaaaattaattctcagtcaaaaaaagatatgctattattatttgtagaaatgggggtctcttatgttgccctggttggtctcgaactcttgggctcaaatgatccacttgctttggcctcccaaagtgctgggattacaggcatgagacactgcgcctggccctggatctgctattactgatctattagtctaaatgatatccagacaaaagtgctgctcttgtaaaagcaaagaaaacaaggcaaaataaaacccattcattgctagtttgggatcagagttcaggaagtcattgctttcccctctgcagcagggccctcacctctgtccactctttttctgtccactcttttatgttctttctgaccctcacaggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaatttctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaatagttattgctgtggcttttaattttatctttggaagatagctatatggtaactcatcattaaccagaacacctctcccctcaaattccgtgaccaagttgtgcagcttgagcaaatgccgaaagagggtattatgggtgggtggtgtgggcttgcaaatacaagcttggaggtgagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatact

SEQ ID NO: 38570 - DNA, 7357 bp, Homo sapiens
atgcagaccttcccagttgctggggcgctggaccctgctatactggacacaaggtgaggcctgaaagtccaggcaccctgaggagctgggcaaactagcagaaaagatggcgctgggagaaaggaaagttagactctggacgggaaatctggaaagaagtggttcccagctgggccaaaaagcctcatcctacgccgtctcatcgacctgggctccaccctgagtgcctccagtgtgaggtgctggactggctctgtgctgcctgtttgggttgagggtttgctcctaggagaggcatgtatttctcgtacagctgtcacaagcgagtgagggctccggaggtggagggcccaagagggtggggagctcaggcgtcagtgatagccagatttccatccatcggtccgtccgtccgtccatccatccatccatctatccaatcaacaagccattccggattcttcaggaatccagtcattcatttatatttaggttaaagaccctctctctggttcctctctagaacgcaatctcgagccgctcccccaacaaaccgtggccctctcccgaccgggtcatctacagccccgcccctcgtttgcctggctccattcccctaaccttggcgttctgtcctcaggccccgccttctttgtttcgtcactcggttgcttaccctcaggtatcccttaactctaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtgggtgtcttgccccccggttccctcaaggcccacggtcgcttgaattccacagcaagtcctcccggacctctcagggcaatcccctcccgaagcccagcctcagcctcgcaaagcctctagtcgttggccttttcgttgcgattatattcgagagggagcttcagagggcgccgcgaagttcccctgtgcttcccctttgccctttgccctcttcgcttcaagaggagcccctggctctcttttttttttttttttttttttttttgagacggagtcttgctctgtcgccaagctggagtgcagtggcgcgatctcggctcactgcaacctccgtctcccgggttcaagcgattctcctgcctcagcctcctgagtagctgggactacaggcaggcgccaccactcctggctaatttttgtatgtttagtagagacggggtttcaccatattgtccaggatggtctcgatctcttaaccttgtgatccgcccagctcggcctcccaaagtgctgggattacaggcgtgagccacggagcccggccctctgattctttttgtctatcactctgtgcactcattcattcaagacatttatgtaggtgccccgcgttcctctgcagttctccactactctggcttttctctaatacaatttattttgtgttattatttctttaagacagagtctcactctgtcgcccaggctggagtgcagtggtgcgatctcggctcactgcaacctctgcctcccaggttcaagagattctcctgcctcagcctcccgagtagccaggactacaggcgtgcgccaccacacctggctaatgtttttgtattttttgatagagacggggtttcaccatgttgctcaggctggttgcgaactcctgacctcgaatgatcccccaccttggcctcccaaagtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaatatagtttttaaattcattcattccaaggcttttgggaggcgctcagtggcgtgcagtttcctctcgaatttctttcttcccgcagtctttctgggcgggcgtctcccgtctgtttcttcccatcttcccccttatcatcctgggactggataattcttgaatagtctgggaggtagcagggaacccgagttcggagcctcgaccagaacctccagacgggaaattggagcaggtggtgtcgttccaggacgctgaggaccacctcctcccctaacgcacagcccaacgatcctaaaagtaaaaaccctgagtttctgagtcaagactgagctggtggggtggggaccgagtaggcgtggatggggagcccagcgggtccccagcggagaaaatgggtgagacgcctggggccgcggtctccagaattcgcctgggagggagagtggcgctacggcgccgccttcctggggagccgcttcgggctccggatgtccgctggggcccgacgcttgggtcccgacgcgcggttcgcactttccaggtttcttccccagggaacagagcttgagcggggggccacccccccgtcctaccggagttctgaggtgcggtcaggcgcggagagcggacgcccagcgccagattctgtgggctccggagttcaggcccactgagccgcagctgagcacaggcggggcaggaaaaaggatgaggtgagggaaggcgctgggttcctggaaccccaagggagcactgagctgagtacgtatcgcttgggatccaggtgtccttgttttaggatgtctgacaggtgtccccagggtatgagaagtgggactgggcaccccctatttgcttttttttttttttttttgagacagaccacatgtttcctatcttggaaaatggtaccacttccttgtgcaagcctacccctgttccctcacccctcgttcagtccaacagcaaatctgtccagtcttctaactgtatctcaggttcattagccccgcttcctcgtccctgctcgtcttctgccggaccagtccgccatcttgtgaccggactcgggaatagcgtcctacttcccggcggcctccactcttgacccaaatgcaatgtgcagccatggcaatcttttataaacagaaatccgatcaagttactcctctgccgaaatccctctggtcagtggtttaactgtcgaggtgctcctggcagcactctgccctccccacatcattgctggtggacttgtctcccctactagactgtgccctgtgagggtggagactttgtgcagggttgtatccccagcatctgatgcagtgattcaataaacatctgtccaattaataggaaagacagttccttttctcattcccctattgctggtcccctgccctcaagcaggatgttatgccccagagtggctgtgggtgcgaacattctgcccctctggctggtctggcactgatttccaccctgagctggtgttgcctctctccttcctcttggccaacctctcttccaccaatataagcccaaactggaggccagcaggcagtcatgcgttttatggcaggccctgcagggagccagagtctgggtcccctgtgcttccacagcagcccccaagccctctacacggtcctcttaatagtgctggtcatgatgagcttggtgtttggtaagtggctccaagggttcagaagggtctcctggcctggatggagaaacccacagacaccaagtgtctgggtacacctgtccaggatgctcaggtaaacccatgcaggaggagagatgggacagatgggtttggtagggaatgcctgctcatggactgatgtgcaatctgaagatttttaaaaatttattattattattatttttgagatggagtctcgctctgtatcccaggccggagtgcagtggcgagatctcggctcactgcaacctccacctcccgggttcaagcgattctcatgcctcagcctcccgaataactgggattacaggcataagccaccaagcccagctaatttttgtatatttagtagagacggggtttcaccatgttggccaggctggtctcgaactcctgacctcaggtacctgcccgccttggcctcccaaagtgctgggattacaggcgtgagccaccgcacccagcctctgaaggagatttctagtgaccaccccagggctgtctcacttcacagcagtgacctgaatagagatactgaaggaatcctctctggatctgagggcaacatagaatagggagggttagggagtgtgctggatgagaaaaccagaatccacaggatagaacaagactgagtccagcctgctgggctccccacttggctgcaaagcaccagccacagagacacaggattcaaagtgttggtttagcactttcctctgcctaacaccaagtgctctgctgggtctggggatttgttaacatgtggtctggccttaggaccagaggaaaagggggatgtatgtgtatgcagttggggaaggaagcagagaattggggctttgatggttttctgagacaggaagggagggaggagtggggctgagtggcctggaatcaggcagtggtagggtgtgaggtagaatggggtgtgagtggggtcagcacttctctgtgttctaggtaagtttgttcctgtcaattgggaaccccctcaaccacttccattccccaaatacctgcgctgctaccgatgcctcttggagaccaaggagttagggtgccttctgggatctgacatctgcctcaccccagctggcagcagctgcatcactctccacaaaaagaacagtaagtggccttctcctgtcatgggcccagcactctcccaaacggaaactctctcagcctcctaagctgcaccccaagtcttgttcccataatcccataagacattgctccaatcctgtctttttttttttgctgctctgtcacccaggctggagtgcagtggcgcaatcttggctcactgcaacctccacctctccagttcaagcaattcttgtgcctcagtctcccaagcagctgggattaaaggtgcacgccaccacgcccagctaattttttgtatttttagtagagatggggattcaccatgttggccaggctggtctcgaactcctgacctcaggtgatccacccaccttagcttcccagagtgctgggattacaggcgtgagccaccgtgcccagcctctcttcccttttcttcagagccacactctgtctccacttccactaaccttctctcctcaatctgtagctgaatagcttctaccctatcaaggtgcgcagctttgacggggaccctccagatctccaggtgcccttgcctgtcctcaagctgtctgcttccgcatctgtctgcagttactgctggtgttgctcttctcctgcatcctccacggcttcttcagtctccttcatggagcgttttctctctgacccttagtggttcatgttcaccaaggtttggtccttagctgtcttcccacttcatatactcaaaagcagaggattttatctgctttgctggcttcaaccagcagccacataccacttccttctgaatctgaatgttatgtcaaaccgctctcctcatatcccgttgaccactggacatctccctcgctgaaaattgactccttcccgatgcctgctcttccaccgaccccccacctttcttaagttagcaaaaacgtaacacataatatgtgctaggcactgttctaaacacttgcaatccgctgaggcaggtattattactatgtgcattttacagatgaggaaacaggtgcagaaaggtcataaccttgcctgagtctcacagatgctgagccagaatttgtgatggctccagagatggtgctctcaacaaccactgcatgcagctgcctgtgttcaagtcctcttactacccttttaacatagccgatgcacagatgtgggtcaaatatcagagtatacaataccatcaaaccaaagtctcccgctactaccctaacccacctggctcccctgcacatgtgaccactttttttactttctggatgatccctcctgcaatcttttatgcacattccaccctgcacaaatatgctgtttactattttttcacctcttcccccgccccaacccaagatagtagcatcccactgtaaacattattccacatttaagttaggggaactgaatgttccgatatcagtttgtaaacagcttccttgttttattgacctgctgtatactactccatagcatgcgcatatcacagctgatttccccatcccactattgatgggcattttggtcatttctctcaagcagggcagcagcaaacatccctgaacatgacttcttgggatgcaggcacaaagatttttctctattatgtataacagcagcagacatcatcttattctcttttggtctgaaaaataaataacaatacacctccttcctgccacccaatctccaaaacatttcccagctttttctcacatggtcctatggtgctagttctcctcacttggctcagtaactcccaactccccctccaaccattacatttcatatggctcttttcctccagccttgcatgggaacttcagtggagttccatggctggtgaacactgggcatgtccacccatgcctaactacaggaatcttttctttttcttttttttttgacttatgagtgtggggatgagaggatttggggctcttcctggggacttccgtatcactggtgcccactgtccctccccaggcagcggttctgacgtcatggtgagtgactgccgaagtaaggagcagatgagtgattgttcaaatacccgaacttctccggtgtctggcttctggatattctctcaatactgcttcctggatttctgcaatgaccctcaaaacagagggctctatactccttagtgtgactgcagcaaactttggtgtaaaattccaccagtttccagccaccttcctgacttctatctgggcttggccaggacttctagtccctcataccagccctccttgcctccctccagccactggaccccagccttggctcttcctcttggttgacgcccttcagcacacttactgctactctgtacccccagccctactgcccaccaggtttcctctcttgtcccctagtccctggatgtttctcccaaataaatttgtgtgtaaactgtt

SEQ ID NO: 38571 - DNA, 29570 bp, Homo sapiens
gcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggtgagcgccgcgggccggggaggcgcgcgcctggtgcttgtcctgtggggctctgggcggccgaggttggcggtccgggcccgccgctcgctcgcttcagggctcttcaaggcgcccccggcctcggcaccctgggcccgctcggcgtggaggcggccggcgcggggtccgctgcgctctgcagggcgggttcggtcttcgcggttctccctgaacttgtccatctttcccacgcccgcgaagcgcggaaacgcacggagaccgagcctctcgtgccgcgcaccacagtccgagtaaacagcggtcgtggcgggaatgatcagaagcgtttcgagagggttttaggcgttttcgaacctgcccctctgagggtcaccgagcagccggtgcaggggcggaagcgggtgacggctgctgaccggcgccttccgcggttgtctccaggccatggcaacaaccgcgcagcgcacgcaggggggttttgtagctgttattgccggaatgggctcctgtggatgctgctctgtggctggcacttctgcgcgtgacgccgtggcaggaggcttcctaacattccatgggtcgttcatccccggtggtggctgcgtcctattctaagtacacctgtgtccaggggaattcgcctgtggggtgaaggctacagttgcttctgcttttttattattgtaaacaatagagatgtgtgtgtgtccttcagtacctgtttcactagaagggttagaaggatagaaggccaggcacggtggctcaagcctgttatcccagcaccttgggaggggaggccgaggcgggtggatcacctgaggtcagcagttcaagaccatcgtggccaacatggcgaaacccagtctctactaaaaatataaaattagctgggtgtggtggcgcacacctgtaatcccagctactcagaaggccgaggcaggagaatcgcttgaacccgggaggtggaggctgcagtgagccgagattgcgcccctgcactccagcctgggtgagagcgagactccgtctaaaaaaataaataaataaactaaaagaaaggatagaaatacatgagcttcattggtcagaatgtgcacattttcttaagggagacgaagtaaaagttcattgataatgttcctttgcttttttaaggaatgtagtaagaaaacaaaaactgatgaccaagagaatgtgtcagccgatgcaccgagtccagcccaggaaaatggagaggcaagtagatttttcagttttgtatcagcccagagtaaactactgctgctgtttttctctttgggggctcacagcaccgtgcacatcactgctttaaagaagactgaagtacgcgggcatggtggctcacgcctggaatcccagcactttgggaggccgaggtggacggatcacttgaggtcaggagtttgagaccagcctggccaacatggtgaaaccttatctctgctaaaaatacaaaaattatccaggtatggtggtgtacgcctgtaatcccagctactcaggaggctgaggcaggagaattgcttgaccctggaagacagaggttgcagtgagctgagattgtaccactgtacttcagcctgggcaacagagtgagactctgtcccaaaaaaaagactgaaataggccaggcgtggtggctcatgcctgtaatcccagaactttgggaggccgaggcaggcggatcatgagatcaggagattgagactatcctggctaacacagtgaaacctcatctctactaaaaatgcaaaaaattagccgggcgtggtggggggcgcctgtagtcccagctactcgggaggctgagccaggagaaaggcgtgaacctgggaggcggaacttgcagtgaggcaagatcgcgccactgcactccagcctgggcaacagagtaagactccgtctccgagactgaaataaacttgaaggggctaataaagacatgtgtgagacagtccatcagtggcacaaggcctgtcttctcagaacacactacaccaaaacacactgcattgggaacaaagaaaacgtggtgtaatactggatttcttcttttaattttttttttccccttttgagacagggtctcactgtcacccaggctggagtgcagtggctcactgtatggctcaccgcagccttgacctctgaggctcaagtgattctcctgcctcagcctccctagtagctgggactacaggtatgcaccaccatgctcagctaatttatttttatttttattttttggtagaaatggagttccactatgttgcccagattggtcttgacctcctgggctcaagtgatcctcctgcctcagcctcccaaagtgctgggattacaggcgtgagccactgcacctggcctctcttctaattcagttcttgtttttaaattctccttagctagtagctatggtctctgtttattggatacataacctgagcctggctctcaagaatgtgattttacagccaggcatggtggctcacacctgtaatcccaacactttgggaggccgaggtgggtggattacctgaggtcaggagttcaagatcagcctgaccaacatagataaaccccatctctactaaaaatacaaaattagctgggcgtggtggtgcatgcctgtaatcccagctactcaggagcctgaggcaggagaattgcttgaacccgggaggcggaggttgaggtgagccgagatcacgccactgcactccagctggggcgacagagtgagactccgtctcaaaaaaaagaatgtcattttacatgcagtctcatttcacgcccagaaggaacattacatgtaagcctggccattatccctgttttactgagtgaagggtgttgggagaggttaaggtcagtctacccttagaaagtactagtaccagtttataaatggagagttggcaatatggcagaagcatattttttccttaagtttagtagtcctgacatgtttaatctgacaggtgttctcccggttgccctgtgtgccagtgctgtggggactgtggggcttagggagcaacagggcctgagacaagcagccaaagagctggccacaggcagaagagaggtagggtgcattggagccctggaggcagctggggccagtgcgcctgagtggccgaccccaggggcctccctcacctgccctctggttgtgtcgttgtagacagatatctaagccctgtgagcctcgtttccttatcagaggcctggggagtagggttacctccctcccaggactgtggtgaggatgagataacgtgtgtacacagcctaagtgggcgccctgccaggtcagtgatggacacagggtgagaggagttgggttggggttaatggagtggaccctgaagagtggtcagaattcagggtgggagtgtagggaagggcactggcacaccaggcaagaggagggtgtggacagacgtgctctagggagagacagtggctccccttggccaggtcaatgacagtgcagagctgtggagaccgtgagggggtgactcaggtgtttgttttagggcaggtgatggaggtaaccgacttaagctggctagagtaggggaagaattgcaggaagccacttgggtggcagctttgagagcctaggcagaggtggtgggcctgggcaagtctaccagagtgatagagacagaacagaggacgtagtgcagggaagggagtgcagttttagctccacagacactgggccttctacggtgtgtgagtctggggtttggtgagagcactccgctggaagtgcaggtggcagggctgccctgggctgagtgaggccagcaggcctgataaaagggaacaggacttctgtagaatgcatcagtgtggaaggcaggaggaataagaagaaagaatgtgaggggtgaggagggaatcagacctggaccatgaaaacttatggaaggactgggttatacacagcatgtctggtggcaaggcagggaggaggcactgctgggtgaggggggcagtttggtcatgggcatctcagtggggatgggctgtggaggcacaattcatgcagctatgggcaccagatgtttggagtggagctgtggctttgacccactgggaacttgttagaagcacaaactcttgagccccatgcggacctcctgagtgcccatctgcagcagaacaagatcccaggttgagtgggctgcacagagacatggggtcatgtgtaggcaggaggcagaggtgacacccgagctgcggttcgtagcacgctgtggaaggaggaggcacatccatagccgtctcctgtcaaatcaagttttaaagaaaaacgaatgcatggactacctgaggagcttctgtaatttattgacattactcctgtaagcttcagagtattcatatgttcatccaccagttatttattgagcactgtctgtgtgcagtacctcttggaagtgctgaggaacaagagaacaagacagtgttcaagctctcatgagcttacattttagcgaggagggacagactcctgctagcagtcagcaacataagtacagatgggtggggagggaagagacgggtgagggggtggtgctgttttagcaggtgttggacatcgtctctgctgaaggccacccagggtgagcctggggctcttagaggttgcttcatgcagaaggatggcgagagcagcaagggccagtggggctggacgtgtggagaccaagggggctgtgatgggacccgggcagacaggggccactggctttgcccaggccctctgtgtgaggggcagctgtctgagcagagcagaggtgtggtttatgttttagcagatgtcggggagcacaagggccagtcaggaaggagagggtggaggggatcaaagagtgactctacatccaggtcaggataagcatcttgttacatgtccgagtgcaaacccagagccagcactgagttgtaaagttctgagcctcaagggagaggccagggctgtgggtggcctcagggagccgtgggatggtaagagggggcacagagctagaggagcagtcagagggctggatcacaggcaccaaagaggaaggggtctaggaggaaggggtctagcagtggggtgagcttccagaacacaggggtcatttacttcctaccacgtgacagtgctagggctgggttccacccttgtcatctgcatggttccctagtgtcattgtgggctgggccctgtgtcctgtgtcccttcaccaccttgagctgctcagtggcagagactgtcctgcttccagccccttgagcaccaggcctggaccctggtattatctccaatgtttactgtgaattctgtatatgggtgttaccctctctaaagaagcacattaaagagtatttgttgaataatcatgctgaaacgtcatctttcatagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaaggtaaggcattcggggcatttgctgatgctggggagctgacctggaggaagtggaggtgaggcctggcttcctgcacagaagcctctgctgggacatcggatgcacatctcagccttttcctggtgttgctaacatcctgctttgaccttccaaacctctccatcaagagcaaaatccccgcacaatttcctgctcccttaataatgctcaggcagtggtggggggctggcatcacccctcaggctcctgtggcttaagcggggcctctgcctggtgaggtcaggtaacacgggtgttggtgatcatgcgggcagcacagagccggagctcctgctgttctgcctcggctgcacgttttcggacacgagagttatgttctaatagaccgatcagcttggggcaaggcagagacactccaaggaagtaaaaattcccaaagctccttccttcagctcatccctgcagacctcctatacagaacgagaggtgccacttgtctttccgtgagacaggttgtattagtccattctcacattgctacaaagaactacgtgacactggctaatttataaagcagagaggtttaattgactcacagttccacaggatctacaggagacatggctggggaggcctcagggaacaaccatggcggaagggtgaaggggaagcaagcatgtcttcacgtggcagcaggagagagcaagtaaagggggaggtgctgcacccttgtaaacaaccagatcttgtgaggactcactcactatcatgagaagagcaagtgggagatccgcccccatgacccagtcacctcctgccaggcccagccttcagtttcacatgagatttgggtggggacgcagagccaaaccatatcacaggtgaaagagaaagagacaaaggcagatgaggctgaaaagcacttcttggtttccatgctgtcacctccacgggaagcaccggcatcctaccctgcccagggtgtaggagcccattcacagtaggtagtgtgctagagcaaggtaggggcctcaagaaacactgactggcacaagtgggtggcataggggacagccaaggagccttctcagcgtttgccattcacccccatggcttctggacaagtcatccagcagcaattagatcacaatatttttctttgtgagacagggcctcacccaggctggagtgcagtggagagagtctcagtggggagactctggtgatcctcccacctctggaggctccctgtagcctccagagcagctgggactacagacgcgtgctaccacacctgcctaatttttgtattgtttgtagagacagggttttgccatgttgcccaggctggtcctgaactcctgtgctcaagcgatcctccagcctcagcctcccaaagtgttaggattataggcatcagccaccacccatgacctagatcacaattgcagatagagacacatgtcctctgtgttgccagcattagttgtgtctgggtgtaccctgacttatatgcacttgcacgggaactccgttagcaagcagcaggctgcctggataggatggtctgaaccaggagatgccccccacccatcagccaggttcgccatgcatacccgtccccacctgctcacccttggcctttcagggaacagaatggcttcagccattttgttacgttgaacagacttagtggatacagctttgcagactactagagacttaattctgtggtgtcaacggtttttgcaaaaacccttgaaagtgtctgtgtcactttatgcttccctaagtgataggggcaaacagctgtgtgcagccatcctggtcacattcaatatcaaattcagttttttcccccctgatacatagagaattgtatctcatttgcattttcttgcttatttagagaagttggttaccctagatgatgtttattgacagtttatattttatcttatgctgcttgtccagtctacaacttatattttagtacggtgtgcgatgtgaatacattcttcttccttttttttcttttctgagatggagtctctcactgtctctcaggctggggtgcagtgtcgtgatctcagcttattgcaacctctccttcctgggttcaagcaattctcctacctcagcctctcaagtagctagagttacaggcaggcaccaccatgcccagctaatttttgcatttttagtagagatggggtttcatcatgttggccaggctggtctcgaactcctgacctcaagtgatgtgctcgcctcggcctcccaaagtgctgggattacagacgtgagccaccacacccggccagatacattcttttctatttgaaaaaatcaaattgttccagcatcttctgttcttcccctgttgacctgaaatattatcctacctctcttatatattgatagatgtgcatccatttgtttcttttttttcggccttcaccatgttggccaggctggtcttgaattcctggcttcaagtgatccacctgccttggcctcccaaagtgctgggattacgggcataagccaccgtacctggccttcttttttttttttttccccattacttccaccccacccttgtactgcgtgtctatttcttgacccttttttgagatggagtctcactctgtcgcccaggcttgagtgcagtggcacgatcttggctaactgcgacctccacctcctgggttcaagcagttttcctgcctcagccccctgagtatctgggattacaggtgcacaccaccatgtctggctagcttttgtatttttagtagagatggggtttctcccttttggccaggctggtctcgagctcctgacctcaggctatccaccagccccggcctcccaaagtgctgggattataggcatgagccaccacgcctggcccttgactcttatatctgaacctgtcttctattgcgctgccaacatctagtttatgctagtttatgcagtatttttttagaacagtttgtagatgaggcttactcacaaaacatcttaggcctggtaactttttttttatttttttattttttatttttggagatggagtctcactctgtcgcccaggctggagtgcagtggagcaatctcagctcactgcaacctccatttcacttcaacctccacctcccgggttcaagcgattcttctgcctcagcctcccgagtagctgggattacaggcacatgccaccacacccagctaatttttgtatttttagtagagatgggtttcgccatgttggccaggctgatcttgaactcctgacctcaaatgatccgcctgcctcagcctcccacagttctgggattacaggtatgagccaccatgcccagccgggctgatgacttttaagaggcatctctggataccattttagtgtgtctgttttttttattgttgtgtagtaatttcacttattcattggccaatgttgtaatttgtattttccctttaaaattatttattttttccagatattcacatttactgatataacattgttcttgaaattgacaaagtcttttagatctgtagtcttgtctcttttaagacagagtattggccaggctaggtggctcacacctgtaatcccagcactttgggaggccgaggcaggtggatcacaaggtcaggagtttgagaccaggctgcccaatatggcaaaaccccgtctctaccaaaaagacaaaaaattagctgggtgtagtggcaggtccctataatcccagctacttgggaggctgaggcaggagaaccacttgaacctgggaggcagaagttgcagcgagctgagatcgcgccactgtactgtagcctgggcaacaagggtgaaactctgttttttttttttttttactgtagcctgggcaacaagggtgaaactcttttttttttgagacagagtattactctgtcactcaggctagagcgcagtggctatggctgttcctaagtgtgattatagcgctctgcagtctcaaactcctggcctcaagtgatcctcctgtttcagcctcctgtgtagctggaactgtaggcatgcaccactgaagccagctcatgtttcattttttaaatcctgacttttaaaaaaatatttaccagaagcccaaacctcaccataatcctgattttttttctcctttttcttaattatgtttgccagtgtttgtctattttattagtctttgcatagaccatctattaacgttgttctgaatttctcattaaggtgtgtaacttttactccttgtgtaatcagcagatacctaacattctctatttctccttctagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggtgagtcatcttttgataaattgggaatgtataacttgagtttataagcgccctttttaatctctaaagttcgtttttcaaggacgcagggtagataagcaacttccaaaagagtctcttggaacgtaaaaagaccatgtcccgtgtgtcatgaaacccagcctctgatcgatggtagacgagtgtcacttttctcctttgctgtgcacagacaggtgttttgttacacagtgggagctgacccctctgggaccaaacagtgaccaccttctgacaacacggacaggacactgggagattcccacactggcccagcaacctccaagtcaccccttacccccagagggtgtgcatttgataaacagtcacttctgaaatgattagtatctggtttcccaagaagctctctgaagagcagagcagaaagggaatgggcttgtgttctttacttgaggaatgaaaggtagaaatttaagaatataataaaagaactcggatgtcaacgctggaatagtactacctgaaatgttgatggatgatgcttctgcgtcttctgctttggtcaaaggggaactgcctccctccatttgcttatagaggggcttttacagccttgagcatcctcatagcatgatggtcagtgtgcaagttcagaaagggaaaatgagcgagttgccaaataagaggttttttttgttgtttgtttgtttgtttgtttgttttttgagctggagtctcgctcttggtgccccaggctggagtgcaatgatgcgatcttggctcactgcaacctccgcctcccgggttcaagagattctcctgcctcagcctcccaagtagctgggactacaggtgcgcgccaccactcccggctaatttttgtatttttagtagagatgatgtttcaccatgttggccaggatggtcttaatctcttgacctcgtgatccacccgccttggcctcccaaagtgctgggattacaggcatgtgccaccgtgcctggccaagagtttttattattctacagcggcttttaaaaattataaatattggtcaggtttggtggctcatgcctgtaatcccagcactttggaaggccaagaccagaagattacttgaggccaggagctcgagaccagcctcgacaacataacaagatcctatctctgctaaataagtacataaatgtagatatattggggattactggtgaaataaaatgatatttggaataaggatcatcaggacaggcttgaagtctaagcagcagcctgggggtcctgatgctccctgtgccctaggcgcctgggctctaacaagacctggtcatctagcacataatgtgctgcagctgaaacccagctacagcgacaggtgcccacacgttaggtcgctccttcatgcttgtcatcataaagcctcgggttaggttagttacactgaagatcagagttgtcaaatgctatatattctcacgatgaaagcccttatttggggctagattcttaaaatgatgtaacggaatgttatatatcaataaaatgtatccacagtaaaatggatttcttaatgtaatattttaaaatttataatatttctttttttgttgttcttgagacggagtcttgatctgtcacccaggctggggtgcagtggcgccatctcggctcactgcaagctccacctcccgggttcacaccattctcctgcctcagcctcccgagtggctgggactacaggcgcccgccaccacgcccggctaattttttgtatttttagtaaagatggggtttcaccatgttagccaggatggtctcgatctcctgacctcatgatctaaccgccttggactcccaaagtactgggattccaggggtgagccaccgtgcccagcctaatatttattatagctagttgcattttctctcagctttgttacctggggagggggagaaacaaaaaatttaaaattaaaaaaatcaggccgggtgtggtggctcatgtctgtaatcccagcactttgggaggccgagggggcagatcacctgaggtcaggagtttgagaccagcctggcccaacatggcaaaaccccatctccactaaaaatacaaaaattagcctggcatggtggcagacacctgtaatcccagctactcgggaggctgaggcacaagaatcgctcagacccaggaagcagaggtttgcggtgagttgagattgcgtcaccacactccagcctgggtgacagagcatgactgtctgaaaaaaaaaaaaggctgggcatgttggctcacgcctgtaatcccagcactttgggaggccgaggtgggcggatcacgaggtcaggagattgagaccatcctggctaacgcagtgaaactctgtctctactaaaaattcaaaaaagtagccgggcgtggtgacgggcgcctgtagtcccagctacttgggaggccgaagcaggagaatggtgtgaacctgggaggcggagcttgcagtgagccgagatcacgccactgcactccagcctgggcaacagggcgagacactgtctcaaaaaaaaaaaaaaaaattcagtataaaaatttaagccattataaaagtatgcccttgccgggcgcggtggctcacgcctgtaatcccagcactttgggaggccgaggcgggcggatcacgaggtcaggagatcgagaccatcctggctaacacggtgaaaccccatctctactaaaaatacaaaaaattagccgggcgtggtggtgggcgcctgtagtcccagctactcgggaggctgaggcaggagaatggcatgaacccaagaggcggagcttgcagtgagccgggatagcgccactgcagtccagcttgcgcgaaagagtgagactccgtctcaaaaaaaaaaaaaaaagtatgcccagccattctatacttttactgtacgttctacttttaaacacatcaagaaccatcacagactgaaatttaatttgcctgtgaattggaagggaatgctgtgggtacgttgtaatatttcattaatttatatatggagtaaggtgttttaaaatgtagagagggaagaagcatgagagagaacatacatatttcattgtgaaaaatcatacacgctcattgtttacaaaataaaaggtaaagcacacggtcttgaacttaggccgttaggaatagataagaaccaagactgattttattatcttaggagggatgcctgtagaatctatgctttaagtttgtctcttaaacgtgagaaagcaaaaatgagtaagaatgaagaagtattggctggatgcagtggttcacgcctgtaattccagcactctgggaggccaaggtgggtagatcacttgaggctaggaattcaagaccagcctggccaacatggtgaaacctcatctctactaaaaaatacaaaaattggccaggcatgatggcgggcacctgtaatcccagttactcgggagactgaggtgggaggatcacttgaacctgggaggcggaggttgcagtgagccgagattatgccactgcactctagcctgggtgacagaacgagactccgtctcaaaaaaaaaaaaaaagaggaagcctaaaagtagatcttttagtacgtgatttaagctgaatatgctcctctctcctgcaggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggtgagcccctggacccccgctctgttggcctgaggtgccaaaagaggtttcacaagattctgcaggctctagatgaggttggaggcagacagacccatcccacccagccttgtagaccaggagggaagagcttggcctgattcacagagggtgtttgatgttttgggacagccaatttagtttttcatcagaggtgccacactggaaaggccagtatggttatttatttaattttattttatttttattattttttttttgagacagagtctcgctctgtcactcaggctggagtgcagtggcacgatctcggctcactgcaagctccacctcccgggttcaagcgattctcctgccttagcctgccaagtagctgggactacaggtgcacgccactgcacccaactaattattgtattattagtggagatggggttttgccatattggccaggctggtcttgaactcctgatctcaggtgatctgcctgcctcgggctcccaaagtgctgggattacaggcgtgagccactgtgcccagtctaggcagatctcttgagcccaggagtttgagaccagcctgggcaacatgtctctattttttttttttttttggagacggaatctcagtctgttgcccaggctggagtgcagtggtgtgatctcggctcattgcaacctccacctcccaggttcaagcgattcttttttttttgttgttgagacagagtctcgctctgtcacccagactggagtgcatcctgcctcaccctcccgagtagctgggactacaggcgcctgccaccacacccggctaatttctttttgtatttttagtagagacggggtttcaccgtgttagtcaggatggtctcgatctcctgacctcgtgatctgcctgcctcggcctcccaaaatgctgggattacaggcgtgagccactgtgcctggccaggttcaagcgattcttatgcctcagcctccccagtagctgggattacaggctagcgccaccacgcctggctaatttttgtatttttagtagagatggggtttcgccatgttgcccaggctggtcttgaaatcctgacctcaagtgatctgcccgccttggcctcccaaagtgctgggattacagacatgagccaccacacccgtcctctaattttttaaataaatattttttaaaaggaaaagaaaaataggccaggcatggtggctcacagccataatcccaacaatttagaaggctgatgtgggaggattgctttagcccaggagtgtgggaccagtctcgtcaacatagtgagacctcgtctctgcaaaaaaaaacaaaaaaaagccaggggtggtggcaagtacctgtaatcacagctactacgaatcctagcctgaggtgtttgagccaaggagttagaggctgcagtgagctatgactcctccattgtactccagcctgggcgaaagactgaggtcctgtctcttaagaaaatccgttttctcttgaaagtacaacatatctcagatgtacaaataattatggaataatatggcaaacgtgcatgtatcttttgccagcttaaaaaaaatacagaataagaaaatttctttacattgatattcagatactctcagggcgcactgtttaaaccactctttaattggtttttggatgcctgagttatagaagagatttgtcacatgcttttcaattctggaaaaatagagagtttgggttaagaaatcttcgatgatgcataagggaataaggaaggaatggctatcctggcaaacaacactagttaaaaattattctactacatgaggcctgtgggagcataggagagctctatctaagctagtcgtaggctgtataatttttagggtttggttcacgtttcagttcttaatttatgctccccctacaatggtttcaaatttttctggcattttacatgtcaacctttagtcattaggattatgaattaataagatggaacattgacatcgtggttgcttagaatacggacttactctctagccatttataaaatataaagaggaaatttaccatctgttccatgggctgcattggttggctcgttatttgagctgtatcgttcaccagcaacccacagcctgctgtgatctcagctccagatggggacagggatgttagtgacttctttcagctgtatggtttgccttactgtaagtgattcacagatttttgtatcagaggtcgaagtataagccatttgacgccagatacagccttttactagattgtgggtgttacattcagctcttgtggcattttgggtgtgtttccaggtgtaaagggataatttccacacctgatggtttctggggctgcctggactccagcaacctgggagtacctggtgtttgtgtgctgagcctgagcctgcctctgtggtccccttgcaggagtgctttccttttgggaccctgttacatgataccacacacaacatggcttcacaacaccagtcacacttgcttagttccacccccaaccaaggaagaggccgtgtaaaatgacaacgaactaaggcccatgcccctggagcagtggtttttaaattataaaaaatttaggccgggcgcagtggctcacgcctgtaatcccagcactttgggaggccgaggtgggcggatcacaaggtcaggagattgagaccatcctggctaacacggtgaaaccccgtctctactaaaaatacaaaaaattagccaggtgtggcgggcacctgtagtccctgctactcgggaggctgaggtgggagcttcactggaacccaggaggtcgaggctgcagtgagccgtgattgcaccaccgcactccagcctgggtaacagagcaaccctgtcaatcatacatatatactacatacatacagcaaatctcaagctaaaataggaagcaaggggctggcctgcagccagtggctggagaagagaaaggatttggtgacacatttctcagaaatgccgtcactgagaagagacctctcagggcccctacctagcattgtgttcactgccacaggcggagggatcaccgtttctatacaaatcagcaatctgctcaggattcacatcagcagagttagttccttcagtgacttgagaaggttccatcccagtaggacctctcataaggaaatcaacaaatgtaaggagactgcaaaaagtttgtggaagaacagaattaaaagataaaaagtataaactttatttctcaacataagctccatcctggtcaagacttttttttattttttattttatttatttatttattgagacagagtctcgctctgtcacccaggctggagtgcattggtgtgatcttggcccactgcaacctccatcccccaggttcaagtgattctcccaactcagcctcctgagaagttgggattgcaggtgcatgccaccatgcccagctaatttttgtatctgtagtagagacagggttttaccattttggtcaggctggtctcaaactcctgacctcaggtgatcgcccgcctcagtctcccaaagtgctgggattacaggcacttgccaccatgcccggctaatttttgtatttttagtagagacggggttgcaccatgttggccaggccagtctcaaactcctgacctcaggtgatccgcctgcctcggcctcccaaagtgctgggattacagcagtgagccactgtgcccagctaacacttttttgtttgtttgtttgttttgagatggagtctcgctctgttgcccaggctggagtgcagtggcgtgatctcggctcctctgcctcctgggttcaagcgattctgctgcctcagcctcctgagtagctaggattagaggcatgcaccaccacgcctggctaatttttgtatttgtaatagagacacggtttcactttgttggtcaggctggccttgatctcctgacctcgatgatctgccttccttggactcccaaagtgctgggattacaggcatgagccaccacacctggcgtttttgagacggagtttcgctcttgttgctcaggctagagtgcaatagcgagatctcagctcactgcaacccccacctcccaggttcaagccattctcctgcctcagcctcccaagtagctgggattagaggcgcctgccaccacgcccagctaatttttatattttcagtagagacagggtttcaccatgttggccaggctggaatagaactcccgacctcaggtgatccacccgcctcggcctcccaaagtgtgctgggattagaggtgtgagccactccacccagccaacagttttttaagcaggatcttactttgttgcccacgctggagtgcggcagctcaatcatggctcacgagagcttcaacctcttgggctcaagtgatcctcccatcttagccttccaagtagctgggaccacaggcgtgcgccaccagctaatttttatatttatttattttttttaagacagagtcaggccaggcagggtggctcacgcctgtaatcccagcattttgggaggccgaggcgggaggatctcctgaggtcaagagttcgagaccagcctgaccaacatggtgaaaccctgtctctactaaaaatacaaaaattggccacacacggtggcgcacacttgtagtcccagctgcttgggaggctgaggcagaagaatcgcttgaacccgggagccagaggttacagtgagccaagatcgtgtgactgcactccagcctgggtgacagagcaagactgtctcaaaaaaaaaacaaaaacaaccaaaaaaacaacacagagtcttgctctgtcatccaagcttggagagcagtgatgcaatcatagctgactccagcctcgaactcctgggctcaaagccatcctcctgcctcagtctcccaagtagctaggactacaggtgtgcaccaccacgcctggatgatttttttatttttctagagacagagtctcaccgtgttgcctaggctggtcttgaaatcctgccctcaagtgatccgcctgcctcacagtcccaaagtgttgggattacaggcgtgagctactgcgcccggccctggggcatttctctctgtggctgcttctgtgtctctgtgggtgtttcctgagcacacacgggcgtctttataggtgaaactttgattgttaaatgggattatcatgtctgactgtgggacatgagctgcctctcaccctctgggcgaccttccccgccaggagtagagtctcccaaggtatctacccagcccctgtttgagggcaggttgcgtggctctcatgtacacaggtgtgcaagtgtctgtggggtcaggtcctaaaatcagttgccaggtcagcaagttctgtgatgttcttatgcactctgactgggctgtacgcctgcgggaaaggagtaggcagggctcctgcggtggaattgctgttgtgtggtcagctgcagtggtgacttgtgttcaccctggaaaccacagcagcactcaacctcaggaaagtgctcagattgtgcgggcatgtagtgacactacagatgttgctatttattacgacttgaggagtatagatttcttatattttaaaaagcgtgcagttgttgggctgttagtttctcgccggtgagagaagttgggcaagcatgtggctgctctcccctgagcggtagctgcgtgtcctggctgtaaggacgctgtagctggccaggcgattttgcacggtgcagcctgggccgctgctcctgctgcctttcagtgcttgttccccttcacctttttgggggacctgttactccgactcttacttgtctgtcggccttgcagggatgctcccatttcccagtagcctccaggcctgcaggttcccatgacccacagccgggccaccgaggacgggttttgggtccagcacgagctcctggtaaggcctggggaaaaggtgttctggcttcaccctggggcggcagggactcgagctcagcattccctggtgcgttacaggaagaccagaggaagcagtaaggagctgaccgtggatcccttctctccccaggctgggtccgatacgccgagcgggtgctgggtcgccccatcactgcccacctctgcaccgccaagtccccccagcaggtcatgggctctttggtgaaggattatttcgccagacagcaggtaagctgacctctctggagggcaggaagggcaggtgagggaggaccatggcacaggggcccaggaaggggaggttccccatctgtccagcgtggtcacggccccccaggtgagcaaaaaggaagctgtggcttcaggaaacatcagcagtgctgtttctcaccaacgcccgtctctattcctcccttcctcttacaacctttttctttcttcttaaccttttctgtggcatctggtggttttcctgggcccattcggggtagagtagaaatgctgcccaccctgctgagaatgaggccccggaccttgcccagagatgctgcctgcctgctgttgggatgcctcacccaaggaggcctaaagtggcctgtgcctggaggctgagggcagctgtcatttagggagccaaacctggcctctgccctggcctttccctcagaccacgggcatcacatgacttccttagccacttctgtgagattccacagtggccatgatgctgtcctcctcttgatggagtgagtcccggcctgaggctcctgcgtgccccctgcctcggcccgtcgtgttctcccttcccacaaccctctgcggcccccaggtcctcccagaactccctgatgtctccaaggccaccctcaaagggaccctaatcccatggtttattctccagccgctggcatgccccacactgctcttctcaatcagactttacacctccctccggggaagcagccatgtccaggcactgtggtaactggagtagagggtaacatcaggatctttcagacatttgaagtcagcctaaaaaggcacgcacatttggcagccttgttattttagcaataggcagtgttttccttctatctagtttctttctacccataaagtcataatttggcaaattataaacatgatgtcagagtatacacgttcagtttaggcaggaccgaaaaatgagctatgggactttctgtcccttgccctgcccccacctgaagagagccatgtgtttctaggtcttccacgtgctgccctctcccctggatggagcccagagctatgtgtcctcctgtaggtgccatgaggggcagccgcagagacccggcctccagcagcctctcacctgaccacctggcacagctgcaaccaggggcgggtttcctcttttgctccgcccctgccctgagtgggtcctttccacccagacctcaccacagggtcacttggcaactgctggctcctggctttgccaccagttcaggcccagccacaggcacctgctctgtgtggacccaggagaggggtagcttgggtgggcatcgcttgggaagattcaggaaagtctgtgggtgaagtagccagcgcgcgcacacacacacacacacacacactcactcaggcctcctgcaatggctccatgctggaccagcaacagctccacgccggctggacttcctcttacttgttttgtccccatgtgcacaggttcaggaggaaatgggctcagccttcccggttcttccaggaggctccactggctggggggctttgcagatgtttgggaggaccacacccagtcctgagggaggcagcagacagacatggatggagtgctggtgctcggtagagttgaagaggggatgggagccagatgtggctacagcactttcatctgtggggcccggcctcagacccacaacagtcccagccccaagaaagtgctgcatgcagccaggctcgatggctcacgcctgtaattctagtactttggaggccgaggcgggcagattgcctgagctcaggagtttgagaccagcctgggcaacacggtgaaaccccatctctactaaagtacaaaaaattagccaggcgtggcggcatgcgcctgtagtcccagctactcgggaggctgaggcaggagaatcgcttgaacccgggaggcagagtttgcagtgagctgagatcacgccactgcactccaacctggtgacagagcaagactccatttcaaaaaaaaaaaaaaaaaaagagtgcagcatgcagtgtctggagggcagcagcagggggcattcggtctcccatccctcttgttctgggcaccaagcgtaagctgccgtcacctcttcaccagccctaaatatgggtgcccctctcccacagaacctgtctccagagaagattttccacgtcattgtggccccttgttatgacaagaagctggaggctcttcaggaaagccttccccctgctttgcatggctcccggggcgctgactgcgtgttaacatcaggtgagaggtgggcgggggtgcacctgggcgctggggtaatctcctactggccagtacacaccagagccaggcagatctgtgtcccagagccatctcagtgcctgccaatgtggtcgcttgtctgaagttactgacagctgagggtcctaggggcttaactgcaggtgaagagaagggtcatgttcgatctagcctcctgtctcctctgtgcatcttcctcaagataaatcaggtctcagctgggcacagtggctcacgcctgtaatctaagcactgggaggccaaggcaggtggatcacctgaggtcaggagttcgagaccagcctgaccaacatggagaaaccccgtctctactaaaactacaaaaaactagccgggcatggtggcacatgcctgtaatcccagctgctcgggaggctgaggcaggagaatcgcttgaacccgggaggcagaggttgcagtaagccgagatcgcgccattaccctccagcctgggcaacaagagtaaaactttgtctcaaaaaaaaaaaaaaaagataaatcaggtcctgggagaaccacttgggcagtgtggtggccctaactttacattacagtccatgtaaggtacttatctcttggtgggaaagttgtctatagccatagcgggtctcctaatcacaaaccaagtctgcacttaaaacacaagtgaagtttttttcattcagaataaaatgaaaaaggcacgtttgctccagtgatattgcctttaccacggtattggccactcctttcagatgttaagagcctacagtgagttctgtgtgtgttgtggatggaagtgattccctggaattatgtagaacccattcagaagaatgttgacatcagttggtgggggaagcttaagactttgttaaaattctggcggaactgttttaattggtctctgaaaacaggtccctgcaggtatttagatcagtggtagatgaggcagagaggtcagctctcagggacaatctttaagggcgccaatgtccctcacaggcccctgacttgaaattctagcacgcagacgcctctggaaaggtccccaccccataggcacaggctccctgtggggtgatgtggcaggggtgttgaaggatgagggatagaagggtcctcagcacggccatccttcactctcagaggaagggcccaggggccatctgcttacgttgacaaaataaaacatgcgcggtgggctgtcagaagaaccatgtccagccatcttttttctgagtgcagatttataggaaattacgctattttcttacctgtgtttccagccatctcacagcatctaatgtgatgccacagccatagttttagaggctcagtttttctattaagggttttttcaggcatcctcatgtaaaaggaaatacagaaagtggttctcactttcagttgatctcattgcagaataaacaattgtcatataaatgtagctgggtacaatggctcagacctctaattccagccactcaggaggctatggctggaggatcacttgagcccaggagtttgagaccttgctgggcaacacagtgagacctcgtctctttttttttattttttgagacggagtctcactctgtcacccaggctctgcagtggctccatcttggctcactacaacctccgcgcctcctaggatcaagcgattctcctccctcagcctcccgagtagctgggattacaggtgcgccccaccacaccaggctaatttttgtgtttttagtagagagggggtttcgccatgttggctagactggcgaccttgtttcttaaaaaaaaaagggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgagactccatctcaaaaaaaaaaaaatgcaaccagtgtatatttcatcatcctatctctgtgagcttgttatacacaaaagttttctgtttgtttcatgcaaagtaggccaaaaaagtttacagattttccacatgggaaaatcatggagagattgtttacataaatcccacagttcaagggcagaaagaggaatggaaagaggagttagaattgaattctgcttacgttttattagtgtttcattttattggcctcactttgccctttagatggactcctgctgtgtgtgatggagatttcataagagggaggtcacccagggtcactaatgtcaaatctcctgcaggggaagaaaagttcctgtggccacctgtgtcttttcagtgtcttacttcgtttgtctgcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccaggtgctgcattcgtgcccttttgggggaaggtaagatagaagtttacagaatttaagcatctgtggggccaggcgtggtggctcacacctataatcacagtactttgggaggctgaggtaggaggatcacttgagtccaggaggctggggctgtagtgagctatgattgtgccactgcactccagcctgagagacagaacaagaccctgtctccaaaagaaaaagaccataagcatctggagcacctgcaagagcctgtgcatgggctcggcgtgactgagagtcctccgccttgcccgagcatcaggcaggccctcccaagacccctcaagatgctagaatgggactttctgcaaagtttaaacatctgtacaggatttagcttctttggtggcgaacttggattgtgatgccctcaggaagtctggtttcactctttctgtcactgtacgtcagcattcatgaaggacttgtattttctctgccttgtgaggtttggagacttgaaggaggacaaagtgacgcgtcatgatggagccagctcagacgggcacctggcacacatcttcagacatgcggccaaggagctgttcaacgaggatgtggaggaggtcacttaccgagccctgaggtgtggggcagtatccacagcctgtctgtgcctgtggttagcacgtgtgcatggtgtgcctgtatggatctgtgcatgtggcggttctatggatggagtttacactagtcaaaatcaaaaggacttttttgtgtttattcagaccttttattttgctgacattccaaacttacattagaaagtgttcttggccgggtgcggtggctcgtgcctgtaatcccagcactctgggaggccgaggcgggcggatcatgaggtcaggagatcgagaccatcctggctaacacagtgaaaccctatctctactaaaaatacaaaaaatttgccgagtgtggtggtgagcgcctatagtcccagctactcgggaagctgaggcaggagaatggcgtgaacccgggaggcagaggttgcagtgagccaagatggtgccactgcactccagcctgggcaacagagcaagactccgtctcaaaaaaaaaaaggaagtgttcttaagtcacagataaaggacttgatggatcaaaattctctgtgttcattttgtagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggtgaggcgccaagagcagcacctggctctgtctcccacgggtgctcaggccacactggtcctgcagctgccagagagatggtgctcttggccacccagagcctctctcagccctgagagctttgtagggtatggatgctcccgtggggcttgtgctgggacattctaggctccattggttttgctcttttcctcaccccatgtagcatgtgggcattctcttggggacgtgccctcaggaggcccaacatggcaccaggtgagagtcagcccgtggcggctggcttagagaacaaatcacaagagttgaggctgccctgcctaggagaaacacccctgccccgtgccaggcaccaagcatgagccttctctgtcctgagtgatgggagagagcagtgagaggtggaagcgggaaggggtgtgacccagcctgggcctgaggggctcccttgttgcgtggagggagggtgggccactgtgggctgtgatcatccaggcaagtgaggaaggatccccacctggggcagggggagtgagaggatgagaggaggccaggacacggtgggggtctccgggaaggacttgctgagggtgtgtcagggaagaaggggaccctctgcccctgacccatggtggtccatctgcgcccctggtggggaactgaggacctttgtgccattgtgagtcggggggggcaccacgagggactcgagtggaaatgccgggtgcaggtcagttggaggagcggctccactgatgttagacaagtgggacaaggtgtgaagccacaggatgggaggggcccttgggcagggcacagacaagggtgtgtccttcaacacaaaggatctcgtagaggaggggaggcctcagccagcactgacaagaggagggtgagggcagagaggggagcctgtggccttggaggcctcactgagcattccaggggcacggaagggtcagtcccacagctgggctgaggagcagccgggaggtgggccgtgaagcagggcctctgggagggcctctgtgtgcaagcgggtggagctggggcctgaggaaggagaaggtgcaagcccagccccctgggaaagtggaggttggagaccagctggggtgccaccctggaacccatggggagtgaggtttaaccagggaaatttgctccagattgttttaaatgaactcttacactactaagagtgacatcatctaacacgttggagagtaagtagcattaatagataggagacacatttttactcaggccagtgttgggtgtgtgggctcatggctgggctcacagcttagctgcctctggtgcagcctccaggcagggcccagcacactaacacgtgtggtgcaggcaggagtggtttaactgcttgttcacaattcctgtgctatcctggttttgccaaattccaagagaagttggaaatcgggatttgcatatgaagccacccagttctaaaaggttggcaacttaggttttaggtaaaaccattttatgggtgatgtaaatgggtaagaatgagaggcacacgggtccaggcacggtggctcacgcctgtaatcccagcactttgggaggccgaggtggtcggattacctgaggtcaggagtttgagaccagcctggccaacatggtaaaaccctgtctctactaaaaatacaaaaattagccgggcgtggtggcacacacctgtaaccccaggtacttgggagactgaggtgggagaatcgcttgagcccaggagatggaggttgcagtgagccgagattaggccactgcactccagcctgaccaatggagagagactctgtctcgaaaaaaaaaaaaaagaagaatgagaggcacacggggctgtgagtctgggatcagtgtccctgacagccttgaggaagaccctggcctgttcagccagccctagccttaggccacacaacattccacgtcccctttattcctctcctgcttccaactcttccctgtgaggcaaaacttccttaagactatcccggctgggtgcggtggctcacgccagtggtcccagctcgaagtaggattgccgcttgaagccaggagttcaagaccagcctgagcaacatagcaacacccgcccctcccgcccaatctctacaaaaaatttaaaaatcagccgggcaaggtggtgtgtgtctgtagttctagctgctcaggaagctaaggcagaaagatcgcctgagcccaggataaacttacctgtgtttatctttcaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctc

SEQ ID NO: 38572 - DNA, 49008 bp, Homo sapiens
gcgcgcagctggttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgagtgagtggggctggtgtgtgagggctgtgagggctgtgaggggtgagggctgagggctgtgaggggcgggcagccgggggtccgcgcctgagggaggagagcccagaaggccgcagacgcgcgcctggctcggatagtttcgccgacggcgcacctgagctgtcttttatcccggtcagtgtcaggcgcggggtgagcgggatactggcgaccagcggatcctccgctcagcaaagtggccggtgcggggcatgcgggcaccgtcttcatccttttagccagtctggctttctcataggtttctgttcaagtttgtacccccgtcccccgcccgccgcatctcccactgtctcgttttgagaaagtagtcactgctccaactttgggagtcgttctcagtgatgggattttaccttggccttcagttgcacttctcccacattctcatcgaagtgggggaaatagttgcccgcgttctttaaaattttgcccatctgtggagtgaagaaattggtatcttgctgcgagtttattttgcgtttaactactggacgtttgcgttcctttttcggtaaattgcctgtttatctttgcctggcttttagaaatttgagttgttaaatctttttcttatttgtatggaagaggtatttgaatattgaataagaatagccttttgcacgtcgtacatgtaatatttttctcactttgccttttgtgcatgttgtttttagtgcattttttggggggtagtctgtcaatttttttgtctgttaaggcttatgggttttatgttaggctggaaagctatccacactcccagtgttttaaaaaatgtactcatttttgtagtaattttaaggtttttttttttaagttaaaatttttcgtacgcttggaattttcagtactgaggtaggaggggagctagatttatttgcttttccaaaggcttagcctatgtcccaataccatttcttaatacttcctttttttcaactgatttgaaatgctgagactctttaaaagaaaccgttagtctgctggaccatttcttattaccaaactgttttggttcccctagcatttgtaatatggtttgtgctttgagatttttacacgaatagattctatttcattagcactgaagatgaaacaaggtcccaaaactatcctagtttaatttttgtgaacaaattaaataagagtacatttttactagtggacagtttaatctcttaacttcagaaagggccaaatgtgcactaatgccaatgaaaaatgttttcaacagcatcctctttaaagatagtcccccaaacataatccttccttttaagaatataggcattggtttctattggtaactgtcgggaagtgtttattactgttatttgctttttgggagaaaggaatgtgtttcagaatacactatttgttcttgaaatgagattatgttgtcttaaagttatattttcttatagaccttttcatctttgtcatttcaaatttcgttcgtcttaataaacaagaacctaaaagcagatatttaattggatattttaagggtatgttccatttacaacaaagtatacatcaatattttttctaattaaaaaaaatctatgtcaagaccgttgtctttcctgatttgctttgcctacctgaattttcttaagagaagttcatggtaagtcaaagcttgtctagttgaaatttttcccagatgttttaagtgtattataatgaagttagtaatacagtgggtaataatcaaagtgacaatagttcctggttggatttgctctgtagaatgcattaaattaggaaaaaacatgaagatacattccgtggaccaaggagcagagcacatgctgattctctcatcagatggaaaaccatttgagtatgacaactatagcatgaaacatctaaggtagggaacttttttcttttattaaaaattaattttaatcaaaagacaataataatttctgtaggaaatatctgattcttgtcccctgctttatatagtagcatcttaagtaaataataaattctgaactgaccagtaaagtccttatgtcccccagggcaggtatcatgtgttgttttggcatttaaaggaaatgattaaatagtctgcctagccctaaattggactttcctattcattaactcatttgatcctcacaataatcctataagttaaatttctggaaataaaagtttttaacctagaaaaaatacacattatcatgaaataatttgtgagacttttccctagtagattatatgaattagaactcattttcatcttgcatttattcctgcatcctaaaattgtttgcataatattttattataattatgtaatgcatattttttcttaattaaaacatagtatttaaaaaataattttagatgtactgaatgtgatgcagtaaattgaaagttttttcttgagcttcatttctaattaaatactattaatagttctaaaatccatgttgtaactttcattatggtgattaacacaaagtgtattttccttcatcaggtttgaaagcattttacaagaaaaaaaaataattcagatcacatgtggagattaccattctcttgcactctcaaaaggtaatttttctgtaatattaatagttttgtagaagtaatacctgtgtgtatatgtggagccagtagaatgtctatatttcacttgtaacaggacagaaatacagttttgaatttgatatggttccgagtacgattcttaaagtaaatacataatgagagaattcttggatctgtaaaatgttcaggtttccaaaattactattcctaaatttggtttcatgtttttatttttcaagtacgaaacagtgaaaattttctgaataatcaaaactgttttctctacatctgatccaggcctggggccacccttttccagaaactgcttcccttttcctaacacctttccaacttccactcttccggctcagaatccccttttgtggccaggctgcagacctctgatacgttttaacattgcttttgaattcaaggatctccctagccctgtagtatttcccattttctatcagacactgtcatggtgggaaatggaagcagtgaatatgaattatttcctaaagaaacttgactatgaggccaggcttggtggctaatgcctataatcccagcactttgggaggctgaggtgggaggatcacttgtagccaggagtttgagaccagcctggacaacatggggagacttcatctttacaaaaaaacttaaaaattagctgggcatggtggcttccacctgtagtcccagctacttgggagggtgaggcaggaggatcccttgagcccaggagtttgaggctgcagtgagccatgatcgtgccactgcactacagcctgggtaactgagcgagaccctgtctcaaaaaaaaagaaacttactgtgaatggaataattaagatagaagtagggtaatagaggggaattcgaagtcaagggaatttttgttaatatataggacagatgtaaacatgttcataaactgaatagaatctgggattcaagggaagttaataattagtgagtatttgaccttcattgcaaggcctgttgagatttgatagtatgaacttgtattggaagaaattgatcatttgacttcattcattcatgaacaaatatttcatattatctactgtgttcggattatgaagatgaaacacacaagccctgcctttaagaagcccagggtctagaggcgtgtatgtacaagggtaaagggatattcagagtttattactagtaaatcacagtacagaaagaataaaagttggggaagcaagaaaagaaactggtcatgctcatcattatattcctggtggttgacaggtgcatgaaaattgtgtgtgaaggagaggctctgcttcccaccacatcctgcacaatatcttgcaaagagattccagtaaaccttaattctctggtgtatttttttagactctattagatattgtcagctctatcagataacatctaagaacgctccctaaaaaatgtgctccatatattcagttaatggaagaagaaactgactcgttcaagaaactgtaatttgaaattaattttacagttgtttatttgggatcttgtaatttcaaatgaattttacagttgtttatttgggatcattaggcacatgagagaaaacagtagcgctggggtttttcatagaggtagattgcttctgtttttcatgggcccgtcctctgagtgttttaaagtaaatatttcttgaatttgatttataatcaaatttattatgttgaagatattatttaatatgttcaaatagcttcacttttgaagtgagggataaggaagtgtaactgtcactgctaaagagaagattctgtgtttttctgtggcagacatagggtaactgagagtaccatcagtgcaaaggtacaatattgtgatattatactaggtagagcatgcataatgctttagggtaatgtctgctgcattttaaatggaataaaacagcatttgctttgtttatgtcaaggtggtgagctttttgcctggggacagaacctgcatgggcagcttggagttggaaggaaatttccctcaaccaccacaccacagattgtggagcacctcgcaggagtacccttggctcagatttctgccggagaagcccacagcatggccttatccatgtctggcaacatttattcatggggaaaaaatgaatgtggacaactaggcctgggccacactgagagtatggaacacattctcagattcctattaccaacagatatacttgttagatgaatttaatggacctccctgtcaaaaatggttcaaatcttcactttcattttcactgctcttcctgattacctctctgtcttcagggcagaatcagtccaagaggcatacatagtgtggaagttgttactgtaattgagacatgtttcagggctgtgtgtgagacgggaaagggcattgaattagggatgagaacctggattctgattcccactttgcagtttactaactgcaagccttgcccagtcactaaacttttctctagacctcattttctttttctgtcaagtgacaagtttggatgagatgacctttaaagcctttgcacttaaagtctgttagtgtattattacaaaagaatactaaaattatatttaagaactcacatatcctgatcttattctataaggtatcaattatgtctgtaaacacacatgaagaaacatgtaatttccattattgaacaaagctgatggtgaaatttctcatgatcccaaacaactcattaagagttttcaggtgtaagaaattctgctgctttacccagctgtggtactgtatgcattaccctggatcactggttactcatttctccctgacacagtgcaatggtcattacacagaatagcccataagtcagtgttagaaaaatattcaaaggagagaagagaataaagcggccattaaactactttggctgaatctctgagtgcttttgacatgaaaataatcatgaagaaaagaagaggtagtgtcaggtgatgacactagtagataatttgaaagaaaggaattgctatgttcattaaaagtaattctagatggctgttggaaatatctaatgtgctgcaattaaagtgaatcaagtcataactgagaacaggctttgggaagtggtttgaccctttcacaggtgggtgcccctaagtgtgatccttttggccactggtcccaccttcaccctgaggcgtagaacttgatcctaaacatggcaacatagagcctttcttgtcagaatatcatgagaactgttgtcgctgggttgagaagcagcagtccaggtaactccactgtgaaactcagcatttccttttggtcacttcagctatttttttccttacataggtaaagatgatccatcccttattgaaggactagacaatcagaaagttgaatttgtcgcttgtggtggctctcacagtgccctactcacacaggtgggtgtacccttgtctctttttggctgtatttttagaagaacagtttgtatgggaagttagtgtttcccagagaagaaaggtcatcacttcctgtatgtaggactgtccttctgatatttaggagctttactttgacagtgctatttattagtgattcactttgcatcagtgaatactacttttttattttatttttctagcatctgatatgacattccctttccttaggatgggctgctgtttactttcggtgctggaaaacatgggcaacttggtcataattcaacacagaatgagctaagaccctgtttggtggctgagcttgttgggtatagagtgactcagatagcatgtggaaggtaagttgtaaagtatcaataagaattgataaaatgagtgcagcaaactagatagtaatttaataaaatttctttcagtttctttgagatgtatcaaacattttcaaatcagtgaaaatgcttaatttatattatttagataaatgtaataccccttttactatacatggttgttttctttgatttttttttttttttttttttttaaatgagcagatacaattcactttctgctgtctccttagtgaaatacctttgtaactattcaggtgcacttttgtcttaaaaaaacaagtcattaattgtttatttgggaaaaataaaatgtaaatcacaaaggattattcattaaatgtaatcaccctctctgacaatgccttgtggccaacatactttttaattaccagagttctttcattgtagcctgccctgatcacagtaaagtataagacatagtcagtgatggtttgagtgaaatattcctaagaagtttaattttcacagctcctttttagaaaagaaaggtaaaatgtcttgctcagactccttagtttatttaaaggttttttggttttcttgtttgtttgtttgtttgttttttggtttttggtttttttttttgaggcagagtattgctttgttgcccaggctggagtgcagtgacgcaatctcagctcactgcaacctccgcctcccaggctcaggttattctcccacctcagcctctggaatagctaggattacaggcgtgcactgccacaactggctaatttttaaattttatttatttattatttttttttgagacggagtctcgctctgctgcaaaggctggagtgcggtggcgcaatctcggctcactgcaagctccgcctcctgggttcacaccattcttctgcctcagcctccggagtagctgggactacaggcgcccgccaccacgcctggctaattttttgtatttttagtaaagacggggtttcactgtgttagccaggatggtctcgatgtcctgaccttgtgatccacctgcctcggcctcccaaagtgctgggattacaggcatgagccactgcacctggccacaaccggctaatttttgtatttttagtagagtcggggtttcaccgtgttggccaggctggtcttgaactcctgacctcaggtgatctgctcgccttgacccctcagagtgttgggattacaggggtgagccaccacgccactatttaatttttttgattatcagatatatcagtccacgtcttgccagagggatgttggaagttggtaggattaaaaaatattttcccccatatacacttattcttttgggcagtttttccctcactaaacgtagagcaaaattcagactgtatttgaatgctgggttcatttgttagtttactgaaaccattcttataaaaaactagcatgaatactttcagtctgtaggcatattttcttatgatcttggagtagaattacataaatgggtaatattattaaggtagaccaaattatcggaatatgagtctcttcaccaaagaagcgttctcttcaatatttatacctcattcggtatctcttaaccaaagcagtcttatcacctctttggattcttcattacatacagtccttttgagtagcatgtattacaagagaaggaggcaagttggagatctgtcttaatgcacatcagggcaatacccctactaacaggacaattcactggaaagactcacgaacttactaaaagctattatgctcatagtcacatttattacaagaaaaggatacaaactagtaccagtcaaaggaagacacataagggcagggtataggagggctgcaaatgctgagcttgtggctgtcacctccccttggagcaggtggatggtgttatctcttctggcctgataatgtgacaggacatacagaatttgccagccaatcagagaaattcacccaagttgagagttgtttttgttttttctggtttttttattttggagacagggtacaggatgtacataatctgccatctagtcagaggagttcacccaagtcaagaccaagtcaagagttgtttttggtttggtggtttttttttttttttgagacaaggtctcactctgtcacccaggctggactgcagtggtgctatcatggcttactgcagccttgacctcccaggctcaagcaatcctcctgcctcagcctcctgagtagctgggaccacaggtccaccatgcccagctaatttttaaatttgttgtagagatagggtctccttatattggccaggctggtcttaaacttctgggttcaaagtatcctactgccttggcctcccaaagtgctgggattacaggcatgagccaccacaccccacctaaattgaggggttttattgctgaggcatgattggttaaatcattgcccggatagttaaacttaatctccagcactgccctcctgtaggtctgatttacatcacaggccaggagagctctcccaggatcctgccatgaataataaagactctcctctatcacttggggaattctgtgggtttagaggttacctcctaggaacagggcaccagccagacctctctgggcaaggcagattccttgctacacaacagtatagtggaatatacaaaccagcaaatcaataggaaaatcagtgtggtaaaggtctttgagaaattaagtgggaactcaactgagtcttccaggatggaaagtgaagggactcagagatggtttccaagaggtggtgactcaaactgatgttgaaaaatgagcagagggcaaggggaggtgcttgtttcaacaaagggaacaccatttgccaaagtatgacatcatggtcttgagtggcctttgggttccaaagtcttttcaggtacatgttgatttcttggtttccagatgattttcatcctctaagagatgtttagtttcactctcactgggtaacatagttttggcaatttactgtattgctaaacactctcatcattgtggataattaagaattgaccatatgtgcttttatttaataggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttggtaaattctataggaacatagggtttggcatagtatctttttagagaaaatgatttttctaactaggtaatgtggcaaagaaagcaacatatgactatgaagggagtttctctaaatactggtttcattttttactggtaaacaattcaagagtcagtctaatttactgaggcaaaataattattctatattactccttcagattaggattaatgtgaatttaaatgataaaatagacaatggattcagaggcatatgcagctctcattccagtttgcaagagacttactaattcttgtaattagttgtttactaattcttgtaattggctggttgccctggttaagttgatccacagtcatataaaaccctcagaataatgagcaatcaacgtatacctggcactgaactgtgctcagcacttacttgtgttatctcaccaatccttgtaacagttcctgggaggtgtattctgtcactcctcttttactggaggataaagagacttggagagaaaagggttagccacttaatcatggccagtaagtggtttgtctggagttgaacccgtgccctttatgacctcagagtctgagctctgaaacactccattgtagaagcaccttggagcatttctgttacttgtttctgaaagcttagtggtgacctcaagtaacaaaatctactcatttcttgtaggaaaacgaacagagttatttccttaagcagcatgtattatctttgattccttataacagttacatgggcttaaagtacttatattctttatagccagcagtcattgcttaaatcttgaaaacatggtttttagtaatgggagttgaattaaactgataacatttagctaatcaaatatttgcattttatatataaatatttgtattatgtatattaaactgatgtcacatgtccaccttgtgaattacctatgtttgccaactagactttactccaaaggatatgtatttcagctgcttaattggcagaaaatgtactaagttttgtctattaagaagaaaagatgactacgtttaagaagaatctgaagttatttaaattgaacatgcatgtttgtgccaaatgactttctaaaactcttactctttgtgcatcctttcagaaagccatacctcagaaaaggagttaataatgattgctggagggaatcaaagcattttgctctggataaagaaagaggtaaaaatagatctccaggtgttctataacctggtattttaagcaaaactaagggttctagtatcccagtttggtgaattccaaaatcatcagtttaccaggctgactttttgggggatagctggacattactgatcctttattgtctaaactacatcagtattttcccacaaaaatcagcagatttttctctggtgaatgtctaatcagtgtgatttccataggctatacttaccttttgggggctacttgccaatgatgtttggtcagtatccttgcaaacaacagagtgacagattctaaaaatgactttgcaggccagtactaagaaagacaccaaggttcatgggcttgcaaataaaaagtccataacttccctgccctacttcaccaagtgaaatcgagttcctcacacttctgcacacagctctttcaggatcttcccttcccttcaaggctgtctgatgttcagtttaatttgattgtatttgtataaagtgctgagtgttgagtcctcaaagaaatttactttcagtctaagcccccttggacaagaaagtggcaaccaggcaaatgattgattacttatttgttgagtatcactttgtgattgtcccagggctgtattacacatatttaaaagtcagttttactctctagagtgtacctaaaagttgggtgcctatctctgatgtgtctaaattattgtattttactttcctgtttgtttacagaattcatatgttaatctgaagaggacaattcctactctgaatgaagggactgtaaagagatggattgctgatgtggagactaaacggtggcagagcacaaaaaggtacaccccacagtctgactctctgcttatatatcactctcaagtatcatttcccaaactggttctgcacagcaatatgagattttgtagtcagggttttccagagaaacaaactcataggatatgtgtgtatttctgtctctatctttatctctatcatgtctgtctgtccatctatgtatctatggaggggagagagagagattattttaaggaattggcttatgagattgtaggggctggcaagtccaaaatctgtagggcaggccagcaggctggagacttggggaggagttgatgttgcagctcaagtctgaaggcaatctaaaagcagaatttcctcttctttgggtgacctcagccttttctcttaaggccttcaactggatgaggctcactcacattatggaaggtcctttctttttattcacttgttcaagtgctttactcagtttaccattttaaatgttaatctcatctaaaaaaatactttcatagaaacatccagaataatatttgaccaaatatcttggtaccatggcctagccaagttgacatataaaactaacccatcacaactagcatgtaagcgccatgaggacagctttctttactgtagggcttctccaggcctctgtttatgtatattgtgactctctggccagaaaatagagtctatagtgtttcccagtcccatttgatcctggaaccattagtttgtgtacctgttattcttagctgaacaatttgtaccattcttctctaaaccatagaactcctataggtttacagaactcctacctattcttacaaacatcatcttttagaaatatttttaggtatggctttctaattctggaaaatgattgtacaaagtagttgcacaaaatagttgcatcataatttgcagagcataaataattaagaactgtacaactacttctaagatgaaactgagcatactccttcccccatttaatttctggtaatttatttctacttcagtggaatagaaataaataggacttgcatagttggtggggtgggagtattttgtttgttcaagaaagttctgaccataaatcaagcctttcctctttatttgaggcttctctgagtatgtataaacttttttatttcccatgtttgccactgaaattttgagatttaccaaacagaatggacttttagaagccaagccaaggtaatatgcatacagataggagacaaatggagaggttggaaggatagttataagatgtggtatttatcatgtctcatgctgtaaagaaagaggctgtatgtatgtataccatgtgatttggtttaaccagtgtcttattactaatatagggaaatccaagagatattttcatctcctgcttgtctaactggaagttttttaaggaaaaggtaatatatgtaataaattaattgtattaaattgtattaagagtaccgtgaaagaggataaaaaaatgattggagagtaaaatagctgtgtgttcatccctttttaaaaattttttttaacaaaagtaaatatatgtttgctgtagaaaatgtcaaaaatacacacaataaaaagaaagtgaaaatcttccataatccatcacttaagagtaatagctagcacttacgtatatgattatattttttcatgcaaatgtattcttttaaaaaaaatgagatcatactggttctttgtttttttctttttttttttgagacagggtcttgccctgtcgttgcccatgctttaatgcagttctgtgatcttggctcattgtaacctctgcctcctaggctcaagcagtcctcccacctcagcctgagtagctggggcttcagacacatggcactacacccagctaatttttgtatttttttgtagagccagagttttaccatgttggccaggctggtctcgaactcctgagctcaggcaatctaccagccttggcctccccaagtgctgggatttcaggtgtaagccaccatgcccagctggatcatattgtttatacattgttttctacctaatatttgcccattttacattttattctatcttttttggtaatttttttttttttgagacaaggtctcactccatcacccaggctggagttacagcatcttggttcttgggctcaagcatcatcaaactcttgggctcaagcaaaactcccaccttagccttccacgtagctgggactacaggcacgtgccaccacctcctgctaattttttagcttttgtaaagacagcagctttgctatgttgcccaggctggtcttgaactcctggcctcaagcagtcctcccacctcagcctcctggtgttgggattataggtgtgagctaccgcacccagccggtaacataatttaatggctgcatgaccttccattagaaggtcttccatgagaagatacttaaacatttcattaataactttatattgaagtactaagaaattattggtcagaagccctctcttttggttcccacttttcagtccatttaacgggaagaaatggatgtattttttagaaatgggaaaaatgtttatcttttttctgtcttccttccttccttcctgtggtcagtcctttcttccttccttccttccttcgaaaaacctttatcttttttctatggcccgcccttcttccctcccttctttcctccctccctccctccctccttcccttccttctttcttttctttttttctttctttctttttctgaggcaggatcttgctctgtcacccaggctggagtacagtggcatgttcacaactcactgcagccttgatctctcaagctcaagcgattatcctgtctcagcctccctctgtggctattttttttaaactgggaaatattaatttttttaatctattacagataagacagcatctgagttaaagtcttatggtatatacagttaaagcagccttgatattttttggtattttagaaaaaatcatgtttactacattgcatttggatttagacaatttattatagttacacacttgagaaaaaaggtaattttgttgaaatggggcaagctctagaagaaactttgcatctagggagataatctaacaaaatacttaatttatctttcttctacagaagaactacagaaatgatgcctgtttatttggacttaaataaagcaagaaacatcttcaaggagttaacccaaaaggactggattactaacatggtatcttcagattgttatgtggagaaagaaaatacaccagaatatttcttaaaagaactcaaaatttcagaagaaatgttttgtgttaagggattctccgagaccttgtagcatattcagattaagttaaactcagataacatttaggagtttgcccttttagggtgaaatagttggcatagtagtcacacaggttacagatattctaaatagtgtgtctgtacacaaacacacatacacatatatgcatacacattcgtagagggaagtttttcaactcagggctttaggaagatgattaaggatttgttgagattggtacactagaataagaacattttatatgcaaagcataaatgtagaaatgagaacattttttctgatatgaatatccctctcaccagggactgcctggattctttttttttttttttttccattctacttttctgtagattctagaatgttcttgttccttatgggatgattgtttcctgtttcagcactgttactgctatctttaggttttctttttgcaggtgctccaaacatgcttcctttatttttatttttatttttttggaaacggagtctcgctttgttgcccaggctggagtccagtggtgcgatctcggcttactgcatgcttcgtttattaatttagtttttcttaatgtagtttttattatttccctattttattttactggttgatatggggatactactttctgttctactctccatttttttctctctgggtcgcactgtagttccttctttctttctctctccttccctcctcccctccttcctccctctagcctcaccccattttttaatctctctctgtgttcatatccctcttctctttccctctcaatctttgatctctcacccttcctcctttcagctcccgcacttgctctgtttgccacaactagcattttctatttcagctgcaagttttctcattcgctcctttctttcaaggaaagatggaaagttcagttctcttaactttggcagaaccacagccccactgggggtccgaggtgaaatggttccctaattatgtacctttattgggaccctacaacacttagtgctgcctgtatcaacaacccagaaactactcagtggactatttcatcaacatttgttagagctcattttcttttgttttctaaaatcctcctgtgggggccagtttaactttctttctgtaagattctgagtcattgctactaaatacaaccatggaaagattaccaaaaatagaagcccttttgtgcgtctgtgaagggaagggattggatcagttcatcattaagggctccttctgtttactaattataccttgattgtgccacaaaaagaacatatggtatgtaaatgaaataatcatagggcatccttgacctccattgtttcagaataagatgattggattagaagacctgtaatgtttctttctatcttgaggttctgcgatacggactctcagacctttggcatgtgttcatttattcagcaaacatttgaatacttgctgtgtgctgggcactgtaatgatgactcgatgaagaataaaagagacatactccctgtgctttagaagctcatggtgtagtaagggagacagatacatacatgcatacatcagtgcaaagacctggtgtgttttacacttcactgtcttcgctagtgcctggcttagaatgtagcctgtgtgcaatatttttggatgaattgagtcattattagggcagtgaatggttagctctttttactcaaaacaagttgcccagaggaattaagatcttaccaggtgctcacgtggaaggatattcgaggcagctagaaaagcgtatgccaaagcacagtgtgtcagacaataggactggctcgagggtatcacagtaattctaagggtttggaataggtgaggaggcttgaggttgtgtctgatgatgagcaaggaggtagaatgcgtgtgtactaataagatgttgaaatagagttgtcaggtatacgtaactccaaagaccgaatctcatcgtaggagtccaatataatgttttaatataaaaataggtaattataacaattcgtacatttacagatatcacttagccactatctcataatataatgattaagaatttgggctttggagtcagaaagatccagagaaattcccacttagctgtgtgaccttgagcaagttacttaatttctctgaatcacagatttctcatcagtaaaatgggattaataacatctgtgttagggagaaactataataagggttaaatgacctaattaatatatgtacatcacttagcacaataattgacaagtaataagtattccataaatactagcttatcttcatagtgggattttaaacaaatgattactgtgatctaagcacacataacaaaaattcagaattccattccattttttcctaaacagttgcattctgaattggggaaactataaggaaattggaggggctagaaactagagtctgtggtagagacagttgctcttatggaagataatgagaattatgttaaattttgttcttgaaattttcggattttgtcttttttttttttttttgctttgttttgtttttctgctttttggagttctgatgcatttttactcttgaaaaaagaaacccacggtgtgatagtgtaaaccagagggtagaatatggtacttatgactgagaaggctgtttattagttctgaatctattgttcattgagtgtaattcttgcacatgtttttttctttttctttctttcttttttttttttttttttgagatggagtcttgctctgtgcctggagtgcagtgacacaatctcggctcactgcaacctctgcctcccaggttcaagcgattctcctgcctcagcctcccaaggagctgggactacaggcacgcaccgtcacgcccagctaattttcatattttaagtagagacagggtttcaccatgttggtcaagatggtcacgatctcctgaccttgtgatctgcctgcctcggcctcccaaagtactggttaggtgtgcttgatctccttcatgcaccctgataattgaatggagagaatactaattgtatatcccaaatacctccaatattttggaggctaggtgagaagggatgtaaacaggggttttagaaaactcaatgattattctcatttagtagtagaatgacattccagcctctacaccttgttttattaccatcagttgcaccctgcttctactgagttttgaatcccttttccctgttcctttctgaccacagataaccacctgcctcaaagataatctgctcaaaagacttccatttcattctccaccccaagaagctttagaaattttcttccttctcccagaatgtcctatgatgcatatttccaacaactgggagagccttgtggttccatttgcaaaggttgtttgtaaaatgagtgaccagtcttcactggttctgggtaagtttgatcatttgaagatactttacctgtcttctcagtggaaagacatgtctagtaaagttatggcaaaactaagatacttagaaatgtattcatttttttttagttcgtattgttagcatactctaaaggtactataacaattaccatggtcatctaaaatagattattctaatacttttttagattccttggatacacacatggctttgtcatgatttccttagtttccaacttttcactatgaaaaatttcacagagaagttgaaagaatagtatggtataccatatgcaataaatggtacaccttgctggagtgcagtggtacagtcatagctcactgtaatcttaaacccctgggctcaagtgatgaggatgctaagttctaaacttgtaatagtaattgtatttattcactgaaaagtttattacaattgtgcttttgtaattatggtattagagtcagcaataataagtatgttgtcatttgtgctttctgtttatgtacagattacattttatttttactgaactatttgaaaataagttgaagacatgagatttcactcataatatttcaccattcatctaagaacatggaatctggccgggcacggtggctcatgcctgtaatctcagcactttgggaggctgaggcaggcagatcacctgaggtcaggagttcaagactagcctggccaacatgacaaaaccctgactctactaaaaatacaaaaattaactggacttggtggtgcatgcctgtaatcccagctactcgggaggctgaggcaggagaatcgcttgacctgagaggcagaggttgcattgagccaagatcacgccattgcactccagcctgggcgacagagtgagactccgtcccaaaaaaaaaagaacatggaatcctgtattaccctggcatcattatcatatctaagaaaattaatcataattttataatattatccaatatctaggtcattcaaatttctcttcttttcccaaaaaaagtaaaaagtatttatagcttttttttttttttttaagaatctcatttgaggccaggagtttgaggccagcctggccaacatggtgaaacttcatctctactaaaaatataatcagtcaatagatagatagatagatagtgaaaccccatctctactaaaaatacaatcaatcaaaagaaaggaaggaagggaggggaggggagaggaggaagggggaggggagggaaggggaagggaaggggaagggggaggggagggggaggggagggaaggggaagggagggggaggggggagagaaagagaaggggaggggaagggaaagggaaggtgaagggaagggaactgaaaggaaaggggaggggaaggggaaggtgaagggaagggaaagggacggggaggggaaggtgaagggaagggaacggaaaggaagggggaggggaaggagaaggtgaagggaagggaacggaaaggaagggggagggggaggggaaggggaagtgggggaggggaaggggaagggaggggaggggatgggaagggaaggaggagggagggagggagggaaggaaggaatgaaggaggaaggaaggatgaattctggtcagttgtcttgtagactgtcccacatccagatagtctgaccgtttcctatccctgtatttccagtacaccgcaagtaagttctaggggcatgaatagagtttaatgggatttttgacatacatagcatattcagctcaaggaaatccattctttatgttttattaaatctggataacatgataagtgatgaaaagctactttaaaatggtttttgttttttaaaatgctgaaatatgttttctgtaagagttaaacacctcagactggaagcacaaaaagaaagttgtgcattcacgaacgatttttaatttaatttttaacacattatactatttcatctgcacaaagaatgtgattaattttgctcatattttttcacaaattaattacatcaagtttgtagttgtattaactgtaaaggaacttttccaggatgttaaattattagtagtattttttaatagagacaggacctcactgtcacctagctggagtacagtggtacaattgtagctcactgtaatctttgaactcctgggcttaagcaaccagaaagttaaattctaaacttgtaatagtaattgtatttattcagtgaaaaatttattacaagtgtgcttttgtaattataatatatactaaaatattttgttatgtgtatcaaaaaattttggctactttttaccttcaacaatctaagtaaaattacgtgataattatatttaccttccttgtgaaggtcaaatatgcagagatagataataaaatagtggttactagtggatgggggtggaaaggaaatgtggagatgtaggtcaaaggacacaaagaagcagatgtgtaggatcaacaagtttagagatctactagataagacaacaggaggactgtagttaataacatatcgtattagggattttattgttgttaaataagtagatgttagctgtctttgctttaaaaaaatatttttttttttgagatggggtcttactctgtcacccaggttggagtgctctggcacaatctcagctcactgcagcctccacctcccagtctcaagcggttctcccacctcagcctcccgagtagctgggccacagacatgtgccaccacgccctgctaattttttgtagttctggtagagaccgagtttctctatgttgcccaggctggcctggaactgctgagctcagacaatccacctgcctcagcctcccaaagtgctgggattgtaggtgtgagccaccatgcctggcctaccaaaaaaatgttaatttgcttcactatagtaacaattttactatttatatgtatcccattacattttgtagacctcaaatatacccaataagctggtgaggtggctcatgcctacaatcccagcactttgggaggcaaaggtgggcggatcacctgaggtcaggagttcaagaccagcctggccaacatggtgaaaccttgtctctataaaaatacaaaaattagccgggcatggtggtaggcgcctgtaattccagccactcaggaaggtgaggcaggagaattgcttgaacctgggaggcagaggatgtagtgagctgagatcgtgccactgcactccaggctgggcaacagggtgagactctgtctcaaaaaaaaaaaaaaaaaagcacaataaaactcattttttaaaaaatttgctttccttgtgttcctcagaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaagagttcctttagaaacctctgtgtttttatctagctgtaaaaattcccttcctttcagctggcttgaatctttaagtagactcgtgtgagacatacgaagtttatattgctatttttttaatttttttttaaaattacatcatacatataaaggaatatatatataatacctatttagaattcaaggaaaaataataaaataaacattagtgtccttaccacccatgttaaaaaaataaaacatttccagtactttagaaatacctgtgtgctgggccgggcgcgttggctcacgcctgtcatcctagcactttaggaggccaaggcgggcggatcacgaggtcaggagatcgagacaatcatgactaacatggtgaaaccccgtctctattaaaaatacagaaaattagctgggcgtggtggcgggcgcctgtagtcccagctactcgggaggctgaggcaggagaatggcgtgaacccgggaggcggagcttgcagtgagcagagatcgcgccattgcactccagcctgggcgacagagcgagactccgtctcaaaaaaaaaaaaaaaaaaagaaataacctgtgtgctttagaaataccgtgtacccctcatgggttgcaacccctccatctcccagaggtagtcatgatcttggatttcgggataatcattcccttgctcttactattttagaactatatgtatgtatttctagacactatgatgtttaattttgctattttcaaaatttatgtgaatggaatactgcttcttacactcaatgttttatagattcatccagattaatgcttatggctgtatttcattcattttcactctgcagtatagttcattgtatgaatataccatacttagcttatccattccaatattgacagatatatatgctgtttgcaattcttgtgtgtgttttttttttttgtcttgttgggagttcctctatgagaaaacatgctgctataaacatttttgttcatatctcttggttttcttgtatcaaggattggttctgggtttcatacctaattctagaattgataagctacggatatgtgtgtgttgttctttactggtagtgacaaacttctaaagcagttggaccaatttaaattctctccagatgatgagaattcccattgctccatgtctgactttaacattttgaaaatatttttgataggaaatgataccaaattatggttttaattgtatttccctggttcaaatgcactagagcatattttcatgtttgtaattgcaatatttgtttccccttctgtgaaatgcctgtccttgacttttgttcatttaaatgatgtttgactttttcttactgattatagaattcttttattttggacactactcttttgtcaatgatatgtgttgcaaatactgtatcctagtcttttgctttatggtattttttgacaaacacattcttaattttattgtagataaatttgtcaatccatttctttttactccttgtgtcttgttttaaacttcttttctcccataaagggttttgattcgagacaggttctccctctgtcatccaggctggagtgcagtggcgcagtctcggctcactgcaacctctgcctcccaggctcctgtgatcctcccacttcagcctccaaagtagcttggactacatgtgcaagccaccaaaccttgctaatttttatattttttgtagagatggggtttcgccatgtagcccaggctggtctcgaactcctgagctcaaatgattgacccacctcagtctcccaaagtcctggtattacaggtatgagccactgtgccaggccaatatttgactttttcttagtgcttacaagaattctttctattttggatactactcctttgtcaatgatatgtgttgcaaatattttatcccagttatagcttgtcttttgcttttatggtgttttttgacaaactcacattcttaattttaatgtagataaatttgtctgtccgtttctttatataattttactccttgtgtcttgttttaaactttttttctcccataaaggttttaaattattaccctaaatcaggggtcggcagcttttttctggaaaggaccagatagtaaatattttaggctttatgaggcatgtggtttctgtcacaactgcagctattcagttgttcaggagtagcatgaaagcagccacaggcaatacaaaaatgaatggtcatggctatgttccaataagactataaaaataacagagggctagattaggtctgcaaaactgccctagatagtattctaagaggacaatagccaaggccagaggaagagtacaaatggaggcctaaaaaggttaaaaacctatctaacaaactgttaaaataaaatatactgtcctcctcttttgacaaataaaccttcataatgacagggagggccaggtttgaatttagaaatctcagtcttcttaaaattctacattgaaaaatggtggcttgctgggtgtggtggctcattcctgtaatcccagcactttgctcggaggctgaggcgggcagatcacaaggttaggagttcaagaccagcctgaccaacatagtgaaacctcgtctctactaaaaatacaaaagttagctgggtgtggtggcgtatgcctgtaatcccagctgcttgggaggctgaggcaggagagtcgcttgaatccaggaggcagaggttgtagtgagccaagattgcgtcactgcactccagcctgggtgacagagcaagactccatctcaaaaaaaaaaaaaaagggaaaagaaaagaaaagagaagtagtagcttaaatgcagccctctgctcttcttttcctcccttgattttgtccccacaccagaaggggtgtcacatgcccgtatgtggacacctcagcccatatgtctgaattccatcccatctcccaccacagaccctccgtagccaaccctgagactggaggatctcagttgtgacatagttcactctctagagaccaagcacggggagaggcctgtgccagaagcaggcttggaaccatttgaacatggaatcccaggtccttggtatatgcagcccaatctagaaggggatgtgtgggctgaaaatagacaggtccccctggccctgcagaccccttattctgggggaagaggcttggctggaggagagccactgcaagaaccatggtcctagggctgtattcccaagtacctgggattacaggcgtgcaccaccatgcctggctaatttttgtattttttgtagagacgaggtttcaccatgttggccaggctggtcttgaactcctggcctaaagtgatctgcctggctctgcctcccaaagtgctgggattacaggtgtgagccactgcacctggcctgaatagtgattcttatattcagcaaatttgccaaattctcatgttatatctagtatttacttatagattcttttgaattatttatgttttctttttccagtccatatacgttttattattttcctttgtcttgctctaggtagggcttctaatatgatgttaaatagaagtgggggaacagtggatacttatttgtgattttaaaggaaattttttttcatggactattcttagtttccaaaggaaatgcttttagtatcatttacttataggggtttgctgttgttgttgttgttttgagttggagtctcactctgcccaggctggagtgcagtggtgcagtcatggctcactgcagccttgaactcctgggctcaagtgattctcctacctcagcctcctgagtagctgggactataggcatacaccaccatgcccagctaattgtttcatttttggagagacagggcctaactatgttgctcaggctggtcttgagctcctggcctcaagtgattctccacctgggccttggtctcccgaagtgcaaggattacccgggtaagccaccacaccggctctataggcttttttttttttttttttttttttcctgagacagagtctcatcctgttgctcaggctggagtgcagtggcacgatcttggcttactgcagcctctgcctcctgggttcaagctatcgtcgtgcctcagcttcctgagtagccaggaatataggcacatgccaccccacttggctaatttttgagttttttgtagagatggggtttcaccacattgcccaggctggtctcccaactcctgacctcaagtgattttcccaccttggcctcccaaagtgctgggattacaggcatgagccattgcgcctggccttctattaggtttttgaaaataacctttgtaggttaaggatatttccctccttttagaaattgttccacattttaaatctaaatgaatattgactctcttttttgaaattccagttattgacatgttagactttttcagtctatttggcatgtcccttaagctttctgtcatattttccgtctcattgtctctctgtaccccattctggatggtatttcttcagccctatcttccagttcatgaattctcttttcagatattttggttgctattaatactaccttttaagtttttatttcaagtagtaatgtttttcatttctagatactcgaatttgttctttaaatttagtttcttgctcattatttataatttcttcattcttttcacattttccttttatttatctgaatatatatgccttataactcaggtatctgaagtctttgcaggtcagtttctgctaatcttcctcctgatgtctttatgctcatgtatgttgtgatttgtgtatgtgtgagagctgtctgttttccttggaactttatcttttggaattacttgagggctggctttcttcgcagagaattttcttctgccaggctcctagagataccaccagtttggtagtactttacatttttggcttgaagctttttagaatttggtggcaaagttgaaggagagctcttttgtaattacagatcctataggggataatttttccccaactcagcaccatttgaacttggaacagtttgccttgtggtcctggggtcaaggtggaggtggagtgattgatatggcagtggaggaaagagcttattcatttctagttcatccttacctgatggtttaacccttttcggtctcagacttgtggggataacttctcctatggactccctaatttgaacagtctaggctttgcctcctttccccaaagccccaaccattgaaaattgaagtttacattcaccaggttgggcagatgctctcaaggcaaatgccactttcatttaagtttttgacctgattattccatatctacctaaaaaatcagtaatgcctttaaacatgtttgttacagcttttcctgtatttctaggtgttttcagtggatcagggtacctaatatatcatactgctgaagaaaaaaatctgccatactattgaaaaacaatggctattttcaacaatttttaaaggttttttttttttacaaaagggaaaggttaatgaaaaataatttgtgttttgaaaaaatgagaaatttattgaagagctctgggaaggtatattctaacaagcttttgccacttacaaggagaatcacaagaaatactgaagcagcaacaaaagaaatcttcaggggatcccgctttgtcctttgaccgtaatagataatatcagaatattttatatttgtcaggctccccacctcagcaggaggccaccaggaaccatgaagatgaagtacccactttctctgtgactctggagatcttaaggctaataatgataaatgtaaggccaagatcatcagatccagagggccatagttacagggtgaaacagtctcaccagactttgggtggtagtactgggaggcctggaatatttgaggcctggacgagagtcaataagaacattctagacacatggtttcagtgcatatagccaagatgagtttttagaagaccacctgagagtaatttatttcaggataacgcccatccaagtcaaatactaacagtcactaatgtctgaagtgtctagtgtcattattattcattgtcttcacgacatgccagggtgttcatgtgtctgtcataataaccctgatcatatcatatgggatggagggttggaaaatttcctctcggtaggggaatgttccacaaatgcctcagcagagtgaatgtctataagtggtatattattaagtcctaaagactaagacatgaagaactggaccccagagtactttgggatattgcattgtttttttttttcttcctattgaaagttctttaaaaatttcctatgaattaaaaataactagaggtttatcattacatcatcaatctctactcttaaatcttagatattctttatgttcatgaaaatttggggctctggcagtggaggaattggatagaattttattctggtcattataagagtgtttcatttataatttaatctgataatctaattaacagctattaagcaaaattgtctttaaatataaaactttttcacaagtcatattttatttaaggtaaaccaggtgaaatgtcaactacctgaaagtattttccaagtagacgaactcttgcaccgtctcaatttttttgtagaagtatgcagaaggtacttgtggaaaatgactgtggtaggtatagcatgtttaaagggggaaattgataatcagtgagttaatacaggcatttcttgtcctctgcaaaattgcacaatagaaatagcaggacttgtgggaaacattaagactcctcaaaatctatgcaattttgcagtcagagttccagcagaaaagtgattggcaccttgggagatgactatgggagtatgaaaaatgcacaaaaaggaaagggtagaaatctgtctatactgtaattagagaaggactagtggagctctgatacccttaaagtggtcataacaaggcagtgagactcatcaggagccaagagccaagaccctgtgggtagagtgtcttgggtgtaagcactccttttttattttctgaaaatacagttgaagggctcctgctgccaaggtagcagttgacccgaagtgtttctccctttctctgaaggttataattctccttctagcacatcaagtcttgcccagcaaaattcatgtatgagctaaccagctacccatgttatatcattctccgtttatcaaatgcaactgagcttattcacatggtagaaactcaggtttcagcagaacagactctttgggaaagcatccaaagtttataattaattgctaaattaaatgggcactaaacattctctttatatacctttcattgatacatataaaacacattttctactactggtactatggaccagtaatttggattgcttttgttggaagtactgagaccttaaaccatcagggatgtaaggctatgaggtaaagtgtaaggtttctctgtcctttaacttatcagaattattgtcatttccatttttaggacgcttcagaaaatgtacaatgctgcgtcatattcagtcactttccatttatctttaataatctgtcgaaaattaaactactacatacagacacacttttaaaaatagaggtatgtatgcctatttgtcttcattagcataaatcacatgctaagcgccttcttaatcatgcagtattttgggggtgataagagaaccacctaccagtgaaaccaatggttgtggcattcaaggagcttatactctaatgaagacggcaaggcagactgtcataatttgaatcatcttcaccttaaggcaaattagggccttggtagcaagggatggagcttggacaactggcctagttgtcgggtttttacctgaagttggcagtggcagcctgtagtcttctgaatagtactcaaagaggtataacaaacttgggcttgattaggtgtaacagacttgggcttgactagcacctatgtaaggaggcacaatctaatgaaaagatacggtagcaggaatagaagtggctgaggattcctgaaattaggagcccaataaatggctactactctgtgatggtgccataaaagaggtttgtacagattcctcccttttccatgtacggtactgttactagctgaggtggttatgtttgtagatgtatccagcaaagtggatggatattttaccaaccattaacaaaatattttaccaccaaagtagtaaaattgggcaattgaaaattcccaaggaattgtatcagataatccctgccgcattgcaatttaataatgattaaatttgttaatataggtaaagcatttaaaactgcctcacacaaagcacccaaagggttgggtattattatcacttttacatatgcagacatatgttatatgtatgtataatattcaaatatatgtccttaaagcagatagtttcatataatgcatttaccataataaaaatgggaaattgatttatgagttctgagtatgactgtaatgaaatatttaacaaagggaaatcaaagataaaaagataaaagaactttgttttgcttcaactcttataacctattctctcctgattttaaacaaggttccagagataatttcgtagaagtaatatttgactactcctttttctgctaaaagcatagactttttttttctttttttttttttttgagagagagtctccctctgttgcccagactggagtgcagtggcatgatcttggctcactgcaacctccacttcctgggttcaagcgattctcctgactcagcctcccgagtagctgggattacaggtgcccgccgccacacccagctaatttttgtatttttagcagagacagggtttcaccatgttggccaggctggtctcaaactcctgacctcaagtgatccgcccgcctcagcctcccaaactgctgggattaacaggcgtgagccaccgtgcctggccctgaaccatagactttaatgacctaaaattgccatttggtttcagaatggacattctgtctgtctgtctgtctctcccactctctctccctgcttgtctctcttcaattaacttcttaggtaaattctcccttaaaatctcttgtcttggttttttttttcctggagtaggctctttggtgacatctctcataacctggattttttttcctgcagcctgtttgctttctaaacatctgaacttctcttcggaatgagagagcatcatgttgcagtgcactgtttcagtggataccaatacatctcttagcctgttaataagtagctttggtatcttaagcattaataattgtgtgtataggagaaagtggtcctttaaaacctgcagttggtaacttacttgctcatccagcttggctccacaaaggctttgattcttcaggtcccttgtttcctctgctcactgagactaaatactgatgttatcatttatcttcagtggtgcatataaggttcttttcataaatgtgacctgcacttataagcagaaccagtttattctgctttccaaatttttacttagagagggccaatggtaaaatgaagtgtaatatttctgtttctgttttcctagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtaaggtgtaattctcacttaatgtttttgctgctgagaaaagaaaaacataaaagaatgtggcaaagggtttcatagagaggaagttatcttcctttgccacagaggttgtttattttagggttcctctgattccctagttgcctttgagttttgggtgatagctgtgggcactcactcagtatgtttgggctaaggagcagcaggcaaagtggttgttctccccacaccctgctcaggtagatagttcagtgttggccctaagaggtccagtcccttctgaggtctggcctagcctggctagcaccacccttgaagggtttcaatgagatggttagcatagaggagaattaaggggttgtttttgttcttatgcaataacctaaattgggacaggcatggtgactcacacctgtaatcccggcgctttgggatgctgaagcaggtggatcacctgaggtcaggagttcgagaccagcctggtcaacatggtaaaaccctgtctctactaaaaatacaaaaatgaaccgtgtgtggtggtgggtgcctgtaatcccagctactcgggagggtgaaacatgagaatcacttgaacccaggaagcagaggttgcaatgagccgagatcatgccactgcattccggcctgggtgacggagcgagactctgtctcaaaaaaaacaaaaataataacctaaattgctttgtagaaaagagaattttctctttaaatcctacagttattttggggtataattgtagatttgaccatgttcggaagatctttaactgattttttgtttaattaccatataatttgtcttattagtaaatatttgatactgaatcataatgaccagtagatcttttgagtgctgtccttgtggcaagaactgttttaagtgccttatacctaattttttaaccctttcaacaacattatgtggcagattctgtttttccctcattttacagatggggaaactgaggtacagaactattaggtaacttatccaagagtaacccaactgataagcatcagaggatttgggcctggccattaagcactagactttctgcttaatgaagacggataaagattggcctgataatatttagtaaatggagtattttttattggggaccttagtttatcacttctcctactcagattaaagaaagattgactttaccaagtctcaagataccaatttaaaagcatattgccccagacacagtggctcatgcctgtaatcctagcactttaggagactgaggtgggcagatcacctgaggtcaggagttcgaaaccaacctgaccagcatggtgaaaccccatctctactaaaaatacaaaaattagttgggtgtggtggcgggcgcctgtaatcccagctgcttgggaggctgaggcagtgagaatctcttgaacccaggaggtggaggttgcagtgagccaagattaccccactgcactctagcctgggcgacagagcaagattctgtctcaaggaaaaaaatatatatattgcagttagagttggtatttccatgtatttttgcacacagataattgtataactctaatggactcgttatgtgattctatgctttgccagtcagtctactcgattatttgagttccacttttatatattgttcattcagtttttaaattcaggtaacactcagcatttaccatttgcaggctctgtgtgaggcattttacatgtatgacccctgtaatctttctgataatcttgtgggaaaactgaggttttatgaggttgggcagcttgtccttagtaagaagagggggaagggtttgacacctggtcttgctacaaagatttttagtatttcactatttcaccaagaggaatggaagaggcagcatctaaataaataaactggtaagaggagatttctggggatgctagtataacatctgggtagaaatgttgaacaggccgttggaagtgactgtcaatcaggagagaaaatgcactgaatctgaaggttaaatacgtatgggtggtaaacaaagtttaaggagaaaatgagcatccagggaaagaacagagagaaaggacagaagtgttaggatagaactgtctgcaattctgtttctagaaattaagccagcaggaaaaagaagagataaataaaaccgtgaagagtgcttcataggagaaagcaagggagaagattgtgtcaaggaaaaggacatgatcagaagtggaaaatgagttaacgaaatcaaggagatgagatatgagaaaaagtccttggagcttggggatttacagttcttgttcttcttggagagacccatttaagtggagaagtgggtttggaagttggcgtatatctctgaagtttggcaagagtggaaggagcccgtgtttgtattggagacaatgtgttgggattttttttttccttttaaggttaagggggaccttaacatgtttgtgaatggaagtgaaggattccaggaaaaggcaggaatggaggggtgactgaaggagcaaagatgggttatgatagcatcctcttgggagggattggtgtcagcagtaggggtgcagcctcctcggggagcaaacagccacttcagcaaacaccttatgtgtgctctggttttttgaatatcctgatttttattatttatttatttatttttgagacagagtctcactctgttgcccaggctggagagcagtggtgcgaccttggctcatggcaaccttcatctcccgggttcaagtgagtctcctgcctcagcctcctgagtagctgggattacaggtatgcatcaccacacccagctaatttttgtatttttagtagagacggggtttcaccatgttggccagactggtcacgaactcctgacctcacatgatccgcccacctcggcctcccaaagtgctggcattacaggtgtgagccaccacgcccggccaatttttatgatttctttctgtttatttttattatacttggatctggtgactataatagtgatgccagttgaggtcaatttaggtaaaacttttacctaaagtggtaaaaactttaggctctggggtttgactgataaaggattaaatttaggctgtaggccgggtgtggtggctcatggctgtaatctcagcgctttgggaggctgaggtgggtggatcacttgaggtcaggagttcaagagcagcctggccaacacagtgaaaccccgtctctacttaaaatacaaaaaaattagccaggcgtggtggtgcatatctgtaatcccagctactctgggggctgaggcaggagaatcgcttaaacccaggaggcggaggttgcagtgagccgagatcagaccactgcactccagcctagacaacagagtgagactccatctcaaaaaacaaaacaaaacaaaaaaactaggctgcaccacctgactattgtataaacttggaaaagttatttaaattctcaaggcctcgttatctcatagaattaatgtagagattaaatatgataatataagtaggatacttacctcagtgccttccaaatacttgggtccacaattaatgttagctatttactattattaaatgagacttcatatatagcaatatagagccctggaagtgatgtattatttgctctgtttcctcaggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaaggtaagttccctcttctttgcttaaggtattttgcgacagaaaaagtacaccatataccatagaaaattagtttgtctagactatttcatgttagaagaggagtattgatataattatggagataatgtataattctaataaggtgattattttctttaaaatggagtttccttttcctgggttcccatgtctgttcacatcgaactcaagcaatatattttttgatcatttatataatgcatggattaaaaaggaaccctctcttttttaggtactcattctttgtgtcagttctgttttcctaatgaatttgaagacaaaggctgtggaaagaaattgtgaaaactagtttataaggattactgaacctaatgtatttttattgctggtatgcttttaggaaccaaaactgtggcagggatttatttggttttttatttgtttgtttgttttgttttgctttatttttgagacagaatctcactctgtcacccaggctggagtacagtgccatgatcttaactcactgcaacctccgcctcccaagctcaagccattctcttgcctcagcctggcgggattacaataactgggattacaggctcctgccaacacacctgggtagtttttgtattttttgtagagatggggtttcaccagtttggccaggctggtctcaaactcctgacctcaggttatctgtccaccttgacctcccaaagttctgggattacaagcgtgagagtggcagggatttaaattgacttaatgaccaaatattaggttggtgcaaaagtaattgcaggttttgcctttacttttaatggcaaaacctgcaattacttttgcaccaacctaatataaaccctaaacattcttatctcaggctttaaatttttcaatttgagatttgattttatgaaagagaaacaaagatttatttaatataaatatttcattgtactggtaaaaactcataatactttaagatttttttttcgcttttcagcctaaatttgagaagaaaagatacttcttttttggggttctatgtggactttccctgttcaattgcaatgttgccaaccttcctttcccactggcactgtttaagaaacttttggaccaaatgccatcattggaagacttgaaagaactcagtcctgatttgggaaagtaagtaaacagagttcctgagaaaggaccctttctaacatatatttaggcaaatatttaagtacacacgcttcataatatttccatgttcaacagcagcattttaggtactttagaccagttttaactttgacaagaattgttggatgataatttcgttttctaaaattaggaagtgttgattattcccataactagacttcaatgtttgcattaatctttcaactttttctgtgtaggaacagtcatgcacagagcacaggttacaccttggtgcaaaatctgctagtgatatttatgttaaatgttgtttcatgtcatcacctttaaaatggaaacttatttctaagttaaaagacaagccaccacctcaccaaaaaatggcaacagtaaaagggttttcatatccctgctgtgtaaagcattcctacacatccgtaagaaatattcacaaagtatccaagaaggcaacctggcaaagaagcaatagaaatgcttcctaaataaaaatgtcttcaatctcaccagtgctcatagaatgcatattaacgtgagaggctaatttatacttcaagttgacagtggtttgaagtgttgatgctatatagtattagcaagggcttgaaaactttcattttaatttcaggtattattcgtggaaatataaattggtactccttttcagagaacagtgtggcaggacttagcaaaatcaaaacatatttgccttttcaactcaacaattctacttctagacatttaactttcagaaatacacaaccatgcaaggatcagtgtatagtaatatatactgtatttatagtttataatataaagactccctaaatgtccttcactaagggaatgatatatttttggtatacttatgcaaatggaatactacagagatttttatttttaaagagtaagaacaggccaggcatgatggcttatccctgtaatcccagcactgcggggaggctgaggcaagtggcttgcttgagcccaggagtttgagacctgcctgaccaacacggcgagacctcatctctacaaaaacaaacaaacaaaaacaacaaaaattagctgggcatggtggcacatgccaggaggcacacctcagaaggctgaggcaggtggatagattgagctcaggaggtcgaagctgcagtgagccgtgatcataccactgcactccagcctgggcgacagtagaagaccctgtctcaattaaaaaaaaagaataagaacagtaatatgattctagtattattatcatccctcttttacagattcagaaactaaaacacagaaagattaggtaacttgctcaaggccccataatggcagaacgatgatctgaacacagtctggctccagagtctattaatcgtttatactaactgtactaataagacaaggaaaaaaaaatcaaaagcacaagatttagaaagaaggagataaatttgtcattattattttactggaaacatcgaagataacctaaataataattatgcctcaaaagactgataattaacaatgtacatgaactaaaagatctttaaatttgtatcattgtttctcaaacttttaggtcttaagattctcttaaaaatattgaggactccaaagcgcttttagttaggttggttacatctgtcaatatttacgggattagaaattaaatattttaaacacaggaatacacaaatatctgttagcagagcattccacaatatcatatagcctcatgaaaactcttctgtttactcacagcagaatgtgaaaataggcaaataacatcttaataatgttatgaaaatagttttgacctcatgaactctgtaaaggcccaaggattcccaagaattgctggtctggctcacattttgagaaccagtgatctctgtgttcagtaaaactcaattttaatcccaggaggctttttattaaacttcacaacctggttctaaaatttatatggatgaacaaagggtcaagaatagccagaaataattcttaaggcaaataaggatggagaacttggtctgtcagctatcaagaattattagaaagctgtattagtcaggacagtatgatgtatgatattggtgcaggttttccgatagaacagacgatagagctcagaaatggacccatgcctatgtggaactttattagaggtgacatatttgatcaaggggaatagcagtactactcaataaatggaactggaaaaaaatgatatctatctggggaaaaaaatgaaagtagatctttgtcttatgccatacatgataatcacctccatgtggatgaaggatttagatattaaatgcaaaaatcatgaaaatacaggagaatgatctttctcacctttgagatttcttaaacaagacatgcagtgtaccaacagtaaagaaaagatttaatacatttaattgcaataagattaaagaacttctttcttcatcaagagggtgttagaaaaatgcaaaagggaaggtgttgtcagggtctgaatgtgtcccccacaaaattcatattttgaagcctcatccccagtgtggagccctcatgagtagaattcattcccctatgaaagaggcccaagggagcctgttcgccccttccaccatgagaggacacagaggacaccattgaaaaggaatgggtcgtcacctattccctttagattcagacaccgaatctgctggcactttgatcttgtacttccaagcctccagaaccgtgagcaataaatttctatttatagattacccagtctaaggtattttgttatggcagcgtaaatggactaagggaaattgctaccaagaagtgtggtgttggaagcaactttggaactaggtaattagtaagtagtggaagagttttgaggcacatgctagaaaaatcatgtattgccctatagagcagttctggcaagggctcagaagaagaggagacctctagagaaagccttggtcttcttagagattacctaagtggtcatgatcagaatgttagtagaaacgtagacaataaaggcaattctgatgaggtctcagatggaagtgaggaacacattggaaattggaggagaggtgctccttgttactatataaagtggcagagaatgtggctgaattctgttgtatcctagtgttttgtggaaagtcagattcttaacaatgaaataggatatttggcagaagcaatctctaagcaaagtggtaaaggaacaatatggcttttcttgactgcttataccaaaatgcaagcagggagaattatttaaagtggaatttatcattagaaaaaaagccaaacttaaagatttggaaattctcaggctggccatgttgtaaagaatgcaaacgtgtttggaagagagcaccaagggtatggccaggtgactctttttattaataaagaggttagtgtggatgggtggaagcctggtgctattcatcacgacaatggaagaatgatcccaaaggcatttcagagatcactgggggctgtcactcccatcataggccctgagtgccaaggcctggaggacagaactatgtcaagagtggctttgtgtgcccacaggacctggacatttgatgtccagcgctgcctcaagtccctactcattgcattctggcacagtgctcctcagctgacccaggtgtgactccagtggccccaggtgtggtgtggtcacagtggctgtgccatctctgctggcacagagtgcacaagctgtggggccttggcttctcccacctagatatcaaaggatactccacagagccatggggtccaggcagagaactggcacagggttgaggcaactgcagagagcccccactaaggcaatgcctagtggagtcatgggagtgaggctgctctagagacccgagaagagccaccagtgtgcagttccagcctgagggagaatcaaaagcacccaacactaatgtgtgagagcctctaggggtgggctttgcccagcaaagtcatgggtgtagggctgcctggaaacttaggagcccaaccccaaacccagtgtgtcctgaaagtgggacattgagtcaaagattattctcaagccttaagatttaatgttgcatgccattttgagttttggacttagttgggacctattacccctttcttatttctgttattcccttttgaaatgggaatgtctatcctatgcctgttccactgttgtattttatttaatttatttattttgagacagagtctcactctgtggcccaggctggagtgcagtggtgcaatctgggctcactgcaacctccacctcccaggttcaagcgattctcgtccctcagcctcctgagtaactggaattactggcacatgccaccatgcctggctaatttttgtatttttagtaaagatgaggttttgtcatgttggccaggctggtctcaaactcttgacctcaagtgatccacccgcctcggcctcccaaattgctgggattacaggcgtgagccactgtacctggcctaccattgtattttagaagcaggtaacttgttcgatttcacaggatcacagctggagaacagttcaccgccttccccacaaaaacaaaaacaacccacaatgaataaaacatggtctgttacttcacaatacagtaatttaaaaacccagtggggaaaaaaaatcagttcagattccaccttatcccagaggcctttcccaatgtcatgtatcccttcagaaaaatttaactgtgctcttttaagcctatacctgtgtgatttccatagttctctggctgcacatacctcactgtattgtaggtgagactcccatcagcatacctcaccttcaagtcccagagtattggcagtgatatcttagtctcaactttacatcccctatgcctgctatagtaggggctacttaaatgtttgttaaataaatatttgagtgaatgagcaaatacaatgagatgtgttatttcaaaagcatgtataaagcatcataggatgataggatggaaataatttaaaaattggttactgtccattttgatgtgacctctattctcacaaatgccctgaaattattaaggtagtctaatttcaggtgtttcttaagcttgatgatattgggacaagaggtgcagagaaggtcctttgacccacctcagagttactgatacctgaaatttaatatgagacctattctgtaagtaaagttcaaaagcttcaataaaggtaacaccagtttgaatgaattcactatcagtgaacgttagaatccttttctaaatagaaacctacaatcattaggtagggaatttaaggtaaaggaacaagagctgtgaagcaggcaggcagcctgcagaaatgcagacaagcttcttaaatttgacatgtttagttgaggtctggccctgtttagactatcagtacgcagagaaagaggtgctgtgaactatacctgacctcataccttcagaatagctatacacttgacatttattttagatgctgtgtctagtgatcatggttattacctttttaaaagcaagattattttttccttaggaatttgcaaacacttctggatgatgaaggtgataactttgaggaagtattttacatccattttaatgtgagtaacaataaaagcagataacagattagttttaatctgattaaccctttacatatttaactaaacatgtcaacttttacttaaaaaaaaaacctgaataaattagtgaaaaaggtattgttcttcatcatgatctaggtgcatcagttagattttactatgtaacagccaaccctaaaacctagtgccctaaaagaacaaatacaattttgtgggtttctgaactgggccgacttggccaggctggatggtctacagtggtatcactcacatgcccagtcactggcaggctggttgggttatagggtatcagctggaacagcttgtctctgttccctgtggtctttcattctccaataggctagctgaggcttttgaagcaagactgcagtctttattcttcacatggtggccttagggttacagagaggaagcgatagcaagccccaccacacatgcttctgcttctgtcagatcccattggctaaataaagtacctcacatggccatgccgagattcagtggctgaagagatagcctctccccttgattgcaagtgttgcaaagccactaggcaaaggggcaggagaactaggatgggaagaattcatggccatttttgtaaatctaccatactgggtctatgctgtatgaagtgaatactgagatgtagcaattttccaattaatttgtttaatttgatcagttaaaataagagaattcaagctttgaaaaaatttatttttattcagtatgatagggtgtaattttttgtttgtacattccttgctagcttttatgacaaaaatgtacattttaacacattctttttagaaagtatgctccaaagtgtttttattgatgatagattgttcagaattatgttggagatattatctgagttcatttgcggttacaggtgcactgggacagaaacgacacaaacttaattcctaatggaagtagcataactgtcaaccagactaacaagtaggtacaaaaaatgaaatagttggtttgtatatgtactatttttattttactgagctctaaaaattccttttagctctttaatttttcattctcattaatcatttttcactaaggcagagaagttggtgtgtgttgtatgtgttttgacatatatatcatggagtttatattgtggtaaggaatggaaatggctttctcagagagacctttctatttcctcctgtccaaaattacaacaccaacatctgtccctctttatccactcgttctgctttttcttttcatatcacacattacctacctttagggtttatttgcttatttatttctcattgtttctccaatgatagtgaatgcggcagggacttggtatgtattcttcaccgctgtatattcagtacctagagtagtctacagtggtgcctgatacattgcaggcacatagtaagtatttgttgaaaaggttactatgatattttgacttcccaacatctaatggaatgccatttaaagccatggagtttggaattatagaaccttcccttgatagttggtcagagtggcaaagagatctctaggaagcgtgctggcctacatcacatctttttccacgatttcttaatctttttttttaaactttgtattgaagtataacctatataacagaattttgcacaagtcataaatgtacagtttagtgaatttcacaaagcaaacatgcctatgtaattactgccagatcaagaaatataacatttccagctatatagttgtgtattgtatgaatatatcacagtttatttatctgtagaattttttttttcttttgagatggcacctcgctctgtcacccaggctggagtgcagtggcgcaatcttggctcactgcaacctccgcctcccgggttcaagcgattctcctgcctcagcctcctgagtagctgggactacaggcgcccgccaccacgcccaactaattttttgtatttttagtagagacagggtttcaccgtgttagccaggatggtctccatctcctgacctcatgatccacccaccttggcctcccaaagtgctgggattacaggcgtgagccactgcgcccggcctatctgtagtatttttgaccgacatagtgtatttcaagttttggactattatgaataatgctcttgtgaacattcttgtacatgtgttttgtttatgtgcaggcatttctgttggtatgtaactgggagaagtgcttggtgccttgtggttgccccttgctccatgcaggcagaatcaatgctcctacctgaaattcatttggatattgatatggatgatgccatatgtaagccagagagtatgaaaatgtttagtacataatggggctttttggggagagctgcacaggcatccaagctgatctgtttggcttaagtgaagagagaggcaggtggctttagtttttatggtggttccgtggggccagggtcagggttctcatgcaacccagagcatgcgtggggaaatttaagccacgcagccatcagtgggtgcccagggagtgagcctgtgttgtgcagatttggaggcgaaaggggaaaaaggaggagtgggacttgaaagctgttagtaagcaaacataaaaaatggaggcacactttcatcagtagggtacgacagttctaattgctctatatccactctaatagtattactagtcttttttaaattagccattctggtgggtatatagtagtattccattgtggttttaatttgcatttctctgattactaatgttaagcactttatatgcttattggctgtttggatatcctcttttcagaaataattattcctcatctttagtctatttttctgttgcttttttttttcttgtcagtttatgagagttctagatgcaagtcttttgttggttatatgtactgcagatatcttcttacatactgtggcttgtcttttcactttttaaatgtgtcttttgattaaccaaaatttgtaattgtaatgtagtctactttatcaatattttccttaatgcatagtgtttttctgttttctattttatgaatacttccctatcctagggctatgaatatattcccctgtattttcttctagaagcttatcattttatttctcacatttagatctatgatccactttaattgattttttagtaagatgcaaggtatggatcaggttttattttttcaatttttgaaactgattatactgaacctatagatcaattttttgaaaaaattgacatcttaaaataatgaggctttaatccatgaatacagaatctccatttgtttaaatcgtcttttgtcattcttgaaaaaatgttaggtagttttctatgtagagatcttgttgcaatattctaaataggtttcttggatcatttattgtatttgaatcttctctgtccttaaaaatttttttgtctgcttttctgttagttactaggagaggtatattagcatctatactatacatgtggatatgagtgtttctttaagtttcgttattactaagcacataacagatttttgaattgttttaccttcctggtatatgactcggttgtcattagtaaatgtacttttctatccttgtcttgtttgtctgattttagtatagttacaccacattcattttggttgatgtttgcatagtgtatctttttcccttctttgactttaatctgtgttttcacatttaagttatatatgttataagcagcatatgatggagttgttataaaaattacattagggccaggtgcggtggctaacgtctgtaatcccagcactttgggaggccgaggcaggcaaatcacaaggtcaggagtttgagagcagcctggccaacatggtaaaaccccatctctactaaaaatacaaaaaaattagctgggcatggtggcaggcacgtgtaatcccagctacttgggaggctaaggcaggagaatctcttgaacccaggaggtggaggttgcaataagctaagatcgcaccactgcattccagcccaggtgacagtgcgagactccgtctcaaaaaaaaaaaaaaattacattagataatctctagtaactatgacagtccatggcacatggtaggtactcaataactgttaggtattctagcttttatttttagcccctcaccattttgttcaggatattgcagtaagtggaaataacattttgttttattaaaggagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaaggtacatcatcaagtctaagttgattaaattcagttttccttcctatttcctcaataacttttttttgtattttctctagaatgcacgttatgaaccaggatataacagttcacatcccaccatagtgatgttttggaaggctttccacaaattgactctggaagaaaagaaaaaattccttggtaagtattatatcaaggaatagatctgtaatcgtatgtctttttaatgggataaaaatttcctttatgataagtaccatttgcaacagatcatagtgtcagagctacgcctagtccaactgaacatcctctgtgtcccaacatcaaaaaacaaatgttaatatctataagcaatcttttcccctgtgatttcatcccttcttattgcttttaaagttttcgtttcttcatccaagctaaatatcaagccttctttctgtagccctgtcatcattcacttattcagcctttttgggattaactaaaatattttatttggctaatttttactgttcctatattattaatactatatttgctattactgtacacagctattttatttgtatctttaggcttaatgactttctcattttctatttccttacttttgagaaatatttatcttctatttttatttttgtggataacatgtatgttagaagatattcagacttaatagaagcccaacctacctttccagtcttaactcctagaggaaatttttgtcccaaccaaataatcccattgtctgaacactcctgagctcaccttgcaccttcccacctccaggcctttctgtgaagttccttctcctgccttgaacctcacctacctccttgttgcctttctaaacctttccatccttaaaggtccggcataattctgaactcttggaaatcccctcagtcatcccagcctggctctctctccttattctcaagcatagcattgactcaggaggcacttaactccatgacacctcttcgggctgtcttataccttacagcttttctcttgctattatgtgtctttttcttcacaagaatctaatattcccagtcagactttaagctgcttgaggacagtgactatgtgtcagacattgttcgaatacaatccccaatgcactgtcaaatgtaggacactgcacatgggctccagtgaagttttgtgaataaatagatttttttctctgtaaagagattttggtctccatgtaaaacagattgcctaattttattcttctttttagtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaa

SEQ ID NO: 38573 - DNA, 83811 bp, Homo sapiens
ccgcggacctgtcagagatacagaggttgtgggggcgggagacagaaagagagagagatccagagaccgagtcttacgttgacacgcagagagaaagacgcagagacagacaaacaaacagataggagaggtgagaggccagcgagtgcttccgattaacttgccaagctcagagaagatccggggagagggagggtcccctttaaacgcgcaatccccaggactccggaagagcccttttctgcagctccttggggactgcacgtctcacttctaagtttgcggcggagagaataaagcagaaagacaggaagaggaggtggagttctacagttagtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccaggtaaggccgccaggtccgggcagccctccgtactgtgggtgtccctagacttcactttgtatatgagccgtttttatttgggaaaagtgcaggagaaagaatcttgttatatttctcaagtagaaggcggtatctggtgacacttgcttttcactagacgaggctgaaggattaaaaggttaacgttgttaagggatttggcagccggaaactgcagttttacgcctgatgaactgagaggtccgactctggtgattttaacattttatagaaaactttatgaagtagttgagggtgtgacgccactttaacagatgctttttagataggaatgagttacttaaatcttgccagaaagataacggctcgcacacttcctacaaggttagcaaggaagattatcacatgccaccctggttaacagttgcccggtgcgtaaccagtgctatttgaaaacgagatataatgtagttctggctcctgtgtacattacatgaggcattcagggctgaaacaggggcggccttgagactaagattctaatttggtcatccagatggtggtagactaggcttatattgttagttccttgtcatatgtcaggtcaaatatttgattctagtatttatccaaaatgattaaaaaaattttttcagtaataaacagggtactactaggcatttggcaataccttgggtttaagaacaagcttcaaactacgtaggagcagttaaacatcatacctctttgtaaacataaaatcaaattattcctaattatttctataataaatactctgtgattgggtagttcttaaaattgttaagtagacaaagtgtagtttctgcatccttccaaaactgctctccgtcttttaaaactcagttaactcagtgctttgacttgttttcctttactcctgtcccactgacagctgatattggagggtagaatacggtattttccatatcgtttgtcatttttggacgatgttagtttgttacaagaagtttttggggtccaagatgtttgggaaatgctgcatattatactctgctcttggaaatttggcgtttcctaatgaatatgactttagattacagttagggaaactgtaatcaaataaattccatgttaataacattatacgtagattgatctttttgttagaaatatcttaccacaattaaagtatatggctcttaagaaaagtagaactttctgatgccatggcatgtcagaggtggtctctctttgatctagaagggttttgtggtccccttatgcatgttctttagtaaattgtctataattccagttctgggcatggtattttatctggggtaatatctgagaaatgatgtgttggaaaaatggaaatgcccacaaattatgctaatatttaagaaaataaagtgtttgctggctagttgcattcttttcttatcaaataggggaaacaactgagctgactccagtatttccaggtaggtatggtcacgtgcttggaaagaagtttagaggattgacttgaagctgcatatctgtagcccacacattgttttgacttgcatgacctccttatcttgcagtgtctggaggtgttgatgaattttaaaggggcaaaagacctccccacatcacctttgcaaagacattggaaaacatgcctaaattatttaggaaaattggttaagtgtaccagtaatacgattctctgtttattagcaggcaggatgtctcaataggtaaaattatatgtatcttgacacctgttttctcattctcatgtttgcatatttaactgccctcattatggcctctgtgggcatcaaaaagagacaggaagaagcccataattaccttggaaagaaaaggaagccaaggaaaatttaccacttaataagcctaacaaacatctctttgatgttcttgctttttttttgagactgagttttactcttgttgctcaggctggagtgcaatggcacgatctcagttcaccacaacctccccctctgggttcaagcaattctcctgcctcagccttccaggtagctgggattacaggcgtgtgccaccacaccgggctaatttgtatttttagtagagatgaggtttctccctgttggtcagtctggtctcaaactcccgacctcaggtgatccgccggcctcggtctcccaaagtgctgggattacaggcatgagccacggtaccttgcctgatgttctaaaaagtcctaatgatgacaataatcattggttaaatgatgacaaatgaaataccaatctaaaagaatccattgatttgctggtaagtgatggacttgagcccacaacattcatgtatgctccagtgtgaaaccacccaattctggagtaaaattttagggtcattaatgcttacataccctgaggaatacaacttcagtttcctcacagggtggaataaacaatgcacatgtctattgtgagacactggtttttggctttgaaaaaggctaagaagataaaatttgtttcaaggtccaggaatttattgaatcttctacaagatttagttttcaaataacattgttcttttggttgagggctgtgatatttattaggtcagcttttctcaggtaatagactaatgaactctggagatttgttagacaattttggaaggttttctaaatatttttcttcgtatccttaagtaaggactactaaattagcttgttgctttgggatatcaaagaggtcagagttcaaactgtagacagtagaacaattgagccaatagttttgcttcttatagctactgacagtgcgaagagttaggtagaagcagtgaccaaaacaacaaagaagagggagcccttttagccaaataggtctctggggccctcatttctggataaaggtctgatctattgaggggagttcctagaatacacagggaagccccaaatatctggatacccctgggttattaatctaggacatttaagaatggcctcagtgctgccttttgtttgttcagctgttcctttctcattcttcaaatgttccttttcctcatttcctctttcaaacactgtattttcaagttcttatgtgtagatagtggttaaacagcctgataaaaggaagatcctattttctaaattatcacactgagctgctggaaatgcctccattcagaatttcttcttctgatatatattttttgatatatatcttgcagcccatctcctgtagtgcacatagtttttttcttctcacatttctactggtaaccaagttctgtttttaacctttttcagttcatattcagtcttctcaaagcaacactctttcaaaaagcctccatgaactgtctcagctggcaaactctaaatcttgagcctagcatttaaggcctgatcctcctgtgtcaacctacctctccagacctagcacccactaaactaaactactcactgctctatggattcccataagcttttgctcaaccacttcttaactcattatcttccttggacctttcctgcctttgactgaaatgttcttcttttccttgaattgccctgtgaaaatctactctcttaagcccagttaaacttcaccataaaacctttctggggtatcacagccagcactgatttactgatttctctattttctgaattcctgaaatattttttaccatgctgatgtcacttctattcctgtgttcagcagacattttaaatgactgctgcactctaatttgaatggttatttaaaaatacaaatctgatcatatcattcatcctgttaaacaattcagtgacttttagataaactacaaacacttagagtggcttcaaagtccttttctgatttggtccctgtatgtttcttaaaccgtatcctttgtcacagttccaatcttaatggaccatttacactgcctggttctctagaaatacctgattatgctctggtatcagtttagacattacttcttctgagaagcctttcttgatcttctcaagagtgtagtcgaagtcccttcaatgcaatcctgtatttcttggtgcttgtgcaattataacatattatatattgcaattatattataacatgtaaattattttatatgtattacagttttctgcttatgtggctataacccctgctgcctctctctaccctccaaaagatttttaacaagttgaagggcatggtctgactcctctctctagagactagtgtagtgcctggtttataacatgtattcattataatttttttgaatagatgggtgaagatggtttaagatgagtttgataatttgagtcctcacatgactttacagtctattggaggagacatgacatatgcacatataattataatgcacgaaacagtgatatgcctgattaaggaactaacccatttatgcctgaggttgcaattttttgaatttttgcaatcagaccttggcaatgaccttgagcagtgggatataaataactcccacatgcttagtgtttcaataatggaacactaggaataaatgtgtttaaaaaccaatgtgagataagacctgtgttttcagaacattaatctgacatgagagtgtggaatgtattggagtgggtcaaggtgggagctaaggagccatctgcagtggatttcatgagatgtaaggaccacttgaatttggagaaactcagaaggtaatataaaggctctgccttcagagacttcaagaagagcaggcatggctgaagagtatgcaaaaggccccaaagataagccttttctatttcaatattttgcctgtaatcattatttatttaagtattgctagatctcttccttcattatcttctgaccctgtgatgccagaaggagaaagaataactccgggctcatattaatggatggccaggctagtggtatgtagcaaaaaggagtgtatgtatgtgtgtggatactgcaaacatgttttttgcattgcctgttgtcatctactgcactttttcctggggtgggggtaatgatgggttagatgagggtgtttctgggaagcactgactatggacagaagagataaagaacatttgttcttttttttttttcccctttatgtgctgagaaatggtgggggtaaaccttctaggaatgccttctaacctgcttgttcaggtgagaaactggaagggcaggacagagggtgaggttacctaggtctcttgttaagaatcctccaagacaatggccccattctgatctattagatcactctcacataagttgattgtgtacagtgtgttgattgtatttcaaggctttgggaaaatgagggacattcgtaattcatttgactgtgatgtcaagagcttagtttgccttgatgccaggtgtgattgggatccattaggaaaatgcttttcattcctttcatatctaactcccaaaatcacatctttacccactattctaggagtcatatgaacccttttatatgtaatgtaataattatagctaggatttattaatcttttactgtgtggcattactcccttaaccaatttatttgtattatcatgtttcatactcataccaactctatgataaaggtcccattattatcttcattttatgtgtaagaaaaatgtggcacagagaggttaagtaactggaccaacgtcacgaagtaagtggtagaacctcaggcagtcttacacactatgctatagtgcattttttgaattacaatctagaaaaccatactttctctagctagagcaaccatgaccttagattttgaactacagggagaagttactagtcatcgactgcctatctggttacattgcttagtcacattaaggaaatggtactagagctgtggaggctacgatgatgatgacttgtctttgtcctcagagaccttataattaagaaataagatggaggctgggcgcggtggctaacgcctgtaatcccagcactttgggaggctgaggggggcagatcacaaggtcaggagatcgagaccatcctggttaacatggtgaaaccccatctctactaaaaatacaaaaaattagccgggagtagtggtgggtgcctgtagtcccagctactcaggaggctgaggcaggagaatggcgtgaacccgggaggcagagcttgcagtgagccgagatggcgccactgcactccagcctgggtgacaaagtaagactccgtctcgaaaaaaaaaaaaaaaaagaaataagatggaaactgtgaaaagtgactatggaaggcaaagctgcagtaatcacgaaagcagacattgtaaaacatatcacaaggccatatatgattgtcacatggatactagaaaacatctgctactagtttagaaaggtgagggattttttggggttggaaatgcctcatggaaaagttataactcagtcaatttggcttatctggtttggtttttaaaaaatttattgattgaactcttgcttataccaaatgtgatgaattttcatgtgaattacatgaattcttttttagaggatgaaattttcttttattgtttcatatataatgaatttttttaagggactatattttgagcaacaatagtactttcttctatggatagacttcaggcatgtctagtatgaaacctttcagttcatttctcacttttatgctagaagttttcggccaatgaatccactgtctcttctggcggtttagaatggaaatcttcccttatgatgcctctgaagcaattgcattcttaactgcacaacactggagaaagtggtttgtgcataggtgttggggaatgagttgaagcaaggagggaagagtaggtgagccgagccaagtacttcaacagaatcactgactcttaactataggtaagacagtgctgctaggaggcagtttgagctttctcacacagttatcaggtgaactttccataattgggatagatctttctctctagggatgttccctagggttgttctctcatctgggtgggagatttgcagctgttatgctttccatgatttattcttatcttgggatatattgaggggcagggacttagttttctgctttctagtcataaaaacctattacttttcaaccataataattgtttaaaggtgttttctttaaatttaatatacttttgattctttttttttttttttgagaaaagtgaattccttttggtggtagtagggattgggggagaaaaataggaatataaatagaaatggaaaataaggcctgaagttgagaaggatcagtgatcctcaggaaaagaaaagcaacatctaatgaaggcaatttaatgtggctggtaatgggtttgcaagttacttgtattccaagtggtgtttcctcaagggatgtacacattactaagtgcaaacagctagtattagggtcatttacaatgcaatttattttaaaaaaagaatgttactaaactctaggctatctaaaaaactaggtaattttcagaattttcccatttccaactttatataacagtagattcctgtttgtaatcaaaactaattaatttattctcaaattattcccaattgtctgtttcagtagccttgagatttattttataaagaaatgaacctttcatcgaattacctttgtgttgataggatttgggagcatagaaaacattcagaatggagccttgtttaatttggcttccgtctctttctaaagatactctgttgtttttcctggcctgaagtttaaggagaataaaaacaaaaatctgttgagtctagattaaaggtgaacctgaaatgtagcattatgccctccaaggccaaatatttaacaccttgactttttttctttaaataactaattgaatagctagagaaaaaaatcaagtgagcattgataatgcctctaagtctttagttctttgaacctaattaaaaaataaaccataattgtaaccaatttatttggtgagcttcttagacctctaactatcttagagaatacagcataatggtttacaatctggcttctggagtcaggcaagcttgcgctgaaattctaattctcttgtttaccacctgggaaatcacagccaagtgacttaccctctttttgtaatccttagttttcacatccgtaaattgagaaaaaaagagccttactcataggacagttttttggactagaaaataagaacaatattaacatttattgagcatttaacatatttcgggcacttatatattcagtatgttatacgtgccaactcaataaagatataagacttttttccattacctatattgcttccaataatacgtaatacaaaagacaatgtatgtaaaatacttagcattgggcctggctcaaattatgtgctcaatgcatagttattatcatcataatagtatgttactcgatatagctacattatccttaacaaaattgtcttccattgatgatctgaacacccaagcgtctgtcaactaaaagaagaaagcacagccatgaaaagacagcaagaattaatgaaaaaaaagatcagtgagaaataagtcagtccagtgcctttgatttcagtcttggtttccatggtgactcaccttcagagaggcttttacagtttacctccacttccctttctccaaacactggtagtaaattcttgaaaatgtaaaccttaggagtagagactaataaaataatttgagtacttcaatgtgcattgaaattattacctcccttccagaggacttctgatgctacatttagaagttggctttattttattatttttgccccagattggcatcaccactgaaatgtgaatgtttggggaaccatataatacttccagaaatggatagaattgcggttttaaattgagatctacttctaaatctgtatggacctctatatgggttttgcaagccgaagaatccaggaccctctgcatttagctgaaccctgttggatagaaaacagataagagaatgagcattattttagtctaactggaagaagtgagagatgtatctcttcagcgacagggaaacagaaagttagcccgaacttcagcgaacagtaaaatcagtacaccgattctgagcttggcaaaagttcctgctttatataaatattcatcatatgttctataaaacatgcagtcccttatgttaagagatgcatgctatgatggtaccaggtaatagagtttgaatgttaaatcataatgctctacagttttcttcaggagcagagttccccagaacgtaagtatattattcggttacttcacctacacattagcatgaacagctagacactggctctgtctctagtcttgggatgaacgctgtttaagtaaatgttgtgggtagggcctttactgtggcagaggaaacaggtcctgtcctagtaagaatatttactaacaattacggagcacttcttgtgttccaggcatcctgctcagttcttctttatacaccattctgttaaacctcctgatcccatggagtaaacactcttgttattcccttgaggaaactcaaccttaggtaggttaagtaactcactttaaatcagatgactcatattggcagagcacatattccattccagggtgactggattctataaccgatgcactttccactattgcctctcatgctgaagagtatcatcccacagaaggacttattttccaaaaagccaagtgcctcttgtgtcatccaagtgcctgaatgtcaaggtagaactaatgccattttcttgaagccactgggaactgtacaatcatttatttgaagctggcatatgttctctgctgatgttcccctcttgtttgagtgaaaagagggaaaaaatgtcttttcttccccttgttaaagttgtacttgcaataatcagggccggccctaaaactcattattacttcctctacaaactagtttttaaccttgcaaagttatttcctgacaattaacatttgatactcgaaacaatattgtgagaaaattgggacatatcagttcccccagaaactgagatacgaataagtcatttggtaaaagttagacaaagtccccagatttttctgggagaccagacattccaattttgaatcctcagttctttttccttgggctaactttaatcagatgctgtattagcaaggccacggtgctctgactaacctgaatattccatgatctttgtgtttcatttactgtgtataactggaccatagaaaggtgcgaatgcctgttctgttttctcacctctcagtcactattcaaaccattggttctggcttttttctgtccccaccacttccctgaaatttataccaagtcacatggaaccaccttattgttaggttcagtgggtgcttctcaggcctcaccgctctgataattttgttggtgttgattacatcctacctgaaacacattctttccttgcttgcagctgtttgtgccatgtttttcttacttctctggctgctgcttttcaattttgatttcctttgctcattctttaaatattagtgctcctcaggtttccatctcgagcctgttttattttgatgtcacacactctttctgtatatcttcaaggactcatatggctgtgattatctatctgtagatgctttctacatgagttggcttacttcagatttctctcttgagattcagccttgcgcacccagctgacaattgatgtctaactcttttcttttccccaactcaacaggtctaaacctgtctcaaacaaaactcatcaactccatctctttctccatcaaaaccttttggtattcctgttttgcccatcttagtgataggtattactatctgctcactgaactaagctgtgaaactggatgttaatattgactcctcactttttctttccccttcccatatcaaatgcacataagtcttgtcataataacttataaatatctcttagttaatctcttgaagctccaacatcctctttgtgtaatggggaaaattgtacctaccttatgggattgtagtagagatgaaatcagataatatgtctagccactctgtcttttgcctggcatgctgtaagtattcaatacacatacactctgttactgctgccgccctctgcatccagtcttgcctcacatatctctttcctctacatttcttccagtcttgaatacatatatatgtatatatatacacattttattattttattagacttcaagttctgggatacatgtgcagaacatgcaggtttgttacttaggtatacgcgtgacatggtggtttactgcacccatcagccattatctacattaggtatttctcctaatgctatacctcccctagccccgcagcccctgacagaccccagtgtgtgatgttcccctccctgtgtccatgtgttctcattgttcaattcccacttatgagtgagaacatgcggtgtttggttttctgttgctgtgttagtttgctgaggatgatggtttccagcttcatccatgtctctaaaaatgacatgaactcatcctttttttatggctgcatggtattccatggtgtatatgtgccacattttctttatacaatccatcattgatgggcatttgggttggttccaagtctttgctactgtgaaagtgctgcaataaacatatgtgttcatgtgtctttaaagtagagtgatttataatcctttgggtatatacccagtaatgggactgcaaaccatcaattggtatttctggttctagatccttgaggaattgccacactgtctttcccaatggttgaactaatttatactcccaccaacagtgtaaaagctttcccatttctccacatcctctccagcatctgttgttccctgaccttttactgatcgccattctaactggcatgagatggtatatcagtgtggttttgatttgcatttctctaacaatcagtggatgatgagctttttttcatatgtttcttggccaaataaatgtcttcttttgaaaagtgttcttatcctttgcccagtttttggtggggttgtttgtttttgttcttgtaaatttgtttcagttccttatagattctggatattagccctttgtcagatggatagattacgaaattttcacccattctgtaggttgcctgttcactttgatgatagcttcttttgctgtgcagaagctctttagtttaattagatcccatttgtcaattttggcttttgttgccattgcttttggtgttttagtcatgaagtctttgcccatgtctatgtcctgaatggtattgcctaggttttcttctagggtttttatggttttaggtcttatgttcaaatcttcaatttattttcagttaatttttgtataaggtgtaaggaagggatccagtttcagttttctacatagggctagtcagttttcccaacaccatttattaaataggaaattctttccccattgcttgtttttgtgaggtttgtcaaagatcagatggttgtagatgtctggcgttatttctgaggcctctgttctgttccattggtctatatatctgttgtggtaccagtactatgctgtttttgttactgtagccttgtactatagtttgaagtcaggtagcgtgatgcctccagctttgttctttttccttaggtttgtcttggctttatgggctcttgtttggttccatatgaaatttaaagtagttttttccaattctgtgaagaaagtaaatggcagcttgatggggatagcattgaatctataaattacgttgggcagtatggccgttttcatgatattgattcttcctatccatgaacatggaatgtttttcatttgtttgtgtcctctcttattttgttgagcagtggtttgtagttctcctagaagaggtccttcacatcccttttaagctgtattcctaggtattttattctctttgtagcaattgtgaatgggagttcactcacgatttggctctcatctgttattggtgtataggaatgcttgtgattttagcacatcaattctgtatcctgagactgctgagttgcttatcagcctaaggagattttgggctgagacgatggggttttctaaatatacaatcatgtcatctgcaaacgagacaatttgactgcttcttttcctgtttgaatacccttcatttctttctcttgcctgattgccctggccagaacttccagtactatgttgaataggagtggtaatagagggcatccttgtcttgtgctggttttcaaagggactgcttccagcttttgcccattcagtatgatattggctgtgggcttgtcataagcagctcttattattttgagatacatcccatcaatacgtagtttattgagcgtttttagcatgaagtggtgttgaatcttatcaaaagccttttctgcatctattgagataatcatgtggtttttgtcattggttctgtttatgtgatggattacgtttattgatttgcatatgttgaaccagcactgcattccagggatgaaactgacttgatcataatggataagctttttgatgtgctgctggaattggtttgccagtattttattgaggagttttgcatccatgttcatcagggatattgacctgaaattttctttttctgttatgtctttgccaggttttggtatcaggatgatgctgacctcgtaaaatgagttagggaagagtctctctttttctactgtttgggatagtatcagaaggaatggtaccagctcctctgtatccgtgaataccgatacagagctgtgaatccatccagtcctggactttttttgattggtaggctattaattactgcctccatttcagaacttgttattggtctattcagggattaaacttcttcctggtttagtcctgggagggtgtatgtgtccaggaatttacctatttcttctttattttcaagtttatttgcgttgaggtgtttatagtattctctgatggtagtttgaatttctgtgggataagtggtaatttcccctttatcatttttaatatgtccttttgattcttctctcttttcttctttatttgtctagctaacaatctatctattttgttaatcttttcaaaaaaaccagctcctggattcagagattttttgaagggtttttttgtgcctctgtctccttcagttctgctctgatcttagttatttcttgtcttctgccagcttttgaatttgtttgctcttgcttctctagttcttttaattgtgatgttatggtgttgattttagatctttttcgctttctcctgtggatacttaatgctataaatttccttctaaacactgctttagctgtgtcccagagattctggtatgttgtgtctttgttcttaaagaaattacttatttctgcgttaatttcgttattacccagtaatcagtcaggagcaggttgttcagtttccatgtagttgtgtggttttgagtgagtatcttaatcctgagttctaatttgattgcactgagctgggagagacagtttgttatgattaccattcttttgcatttactgaggagtgttttacttccaattatgtggtcaattttagaataagtgcgatgtggtgctgagaagaatgtatattctgttgatttggggtggagagttctgtaaatgtctattaactcagcttggtccagagctgagttcacagacttgaatctttttttttttttttttttgagacagattcttgctctctcccccaggctggattgcagtggcactatctcagctcactgcaacctccatcttccaggttcaagcaattctcctgtctcagcttccgaaatagctgggactacaggcgcccaccaccatgcccagctaatttttgtatttttagtagagacagggtttcaccatattggtcaggctggtcttgaactcttgacatcaggtgatccgcctgccgtggcctcccaaagtgctgagaatacaggcatgagccactgtgcccagccaacttgaatctttaatatgcaaatctgagcatgtcactatcctcacatgacttcccattattgtgaaaataaactctaaactatttgcctggtatttacggcagaagcatctgcccccactcccatatttctccagccttatttctactttttccttcacatttcaccttcagtgctgctttctccaggaaggctttgacagtcccattacttcagagttggctaatacctctgtcttctccaaattcatggagcctacctccacacttaccagactatgctacagttatatatgtcttttttttttttttttgagattcagtctctctctgtcacccaagctggagtgcagtggtgcagtcttggctcactgcaagctccgcctcccgggttcacaccattctcctgcctcagcctcccgagtagctgggactacaggcgcccaccaccaagcccagctaatttttttgtatttttttagtagagacggggtttcaccgtgttaaccaggatggtctcgatctcctgacctcgtgatcctcccaccttggtctcccaaagtgctgggattacaggcgtgagccaccgtgcccggcccctgcagttatatatgccttaatatggactctgcaatagtctgtatggtccatgaggcaaaggactgggtttacctggaaagcctccgctatgcccataactagcataatgtctgacatttaggcgatattcaagaaatatttgttgaatgaatgaaatacttgataaataacttcaacctttttaactgataaatttttaaatgattaattttaaaccaacataaccttctaaattaatattcctttccctcctcatcatcctctaaaaggacacatgaactctctattctgctggtttaagcagatgatctagacatcaacctagatgcatcatttaatttaatttaaggtaaaccagcaattccattttttgttgccgacaatgaattaaaaaaaaaaaaacagagagataaggcctgagaagcacccattgtatttagcaatagggaggttccagtgaccttgtatagaataatttcaaggaagtggtgggaatagaagccagaccacaatgggttgaggaatgactgagaggtgaggaaatggaataggtattcatgcatttccatgggtccaattacacacataaaaaacctaaaagaatagtacattaaaatttaacccatgggccatctaaatagaaggaaataaagtttttattacttttagtttatgaactttccaggaatttttttcttctcatttagcctgggattttctctgtagcccattactatattctttacggcaacttagaaacactgatatcaggattagtttatttgtagcatcagggccacattaaactgattctaggaaagtttcatagaatgagaagaaaaacttatggctggaatatttgcctcctcagaggtcttggtagatgattcccaggttattgatttatatttctcagaattatattcaaacacagtgtgctagtttgaaatctcctttcattcaccttctttccttaatctacaaaattagcaattgtttataaattgagtgtcttatgtgtccaaggacttattaggggttgaagaagatataaaaaggaagaagtccattctctgtagatttttatgatcttattgaaggaatatccatttcatgagaagataataatacatggaagcacacattaagtgctaaacaaatagataacagggatgtctggagtctggagaagggatgggtatagcaatattaggcagtgaagatggattccaaatgggccttgcaggacagacaggagttgggtagtttgagaggagatgtatcatattctaggcaggggtcatgggagatgcaaagtcacagtgaagttacaatataaggctgattataactggttaggatagagtattcatctatccttttacagcatgctgaagggggaaggaatattagagacaggcaagtgaggttcttaagtgttaggactttagactctcggcataaatgtgtacaatttttttgagacagggtctcactgtgtcacccaggctggattgcagtggcacgatcatgactcactgcagccttgacctcctgggctcaagcgatcctcctgctcatccttctgagtaactgggactactggtgtgcaccatcatgcttagctaatttttaattatttttgtcattcaagctggttttgaactcctgggcttaagtgatcctcctgccttggtgtctcaaagtgctaggattacaagtgtgagccaccatgccaggccagaaatgtgtaattttgaaggtttttgtttttgtttttttggtatgtgtgtgtgcaagggttgcagtttgggcagaagaaggacatgctgatgggtgatgcatcagtagaaacaaccttgtggagttgtaggataaccaggatgagaagggtattggatacgattaggttagaagctcctagctcctcagtgaagtggtacataagggctctctctgctggtgtgtcatttttatctgctagattctcaaacattttggtctcaggacccccttgtactcttaaaaattattgagaataccaaagagccttaatatatgtgatttatatctattaatacttaccattatagaaattaatgttaagaaaacttgaaaatatttaatttattaaacataacaataaacccattccatgctaattttattttttatttttttgagacggagtcttgctctgtcgcccaggctggaatgcagtggcgcgatctcggctcactgcaagctctgcctcctgggtgcaccccattctcagacctcagcctcccgagtagctgggactacaggcgcccgccacgaggcctggctaattttttgtagttttagtagagacggggtttcaccgtgttagccaggatggtctcgatctcctgaccttgtgatctgcccgcctcggcctcccaaagtgctgggattacaggcgtgagccaccgcacccggccaaggtgcactcatttcttgtggcaactccccagccctgagttgaagaagcagcatgccctccacactttatcctcagaaggactgagtgggaaacccttggtgtacatcaaggaaacaaaggcttttgatcttggcaaaatgggataatgcccatgggattccctagcagatgatgggaagtagggtggcctctgccccctgaagacatgtcaggggtgggaagcgaaggatctagattgggtgtctgtgctctgacaccacaccacacttttaggagtctaaaagaacaccttctcttttcaagacaagacctcgaaaagctgaatatggaatggggtagggctgggaaacttgtccatcactatgacaaagacagaaaatgttgtaaacctcttttaaaaagattgttgtagctttcaacattctttctttttctttagtaaaatctctaagaattccagcctgccttttgtttaggggaacctggaaaaagagattttaaacaaacaaaacatgacttaattttatttttcttaaaagaaactgaaatacaagtacattgttaaaaactttggcagatataaagaagcagaaaggaaaaaaaataaaaccacacataattttaccactcagagataaacactgttaacatttggagcacagatttatccttatttatagcagcattctctatatattgtttcataataatctttttatccctagcagtgcatcataaaacaaggcatctttatcctttaaattgtatattcaggaaaagcgttcttcatcttcccttcaaaaagagttttgagagtgaacgtaagtgtgtgtgtatgtatgtgtatgcatgtgagtgtgtgtgtatatgagtgtgagtgtgcatgtatgtgagagtgcatgtgtgttggtggcatcagtgccagagtgacttcagtaagaagtgtaagaaaacctgaggaaaaatggaaaaattaatcttggggaaacagagttggggtcacttgactggccacctcttaaacctagagattatttttatagagtgttcttggcttaaaccttagaaaactgtcttttatcttgatagaataataatgagtaaactttgaagaggactttaaagaggggaaaacttcaagagaaggtggagagagagattcagcgtgtgtatatatgtatacatatatatatgtatatataagtatgtatgtatatatcagggagatttggaagtgaaacttgagtgccttgtaattgaggcagtttcattattgcaggaagaacaaatctggaagcaatttcctcagtcactcgtgctttgaatgttcctgctgtgagtgtggaacatgtaagtcaccaattccattgttcagtgagccctaaaaggataaattaatgggacggttcacttgtttcaagggtcagaagtggtctcccaattgttaaattcaaactaccattttaaatgtatgtatttcaattgctctcttgggatctttggccagttgccatattcaaaacacttttaggtatcccaatgattatttaatgggaaagaaacctctggaatcctggaattcatatctactttagtatttattaagatgattactaatattgctatgtacctggcatgcagtagtgctcggtaaatatgtgttgaatgtatgaatgagtaaataaatgaatgaatctctcacttgtcttcacagcatttttggagccaactgcaaaaatggtttaagttcatagctgcaaactaaacaaaattatgaaaaagcaaaagaaatgaagtgcagaaagcgaagtatacctaaaattctcactctggtgagaaaagttggctgatgtttgaactgtaggatttttttttttctttcttgagccggagtcttggtttgtcaccaggctggagtgtagtggcactatctcggctcactgcagcctccgccttctgggttcaagcgattctcctgcctcagccttccgagtagctgggattacaggcatgcaccaacacgctcaggtaatttttatatttttagtatagacggggtttcaccatgttggccaggatggtcttgatctcttgacctcatgatctgcccgcctcggcctcccaaagtgctgggattacaggtgtgagccactgcagctggccggacttttttatttgtataaatgtaagtacaagggcagttttgttacatgaatatattgggtagtggtgaaatctgggcttttagtgtagccatcacctgaataatacatattgtgtccattaagtaatttcttattgtagggttatttttgaagtctgtctctgagtgggatcctaaatatggtttaacagttaatttaattgtgtgtttcaactcactattaggggcaacaaagtgcattctctgccagggtctcaatgattctttcattgaatccttctcagtgttggaccaagacatagcagccagaatactggcttacaagtcaaaaggcatgagaacacatatatctgaattctgtctttaacacttttacattgtttaatcttgtaccgttagaaatttacctttctagacaggatttcttcatccaaatttaacctaaaatctatttaagtggttgattaaagaggttatacgtgttaagcatatattatggtttgctattactgtagtccttatatgcttcccagaactcttatgataactattgcttataaaatttattcaccaactaattgcatactcatttgcgttactgatctctccattaatttttttgtgtatcatgtcttatttccccaagaatcagatgcatcaaaataacaaacttagcacatgtatctcctcctctaggaagccttccctgacctcattcctttaatcacatgatatgttgtgcatatttttatttgcttatctgttttatatgtatctcctttctatgctgaatgatgagattgttgaagatgaaaaccatgtcttattctcaacacctactggaatacctgactcagagaaggtgtgagcaacctgttcagttaatgaataaatgaatgagaatgaaggagaagtggaatgggcttctataagagcagaacagatgaagattataggtggattcttattaaacctcttacttgttgcatctctttaaagaacaggagatcgccacttacttggggtgggggaaggatgggtttcatggctttcatcacagctgcatacatggcaaatttcagaaagtagctgtagttcttactgaatagcaacagctgtagcaatcactggcagggcagcgcagggtagaggtgactaaaataaaagaagctagacagagctctttcagacttggattctaaccccagttctgctgcttgctccctctggggctttgtaatggtatttaaagttgattgtcattgagtctaaatgcattacaaaaatctgtgtctccctgcctttacctccacagagagaatacaaccacacctagcactttccttattgggaatgtgagctactcagcctcccacagaatctcaatctattgcaaaacaaaatctgaaaccatttctggggtggcttttgaatgggatgatatttcatttctggtgtgatgtgaaggccttggtataatggtacaggatcagatggtcttactgtattgtattatttaatgggtgccacttgataagacaaccaagcagacaaaacagcctgtgtgtggagaacaggaagaagtgtggaagctttaaagagtggaaaggcttatctttttgttttcctataggttatgatgtagcattcattcactagcttttaaaagtgacttttaaataattactttatgtatccatcagtactcttttatttgtaagagtgaaaaaaaatcaactttaattagcttaagccgaaagggaattcattggcccacataacttaagagtcagggtgcacatcagctttaggtacagcttatccagggtattgtgatggtattgaaaatctgtctttctccacttcttagttagccttctttcacatggcggcagaaatggtttaagatgtccccagactcacagcaggactagtggagaaagagtttttcagtagcacaggtgattataggatccagactgctcctatgcttaccaaaatcacatggaaggcagttcccatggcagtaaggaggtctgttactagatgatgggacaaaaacccaagggttacatgtctttcatcattccaggaaggcaaaaaccacagacatctaccaaatttgactggtctggattgtttcttatgttttgagcttaattcactcgggcttatatactggctctttttcgtgcttttgcacaaatcgtgtatgcattctcaagcctttgttcttctttctatatgctgattctcctgatcagctccactactcccactcagctatgacctcattgcagaagaagccacatccttgtctctggtctctacctttctcagggaaagctcaccaatcatttgcatttggggtcccaggagcattgcaacttgaaatgtctaaaaccaaagttgccaccatcctgccaaatgggcttctcttcctaggttccctaatcacagtgttgcagaactttgttccttagttcagcttatactgggttcttgtcacacgaccagaaaaaattaggcacatagacacattgaagggtgaggagaatggaatttattgggcgaaaaggaaaaaagaaaaaaacgacctctcagcaaagctagcggagttcctgctaacaggcccccatctcacagattggttccaggtcacaaacacaggaactgaagagggcaggctcctgccccttgcacgcacgggaaattcccatggctccatcctattctcccactgctcaggcaggtagagattctccgaggaccctcccttttatctgcctcctgcatctatcaacagcagtagcagcatcctctttctactctcccagcattctatcgtcaatgttgtttttgactatttcctctgcatatcatttctccctcatgtgaactctcatagttctttattattatgttttttgtgaatttataatttcctctctggttttatagaccttcatgtatctaatttatttctgccacagtgatttaagtttgctgatggaaggcagttttacttatttatctttgtactatttccttcctggttgtcatcctccagctttccccactttctacttctcccatcaatattatacctagacttttatggtttgataaatatttgtagaataaaggaaggagttaatgcaatctgtagtataactacatggctactatacttgatattgttaaaaaaccagtgcctaacagcagtcgaagtggtaaaaacagatttcattcaggaaacattgcaataggggtatgttagagttctccagagaaacaaaaccaacaggatatatatatatatattttttctcatatatatattctcatatatatatactctcatatatatattctcatatatatatactctcatatatatattctcatatatatatactctcatatatatattctcatatatatatactctcatatatatattctcatatatatatactctcatatatatattctcatatatatatactctcatatatatattctcatatatatatactctcatatatatattctcatatatatatactctcatatatatattctcatatatatatactctcatatatatattctcatatatatatactctcatatatatattctcatatgtatatatactctcatatatatattctcatatatatatattctcatatatatattctcatatatatatactcatatatatattctcatatatatatactcatatatatattctcatatatatatactcatatatacattctcatatatatatactcatatatatattctcatatatatactcatatataatattctcatatatatactcatatatatattctcatatatatatactcatacatatatacatatatatatacatatatatatacatatatatatatatatatatatgtatatatatatgagagattatgaggaattggctcatgtgattgtggaggctgagaagtcccaggatctgctgtctgcaggctacagattgggaaagccaatgctttaatttagcctgtgtctgaaagcccgagaaccagaggagccagtggtgtaaactctagagggagggttgaagaaactgaaatcaaatgacccagttcaagcagtgaggaaggaaaaaagggacaaattccttcctctgccttttgttctgttcagaccttcaatgggttggactcacactggggagggcaatctacttaacggagtccaccgattcaaatgctaatctcatctggaaccaccctgcagacacctcagaagtaatgtttaacgccctagaaataatgtttaatttgggaagccagtggccagtcaaattgacacaaaattaatgatcacaaggggaaaagagacctcagtatggaacttggctcaactccaaatacaacatggacaagtagggatttacagccaaggaggagcaggggtaggagtggggagggggtcagtgaatggaaaattactaagaggaaacattaagggtaggggggattttggttaaacagacctaacaggattcttgctgaaggcaggaccagggtggtcagacatggagggtgagggaactctctttaaactgagttagaaggtttcttgctaacaccaggtgatgcaggtcctgtaaggatggatgctagggtcgaggcctgggctcagaggagcctgactgcagtttagtcaaggagagaatctttgtcagtattgaagctttcagattcagcatttattataaccagatctcaattgtgtaaaatgctaaggaaggaacttgccctaattccttgagcttccttcatcctctctctgaaccagccccccactttcccataaggacatgtttaggaaagaggcagaaaaacttctgactcataaaaactggtgaggaagaaggaagagcagaagcggaagccaaaatgcacataactatttgctgaaacggttttgagcatactttgcggtctcttttgtaatatatacctagcccctacctataatgctaccttactttggtgtttcacacatacaaggcccatttgaggtcaccctaatgtggcaagagaccagtgaataggagcttaacttcaaacttagagtctttatgaaaaatgtcaacgcgctgaacacgaggacatctgaaaccttaaaaggccacagcaaacatcagggcagcatgcttgagaacagcagtgtcatagatacaagcatgaaaagaagtaaagctgtcataaatgtgaaggagctggcgaaagcacatggagttttattaaggcagatagcattccgtacaatcatcctgaatagttttctgagtagcacttgatgatcctaccctttccgtaatttgtttgttcattgttttggaggtgaaagggtgtgcttgtgagggtgtttgagcctccttgtccatggtataaccggttggttttgttgccctcactcttcaggcgctggactctcatcctgtttgttcccactctgggaggcaccaccctttctaagacaactgctttcttttgtttctggttcaactttgttaagtcaaagtataataaatatcaagattgtttgaagccagaaataggccactgtccaaaattgtgttcattccacttgctggtagatagctattttaaataagtcaggcttgccattaattcagttctgctgcactgttcgtattctgttctcattctcttatcatgaggggagctttgagttttatcatctctacatctctgtgttcttcgtggtgattggacagttgccactctccatgactaccgtgactatccctgaccacctgtccagctaaaatttcaacacaaatgctgcacagctaagctatctgatggtattaattatatatttatttgactgcactgtttctttttttctaattgtatgtaggagggtgtctttaatgatgtacagttggcaattctgacatccttaagggtggtggcattcaagctcgtgactgccattcacagcaagaaatacattttacatcatgatccagtatacatgttcatgttatatatgatgtgtaactaaagtttggttaagcaacacttaccctattatgtgtgatatggtctatagtttctattattttgtattttacttcattaaaaaatgcagactgtgccttagcaagtgggcgtcctgattcaggaatgggttacaatttgagtctgaaaaagaactgcttaacagtcatcaggtattagggagccttagcatgctaattctgaaaagtctttggagattatctataggcatcttcccgttttcctcctattttacagttggaggaatttaaagtccaagtagggtaagtcttccttgcagggaaacagtggtgctctctgtgtgtgctatcatgtgctatcacacctatttattcctggaagcacacagtgtccagttgaaccacaagggctgtctactttttgaatctagcaattatgcttctggatgccttcctggtgatgaataaactgttcacactttcccttccccaattaaatcttgaggtattttctccctccattagtttattatacatcattctgagctaaagggaagactgttaacagggcattgagtgtggtgtatcctcttctatggatggcatgcagctatcattaatcataaactcaaaacagtgggttgaataaggaacaattttaggtacatacttagacattaaaaaaatctaaatgtgcattttctgtaaggtagttgtaatcttagcgttggacaactgcatagatcttggtgtatttgattatttgatgttttttcatttttcctttataaacagtagtgatctccttgtaacaaaatatgacattttaaatttcattgtttctgtagtaaagggaattacagcatcttatggtcaaacaattaacatcaactttgagttattgataccattcatagtgtattagtcagctcaggctgccataacaaaataccaaagcctaggtggcttaagcaacagaaatttattttctcatagttggagacttgaagtccagaccaaggtgccagaatggttgctgtctgtgagggctctctccttgggtcacagagagcattttctcgcttcctcatatagcagagaaagagcaagtgagcaggctctttgatgtctctttttataagtgcactaatcccactggaccagggccccaacttcatgaactcatctaaacttaattacctctcaaaggccccatctccaaataccatcacactggggattagggcttcaacatgtgaatctggggagacataattcagatcatagtacatagctaaggtcttattggggtttaagcattggctgaagcatgcaaataacttgcctaaattacgtttattaaagacagactcttccatttgagtgaatggatatttttcacactataattcttatgacattcagtagcatttattttatatttttcttaataatgcaagtactgtatatggaagagcttacagttaaaatgtgagaacaacattatacctttaaaaaattatttttgcagtttttttcctaatgtagattctagtccttgttaatagttaatgaatttctaaacagcccagcactattttcaaaacttaatatagaaaagttacccaacgtcattgagaataatgcatattttaatgaaaaacagtttgtgcaaaagacatattttaaaacaactttttatatttatatttattgcagtgtagagaagagaggaatttcttagcatgaaactgtagggagccaggtatttgtctacaagaaatgctatagagagccatgccagtgacacacacaaaatatccattcaaactgaagaaaagtaaactaagagggggtactgacaataaaaaattgttttaaaaccctttgtttgaatggtgttggtgcacccctattttaaataaagtccttagatatgcccaaaccaattcttatttattttctgctgtaggaaagctgttgattaagaagggatttttttttttctatttttcttgtttctaggtttaaactggtgtgggctgttttacaactttaggggcctttcaatttctgtggtgggcttttgtataaagagtgctgtgcatctagatgaaatagtctgtgtctctttatagcatctttgcttatgtgcttttacacattattatcacattttttttttgtttattctatttcagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaaggtatattagaagcattttttctcttttatttgaaaagtctatgaaccattgtgaaatgaagttaatatgcctctttttctgctttattgcttttaattaatctacatagaacttcttcgaataatacttatattttgaaagtatttggaataagaagaattataactcatttaagcttcataagttatgctcttctctttgttgaatcaaaattacatttagtacacttaaaaactttataaaatccagttcttgattttaaacaatatatattttatgctgtgcatattggattgcattttctttggcttataattgatcatttcatttccattatcttttgcttaccatattattttaaagcttgtcagtttatctgcagttaccaatgaagagataagagaactagcatgcttctagattaaattttcagggaccaaattattagttttaattttcataggtgaaagaaaataccagagactattttaagtgactataatggtatttccatgaatatgtactttaacggtatgatctgatgcaaagaaattttaaaccataataaaatatatgtatgcttaatatacagctcacatgcttaaatgtgtagaagggtcactttcaccaatgagataaaccaattgttcagggagtctgtttgaaaattatgttggaattttaaagtttcgttcatttgttcattaagcaaatatttattgaacgacataccaagtattgttctgtgcactaaggagtcaatggtaaacaagaagaataattatctgtctttttagggcttacagtgtagtggagaagatttaaacaagcaaatttaaacaagcaaataaacaacatagtttcagagtgaaaggtgctatgaagaaaataaaatattagtaggtgagggatagaaggtgatagtgggtgagtgtcatcttagatagatcaaggaagccctctctgatgaggtatcatctgagcagaaggagagggccacagcaaggtcgtctctagtgaagagcattcttgattgagggcacagccaacatagcttggcaatgagcttggcatgagtgaggagcagcaagaggctcctatgtgtctggagcctagtgagttggtggggaaggtagaaggatatatgtcctggcgggagatggagaccaggtgaggaagccttgcgggaggtggtaaattgattgggttttattctgaatgtagtgtgaagtcactgtaccattctaaacaggggaatgctgtgatctcattcaaatctgttaaaagggcattccacctgcctacaatctgaagaacagattgtaatggggcaagagtagaagcagggtgattggtcaggaagcgattgccaggagctgatgccaggatgatggggacttggactaaagtgggggaagtagaagtggggagaagcagtagattcgggatgagtcctggagatcatgctaaatggtttgccctggattgattgtgggagagggaacaatgagtcaagtcttgagccagagaaaccggagagatcgttataccatttcccgggatggagaagactgggaagagccctttattgtagaggaagggagtggtgaggataaagaatataatttttggcgtggttgctttgagacattgacatacacaggtagacagggaggtccagtaggcaaaggcacacagacatttggagaggagattgctttcagaggagaggtcaagactggggatttgccagtctagagatgatatttaaagacactggggctaggcacggtgactcatccctgtaatcccagcactttgggaggccaaggcagaggattgcttgaggccaggagttcaacaccagcctgggaaacatagtgagaccccatcacaacaaaagttaaaagaattagctgacatggtggcatgcacctgtaggcctagctacttgggaggctgaggcaggaggatcacttgaacataggaggtcaaggctgcagtgacctatgattaccccactgtactccagcctgggtggcagagggagacctcatctcaaaaaaataaaaataaagatgctgttctgagtgagctcatctgacaggagtatagatagataaagagagtaaagatagagaagaaaagggaagacttaacaaagaaagtgcctgttttcatttccggattcctttgtgcatgtacacttcagtctccctctatatgaataaaagaaataacaacaacaatgacaaaaataacaatgatgatagccaattcttttgtggtacttactatatgacaggcactctttgaagtactttacatattcatatattaatttcatgcaactatatgatgtagacactactattcccattttacagccaagaaaacaaaggtacagggagtttaaagtcatttgctcaaagttacacaacttgcatgtggtagagccagattcagcccaggttgtcttggcttcagaacccatgttctcattgatattctgtatttatatatacaaagcatagaaatcaccaagtatcatttatcaatataatttgcaattttgtgaataacagtaatttcaattttgaaatattagtaattttgaattgctaattgttcaagcaaatatttttgctagagtatatttatatttctacaagcctgtttaatacagtttgcactttacattaaaaagtaaattcagcaaacgctttaggatactacccttgactaatagtattgcacagtaaaagcacagactctgaagccagtttacctgggctcaaatcccagctctgtaattttccagctatgttgagaacatgactttaaccttttcctgcctcagcttcctcatctaaaatagtacctttcttatgggcttgctgtaaagattaaatgacttaatatttgtaaagtacttcgaacattattcagtacctaggtgctgtggtaggcctgttagttaggtctgttaaataactacatctaacgtgcataactctaggtacaggaagtgaggtttcagaaaaagcaaatactctactctgtgcaggttacttacttatattcaaaagtaattttttaaccccagttgctctgtgcaagttaattactcatattcaaaagtaatttttaaaccccagttgactaggttactctgtttcaggaaccaggagttgagaactgggaagtcagaagcagggtgtgagaggtagaattctagggacaacactacaaagtcataaaatggaaaagtcagcaattctaagttatgggatcaccaaatattcagacagataacccaataaaaagagaaatgcctcttagggtgcatattgtcttaggaattgaaatgaggctggagtggagtgggatcggggggagaagatatggaaatgtttccaggggaatttagggaaactagtagagtgcttgttactactcatctaagatgtttaacttggcactctattgcctttttgatgtgatatcttgattgttttattttagtgcagctgtatgattatttaatatctctatgggtcagttactttaatagtacctttatagaattgttgggagtatcaaatgagttaatatacgtaagtgcctagaacaatgcctggcacagaggaagaagaatgtctttgttcttatacatgtgttcataggttcaccacattccctggcccctgtgttatcctattgtttttctcactaagaaaaacattttaaaataattaaatgcactggatttttcatataacttttcacttaatgaagagtcaagtctttagctcatccaaagcaataaaaaatcaacataaaaacaatccaaatgatacaaaaatttgaatacatttatgttgacatttcagtgggtagacagtaaaatttctcagaggcctcacattttatttttgaaagtatttcatgtgctttataaaatgatattgatgagtacagtaaactgatgataagttaaattctctaggagagaaattaattgcattttagtaataatttaatggtctgaaattgcctcactttttgatgaagttgcagaatcatatttaattcatatagtagataaaataaagaatattaattgaagcatccttggagatcatattgtccaactctgtaatacaactagtgatgtaagtccaagttccagagaggttaagtggcttcttgtaggtgtcgtacctaaggtgaaatgagagctcctgattcttagtttgttcttcttttcactgagtaacagtgaattaaatgaactaacatttatatcatggtctacttactaattttttaaacataattgtaatcaacatttattaaaggcttgctatattccagggacagcattaactggttttattttattcttgtaataactctatgaaataggagctattttaatctgcattttaaatatgagaaaactgaaacttagggaagtcaaggaaccaacctatgatgccagtgaggggatgagctgggatttgaacacaaatcctctggctccagagttcacactgttaaacaccattctatacagtttcacagttaaatggggccaggcaaaaattgaagcctgggctgtatgcaggtctgcaaaatgggtatcataatagaaccatatttcctcactattaaaatgggaaaaatagcagcacctatctcatagggttgttgtgagaattaaatgagttaaaataggtaaagttcttagaagaatcttacacagtggacagtcaataaatgtaaactatcctgactgtatttctttgaaatctattaaaatctttcagggttcacttataaggagactggtccctctctgaaacagatcgtttgagaaagtcccacgtatatatggagatgtccaaggaatagattcatactaatgtatacttttggtgcttcagttaagtggaaagtgcttcagttgaatggaaactccagacatttttttctgaatgatgttctaacaatacaagaaggggaagctatgcagtgtgcttagaatgtgatgaattacactcccaccatcccccaagttgtgctgataaatgtgcaagggcaaagaaagttagaaagttggataagcagatcgattggtatttctttttgacagagttctgctgcaccttgaaatggggaatttatcaattcattcagcaaggaatgtgtgctttttcgtggacaattttctaggcactgaggatgaataaaacatagcccttctcattgagaatcacacagtttatatgatgtaggcaaatatatcagtgataaaattactgtagcacacaagaagtggtaagtgaacaaagagtaatgggaatcctgaccagccagggagtactgcctggagagcagggaagcttcatagaggagatctttgtgttggcttggaaggccacgtatgactttcttaggcaaggaagataggaaagtgttttcagacagagaaccacagtgtaaaggtaaagctcggttgggaaaacatagtgtttgggtaaaggccatgttgagaagggggtaaataacactggagaggctgtgcaagggtcagtttatgaggggcgatttcaaatgggggcatgagatgatcacttttgtgatttagtataagtctgtaggccatgtcagctagtaggaggggcaccagatcgataactgtcatgttatataagatgagggagtgagaggtgatgagggtctgacttcaagaccactggcaatgaggatggagaggctagaggtgagagatgcctgaagcagaactggtagggtttgatcaccagttgtctatggaattaattggtggaaagtgaaaaactgaaattgatcctactgttcctgttatttatgtaggtagtgaacaagggtaatggaacaggtgtttgcagggaagctgatgagtttaacatgtgcatgtggctttgcttctattggcacttaacaatttctttgccttttaattttagttttcaacatgtatatatcttgtctacccaatgagattataaatatttgttgaatgaatgaaggcatgtaggctagtgatggatagaagtatgtttgtgttaagagaaattccatgtagatctaccacgataaaaggtgtggaattgagaactctctccaagtggaatgtctgtggggactagtagtattgtttaaggtgataaggtaataaatgggaatgaagtgggctgttaggtgaagttgtagggcatggccaggacctgcaactgataggaaagtgtctggagaagatgcagtcgtcatggtcagtgctgtgatgattctcggggttacatagtaccatttataatctgaccttttcatttggtacttagcacaggtgactttgtatcactctgtgtgtgtgtttgcacttgtgtgtgtttgtgtgtgtgtggtggcaggagccatggtttggtccacgtcatctaggctgaatgaacatttactaagtttgtttatttgtacatagaaattctagactaacaataattatagtgaacaatctcgtgttaataaagtatgtataattcaggaaaacatttttacagttttattgagtcctttgggcttttgaaaaatgagattatctctaaaggaataataaagcatatgctaaaaaatgtgggcctgggagccagactgtccaggttcaaaatccagctttctatctgcgtgattctggcaggttacttgaattccatctgctttggtttccccaactgtatgaaggaggtagtagtatttctcttacagggttttgtgaggttcaaataagttgacatatgttgatcacttagcacagggcctggcacatggcaaatgctccctgagctgtaggtgttactagtgtactccactgacagtgccatggagaaaagtggcccaccatttaaacatgctttctggatattttaaagaagtggctatgcagaggcagctttctcctctgtcacactgtactttgtgtacagtgtgtggggccagaggcaaagtcacatgttgcacagccctgaggccacgttgtatctcagcctgcacccacacataggtgactgtcctgggtatgtttcacttgtgttcccattttgtccttacaccagcccctttaagatagagagagggaaattgaggcccaaaggcaataggtcacacatgccattagctatagagcttaggatagtattcattcattttattctaagcaatacttattgtgtgcctactgggtgccaggccctgggtctccagagatgaaagatgcaccacctttttctgtcaccagcatctcttctgtatggaatatttttgcctaatttgtgtctcacagggtgggttatgtaatgcagctgctccctcctgccccatgtgctcacttcctgagtgcttattgcatcagactgactttgattcccaggaggctccagctggggacctgaggtgctgctggtgccaccttctctgaggagatgctgtcctcaggagtctgaagacaaatgattgtgacaaactcagtgttagcagctatggtcaccttgaagctagctcactgtgacccatctccatccctgccctcccacccatcaccccatacctttgtcctgaggctcacactgcccctgttttttcttttttttcaaaatgctgttttaatctattccttgagccatagatgaaactaggtggcttggagcctgtggatctcagattgtttgtcgctgttcgctgttctagatgttctccaatttccctgcaagctgtaaaactcattaatcccataatgatgatttagggctgattaaaacataaacagtattactattaatgcttgctatgccatatttgtattctcagttttctatatacttttcattgagtagattttgttcttttaaagaagatatgtgtcttaagcttttaaagacacttttaagcttaatgtacaggaaaacatcatttggttccttgctctgattaatttctactctcttttccctctgacccacagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggtaaggatgttggctatttgtttctgtgaataattgtttcttttgaacgttttagcactttgtatgtttttagcctccataattcttacagcgttttatggtctagtttatagtgtcttggataagagaaagctgaatcacagcaattgtaaaggcttgtcccaagctgcagtggatatcactatcagagacaaaattaatattctaggaggccagccactaggacgtgctcagacagctctgggacacctcagaaggccttaaaactttattctgccttgcacttggcaaatttaatttttccacacactgtttcattatttatttatttatttatttttctaaagagcatgcaatgtcaactgtactgcaaatgtcaaatgtaaatttataatgtatttaacatataccactaaattccctcatatatttactacagttataagtgactagagagtaaatgagagcatggttgacaaaccttttcattttttccaactgtggaaaaaatatcaattgaggactaataaataaatagcaacttattttttttctttgataaaatgtgttattgatctatcttgactatagtgcacactattcaatttatttcaaatctgtgttgtgcccatataaggaagagaaatggaggaagggaaataaatgaaaggaaaagagaggcaatgttgaagaggaaggaaaggagaaagagactttcatagaagggatccacaaaggggaactagagaaatatatgtatacatggactgtatctgccacccacaatgcacacacacagggagagacaaaccccatacagagagaaaatattaatagtatttcagggagtaccacccttatctcgtaatttttagaaaattataactaaagcttcctttaatttttcaagctatacattgaaagtgggtatataactttttagagttatagatttattatcattatttgatctaggacctaagataatatctatttcacagcctcaattgtagagataaaaaatattaaaatttagggtggttaaataatttgattatagccttacaatcagctagtaacaaagctaggatgacaatacagattttctgatttaaaagagtattatatacataatacatttaatatgatataatatatgtatttattatctcatctgctttatgggtcaaagtaaattaaacaaactaatactgtatgtggactaaagactctacattgatgatgttaaggttttctattttcttgaagtttaacaatataaagaatctgtctttgtaataatctctcaaattttcatagagttttttgtagcaaaatgattttccttttcttatttcactttattttcataacctcaatgttaggtaaatggaacatttatatttatatagccattttgcattgtataaacaggcacaaagaagttattcaaatgaggatgcggccatgatgtctccccagaggcaaacataggacaagaacccagacatcttctattctgcttcagaggggagatttacaatgtgtggaatggtgtaaagttgtggcttttcacccattagtctctcctctgattctatttatttgaagtttatgtgtcttgtctgttaggaacatcttgactctttataacttcaaactctaactccagttctttgtcctttaaagaaagaattattccattcttattgctgtgtgtgtgtgaaagagagagagagagtggtggcaattttaaatcttctttttgcttttattcttgggcctaggccttgatttatttacctttttaggatttatcacagttctgtaggtataagaggatttctcttgggaaaacagtaatccaagtggcctgccatatttgttttaaaagtttgattctggatatcatggactaatatattacttttagagacagtaggtaatcaatatctcatttatcttcattatctagacctaatatcgtattctaaagatgagaatcagagctgctgctttactgctaaaagtttactctttcaaggcaaatattgctgtaggtgttataggtgggaaactgtaagattctctggtggctttatttaatgagacttctagttgtaaggtttttgtgccatctcatacagttttgtcattcaaatttcaaagtttttgttttgtgatttttggcagctaagtttccaatattacttggatgtgaagagagacttagaacattggtgagaattgcatactggtattattttccagaaatcaagttaaatttcttggttttacttgaattgcccttttttctcccttaggcatttggatttgatcccaaagtcgacagttatgttgagaaggcagttgctgtgtttggtggattttacctacttttcttttttgaaagaatgctaaagatgttattaaagacatatggtcaggtaaatggactttatttaaaacatccaatattttaccccctaaagctactttatataggcaaataaagacagaaattttatttttagaattatgagaatggtccagttattaggcttgtgagtttaaggagaacaaagagtcaatatattgacaagtataagataaatacttgattcatgttgtaaaatttggaggttatttttgttttttttcaagtatcagcaatttaatattgaataacagatgtgcataattcatattctattcatattcatcaaaataagagtgtatacgtgttctaacacgaacaaacagtaacagcagaatctaataaatgaaaatacatgtaaaaaagagaaattttatatatctaaaaatacttctttacacatagaatagacatacaattttcctcttataaataaaaagcagtaaactctatttccttgtctgtatgaatcatcttttttcttcttataatctctttggtttttgttcccatatagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggtatatgttaattccatttttccttcattatactgcattctttatactgtgtaaacatgactgtttatgcagctaagtcagtttttgtacatttatgtatgtcagacttattcctatatatgtggggtaactggaatgtaagtctgcattgtttttccaccttccctgtatatgtttactctaaacaagtgagttaagaaagaaattgtggatcactgttctggacttcattattctctaagattatttactatatgagagtctctcaattgcatttatacaatattatatagcaaaatttattcagagcatttattttacaattctttgaagatccagaatcaaataatcctttgattgattttgaaattgcaagaagatttgcaaattattaaaattgtttttattaattgtctgacttataatttatatttatatccacatcttctaaataatattaataggcacaatttcttgagcacgtatcatataccaggtaatatgcttagcacttaattatttgatctcatttactttttataacaactactcagtgtagggattatttcttatgtattagaactatattggtttcaagtgatagaaatcaaacaaaattatatatgcacaaaggacaacttactggaaagatactagatgactaatagaacagccaagctacaggaaaaacaagaacctaggaaacattagaacccctaggactctccctccttctctttcctgtctcttagtatcattcttttctttcactgtaggctatcttttccataagtgggatacatagccactagcagttcctgaggtttgtcttataatttcagctactagaaggaaattgacctgactctttcagtcctaaatccaaaatctctggcaagtgtcttcctggttcagcttgaattagatgatcacttctagactaatctaagtgcttagagggctgggcccctttaatggtatcaagggaatgtggatggagtagaggagtggttatcaaaaagggatgctgaaaagatagtatcactggtgtctacaacaattctcatttgacagatgaagaaagtggaactttagatgttaaataacccctccaggtttactcagctagtgaatggcagatccacaagctatatagttaaacatgatataaaagtgaacagctaaaaacaaaataaaaaggaaagccagttaaggggaaaaaaagcaaaaaaaatagagcaatctggaagagattattatggcaaatacctgagtttccttctggaaagaaaacatgattggtcatatgcttctctccacctgattaaggaaaatctcaagtgtatttgaagagccagttctgtgttagcactcagctaagaggaaattattttttgcagtgtaatgaatgatgctttcagccaagagtttgcaaagaatctggaaatgttcaagtatataatttcttacaataataattacaattaacattcattaaatgctcaaggactatgcctagaacgttagatgaattacttcatttgatcttcctaataacctagggggcaagtgctgttgtaattaggagagtatgacttagagaggttaaatagcaaacccaaagatgctcagttcctaatggcaaagcttggattagtaccaaggctgccttataccgaagcctgtgttcttatatactttgctggactgccttccttatgttgctgctctactgtaagcaagatgacaacatcaactgttaaatatttattttttgtagtggggaaaaataatttgacccaaggatattgctttctgaggatatattatttaatgcgaggcacagcagagaaagcctaaagaatagtagttaaaacccttccttataccatgtgtctaaattctagttgccttacacaagcttttggcaaatactggattatagtgagattgtggttgaactctgacaagtcattcaagaggtgccagtcagctatattgctaatttaaacattgattaataattctttagataccagatggcagagggataatctgccatgaaatttggagcctaacttgaattcttgctctgatggaagattttcctgtatctttccagcgttaacaagataactttaggcagggctacacttctacagagaaggagctttgaacctggtccaaccttgaacaagttctcccctgggatcctcaagtcctgtaacacaaagcacggaagagatacagtttgagatttaaaatatttaaagggctgatcacctccttgaccatactagaaactcagtgtgacctctcctgatttcaggaaagttccttctgatgaacctactaggataaactagctgctaaatgtgccttgagtatcagaatgagctgataggcatatttatatttagaaaggaggatggctgtcaaagccttcagcttttgtgagaggctaaattatttttttaaatcataattaacaaataagtttaacttctccaaagttatattttagttaaagatttaaggctcctgatttaggattagctatgggcagaagacatgtttgcagtaaatctaagcaccatgacaaagatgaggccctcgacatgatcctgttttacataattttgaaataaaatcagaaggctgtttttattccacttatgacagtaatgctttcatttacttattcaataaacatttattgagttcctgttcattgtcctaggcactggaaattcagaagcaaattcttgaggagcttacagtttattcaatggaaacataaaatatagaaatgagcaaaacaagaaaatatcatatagtaataacctaccttgatgaaactaaagcatggtgatgtgagagtgatgtgtgggagcttcttttgattgactgttcagaaaaggtccctcaaggtgtcagtagggaattgtataatgagaaagaaccagtcatgcaaatatcggggaagaaaatatgctaaagactttgagaataatcaaacaggtcacacacaagggacctggaagctgaatggtagtggacttccccacatcaatgctggagagcagtggcacaattccttcaatattctgaatgaaaacaactgtggaattataaacctaggtaaactacctatctagtgagagggaataatggaactaagattctggaaatacacttccaggaataagaaggcagctgaagaaagaagagaaggtgcgtgccagggtgacagccctgcaccaggccttgagataatagttttgacgttaatttcttatggggactattttctcgctattttggttgaaggtatagtctcaaataaatagacatttaaacaaattgagcaacagactgcaattttcagttttgtttacattgcacaaaaaatcaaaagaaatgaaatttaagaaataagtaggtctggatattgctttaagagagtaagtattacaatataagtgatagtgattttaataataaaattaaaatactttctaatattttatattataaaaataatctaacctaggtgaccccattaaaaggattgaacatgataatataactcagggttcaatttgagttacaagtatggatttaagaattttgttgacaatcccggctgtcactgcttcaacaaagtttttccaaattgaaaataataaggaactctctaaaaattacagtgagttaagaaaggtggtctaattggcattactgtcaatagaatgtaaattatgtgaaaatctagattataaaagcataatttttgatcttgctgaaatgtagaaagaacaaagacatgttatagaatacttaaactgtatgacttaggaatgtctttattattcatccaagcaattctggctcattacagaatactcagctaagcaataatatttaaatttagaagtctctggtgttttatctgtgtttagtcatataaaaatcatagttttacacatatgtttttattttgttttcatggaagcatatttatcacagtgaaataatagaagatattaacatttaacagttagcttgattataacttttaaatatttagacgaaatgatttgagagttccttaatacctttgctccaggcctactaagtgtgaggcacaacagtctatgtggcatgcgtgtgggcacgtgcatgctttttggggaaaagtgggggtcacagaggggtaaaaaggaagatgtaggaaaaagaggggtgcacaagatgctatttccccagttattcagttattgttactaggtaatgtgtcacatgtcaccttgtgacatgctttgtgtttttctcttcgacgttcctgtgtagccaagtgtggagtcatttcactatctctgcagccgggtggggctccccagcccagacacagccttggtgtttgttggatgttgattgctgaggaatgtttggtactttggggagggtgtcagctcttcaaggccactagagggaccctggagctcgttcctccagcaatctgtcatcagtctctctttttatgaaatttcctgtgctttcatttaagaatagatactattaaatataaagtgatttttagaagttgattattgtgaattttatgtgtaaagttgaggtgcaataaaatagaatttagctgcaaagtgtggagatgttagggagattttctttgttgatgactgatatgaagtgacactctatgaatagaatgctaacatttttgaggtggttgggcctccatgagagtttaaatacacataattcattcaacaagtatttttccagtacttaacatatacttggcattattctaagtgctggcacatagggcacagtggagaggagatgaggacccagagcagttttcaagaagtaacagatgaggtgagacagcagagttcacagattccaaactttccacccttccataacataactgaaatattacacattttgcacagaaaaatggaaagcactctttttttttttttaagtatgaaatacaaaaaaaactgactggaagttctgtgtgtacatatatgcatggggcttgtctaccagtcttttgggtggtgtgtttttctccattcttgcctggcggtgggaagaagggtagaatattactggctatcacttgggaagtggagtgggaggagaaggggactggggcactaagaatatttgacataacacccctttctttagtactgtacttcccaactgtcttcagtttgctttgtgtctttgaattgagggtctctctagttcactttccccaggggtagatctccagtcatcatttggggtggctgccttgccacattggcttgggaggaaggacttgaggttctacttgttccctaaatagacttgcagccacttctcttatgtttagttccggtctttgccctctgccttcagaagtacttggtgcctctaatccctgaacttttttgaggttctgggtcctgcatcactttgcttcttgttgactttctttgtgaagtcagtcagaacttgccttcctctttccatcttccaaaatacaaatctcaatgctgtcatgttgtctctctttcctcctgtccttgcagttttatgtctttattcctttataaggacatagcttcaagagggcatttcaggatggactagagataaatatgtatatctggtctgcactatttcactaaaagaccatttactattttaaatcatatagttcttgaacatcacaagatttaaaaacagaaattagttaatttcccctataataacaattaattaaaatagaaaactatacaaataataaaatgacataagaaatgatttccactgatcttgattgactggtacttacataaaaacagtaactagaggcagatgatatagccaatcatgaggagaaattctgggttgtctttgctgttagtggaatttctctctcactgggtctatctcagagcatccctgccctggacaggtcattttatctggctttactctatgtgttgctaaggtcatgaaaattggtacctgaatccactgaatttagcctactttcactgatatgaagtatacttttattcatgaaaaactgttctaaagttttttttttattactccacaaaattcttatttcttattttcttactttaacaaggagactgagatgatgatttggaatgtgtgaactctgctgtctcacctcattacttctgttacttcttaaaaaaactactctgggtcctcatcttctctccactgtcccctttgtgccagaactggtgtcctttctcctttttaaggccagttcctctaaatattctcatctttcctgtggcctcttccagttttgttttgttttgttgttttaggacagggtctcactccataacccaggctggagtgcagggcttaatcagagctcactgaaatctcaaactccttagcctcaagggatcctcccacctcagcctcccaagtagctgagactgcaggcacatgccaccatgcctggctaactaaattttttttgtgtagaaatggggtcttgctatgttgcccaggctgatcttgaactccaggtctcaagtgatcttactgccttagcctcccaaagtattgggattacaggtgtgagccaccacatctggcctgttttcatttatctttcctgaatctctccttttcccgtgtctacaaacaagttccatcttttctacctcaaggtgttatttttttcctcaatctgctactcccaagttttctcaaaccttctttcccacaactgtccaacttttctaaagattggctaattctgaaataagactatatatgttagacatattcttaaatgctttacatatattaactcgtttaatcttcacagtaacaaccctgtgaggcaagtacgattattatttccatcttgcagatttggaaactgatgtacagagaaggtaaggaacttacccaaggtcacacaggtaccacattaggattgaagtgcaggaatcctgtttcctggtctgtttggttaacttaccttacactacgctgcctattgtttccatttgttaaccagccttcctcatcatctccgtacatgcttaatcatgtacagtttctaaactcactacctattctctgaacatttttagaataatgtaagtggttgttctaggcagcatgtgatattcctctttttaaaattaaattaaattattcattttttttgagacagggtcattgtaacctcagacacctgggctcaagcaatgctcccactccgccttcagagtaattaggactacaggcgtgggccacaagctatgttcctaatcctcattcactctttcttcctgagccattcctatagtttaacacgtaagtgagtacctattgtgggctaaatgctagaaatataaaggcaggtttttcgctggagcccctcccctccctgttgagttacttatgaggtggtcttggtaacatgataccatccttgctctgtcaccattttagctgctgtaatactttcctggtgcttcttctgagtctccttttcttgcaaggcagttggatgtggaagagaagcataggctttggaattacacaggccattgtttgcatcttaggattaaaatatgttgtttgatttgggaaaaaataattaacacctttgagcctttgctcatctgttaaatgaggagcaaagattcttaatttactgatttttgtgaaagtgaaataatttcttatgggtcaactatgcaacattgtgtctaatacattgtacacttgtgataaatatacatctccctccctcttccatttaccatttttgtcttttcttagtttttatcatagtcatcaagtcgcatcacttcatcttttgcacctttgggaatagcttctaaatccatatgcttaattatgtaaagatcatcacttaaaaagatgacttcttgtaataaaccacatagctgtttgaatctatttgtatatgttccttctaggttagggtaacaaaatgagaaggtaaaatatacagaattccattctttctcatttttcttatctaccttaaaatttgagtagattttctagaaagtaaagctggactttaaaagctcataggtaatttagtaataaagacaaccttctgaatataaatgcccacaagcctgcctttgacctgtcagataaattaagagaatttggaacatttactctctcttaatggaagagaatcttaaagtccaatataatttgctattcaaatgacgatttatcaggctttgcaccaccgattctctgttagagccttgaaataccagctagagccacttgccaaggaaggaaaacactacattaagaactacttgcttttccccagataaaagcttgtccaagttatgtaaatttgacaaaagcattttatttgatagctaatgtcaggagggatctagggttatctgttctggttccttatgttagctaatcatttggccagctagtatattccattcttgtggaggctggtggcatcaacatttacacagaaagttcattaaaaaataaaacaaacattgggccaggcactgttggctcatgcctgtaattccagcactttgagaggccaaggcaggtggatcacttgagtccaggagctgaagaccagagtccaggagttgaagaccagcctgggcaacagtgagaccctatcttaaacaaacaaacaaaatgttgatattgccaactcttaggtcagctagtataatcaaataagattaggtatgaatgtgcttttaaaggtacaaaaatctgtactatttactctgtttggagaacagtcagtttcttatgggtgtcagtcatggactactttgatatccatatgaaaagataacattctcattaattgtgtgataaacatttaaatagtcagcatttttgtggagtttataattttaatcctttggaatgtgctttcaggtccatgcaaacacaattccaatgttatgaagttttgagttctggagataatctgtagacttttaggtttttcttttccctctgtgaatagttttttatatacatatatataatatatatatttacatatatacacatataaacacatatataaagttttatattatatattaatatgtatcatatacatatatattattatctaataaatagatgtgtaaaaatgggtcatggagtatgcacacatttaattttgctgaataacaacaaaatgctttccagcctcttatgtttgtttaccttctcatgaacagcaaaaaataattcctgttttctctttgtctttagcaatacttggaaatttcagacttaaaaagattattgccaatttaataagtctgaagtggtatctttttctgatttgtctttctgattatagtgcagttgagcatcttttcatatgcgttttggtcataagtttacttttatgtttcctattcatctgttttgcacatttttagttgagtttttttttcttaatgatttgtgttaaagaaaaaactattctgacacttgttaaaacagtaaggaagagtgtattcaagactgttgcaataagggttgcttctatggcaacagcggagagagattgggttcaactctaaataaagtaaagacaggttggcatttatagccaattagcagagagaggggaagaatgcatggaatattcttaagagaaaacatcaagggtagggggattcctactaaaccaatttaatggaattcttgctgaaggcaggccagggtgattatatatcactttggggatggtggagaatgaagaattttttaaaaataattatttgatttttccctgagtcagagggaatgaggaatttgatcagatattaagagtgatcatatataaaggatgaggggattcttgctaaactgacttggcaggattcttgctatgactgaattctgcaaaaatggacacagaagtcgaaggtctggttgagaagagacctcagaggagcctaactgaaatttggtctaagaaagagtctgtcatttgtaggagttttacatatattctggatgttaattttccttgattaaatgatttataaatgtattctccaaatctgtggtttctcttttcactaagatttccttccatattttctttcaaaaattttaagtttaatttatttttgtatatgaggatccagttttttcctgtataaataagcagttatcctcgcttcttttgctgaacagatcattttattcctgccgtgtatcaagtttgtatgtattaatgtatctgtattttggctttctagtctctttcacttgtctatttggaaaaaaaaaacaaaactctgacctaccaccacactgccataattattatagtttttagtcagctataaagacaaggtctgctcctcaccttgttttttcactaaaagttgtctttgtttttccatatcaatatcattgtggagattttcattgacattgcattgaatttagagattaactaggctgcagcttacatttttatgatatttaagattttttggtttggtaatttactatattagaaatatttttaaaatattctgttagatttcttcctaattactttgtagctccacaggtatcacaaatgataacttttttcctactgttttctagttgattattactgctatgtaagagtacactgattttagtacactggttttgcgtcctgcagtagtgctgaattctcccagtattgttttgtttgtttattcttttggactttctgcatccatattgaagagcaaagaagccctttttaatttgttttctaattgttttaactcttatttctcttgttttattggcaagggctcgtaggacaatgttgagtagaagtggtgatagttggtaatttgtcttgtttccaactttaataggaatgcttctaagctcagtaggttgctttctttagttttctttttcttttaaatagccttaattagattaagaaacatttttctcagtgttgaatttcattgcaacttttttctttttctatattacagctaaatataggtaatctgtacttggctgatttttctacttttagaattagggaggcttaaagcagagtgaaaaattaaatgagtgaataattatattttctcacaaaatttgtgtcatttttgaattatacattgttcattaggtgttaattagtaacatgaacattagtgcaacttatctttgtcaaaagtacttgagtcaggtagatttgagtttaaatctgactctgataactaatcgggtttcttcaacttctaaaactcactttcttcatctgtaaactggcaataatatctacaaggcaggattattatgaggattaaatgaaatatttttaaagttatgactaagagtaggtatgcattaaatactaaatcttattatttctgtgtctaccatacaaccatacatcaccatcatgctcctgagaagtgagggtgatggggattaagtaagagaaacagcatctaacattatgtatagatgcaaagccacaaagtcctctatttcaatgacggaatattgagcaactgttgaaagagtaggagacttggttcaaagtcatcgaatcatatgccagatttataagcacttatcaactggaaggaggaaagcattttatgcagtggggtttcttgaagacataatggggatcattttgaagattcaaaagtagatggattagttcatgtaagagcaatttatagccaagagtgatatatatgagggcttccagaatagactaagagaacagggcctccatggcagtttgcagagaacaaaatcaaatagcaagtttgagcaaaggctataaaggcagttggattgaatttttagaagttaattaattaaattgacaaataataattgcatatatttatagggtataatgttatgttttaatatatgtacacattgtagaaagatgaaattaaacttattaacatattcatcacttcacctatttttcatttgttttgttgtgaaagcatgtaaagtctacttttttaaaagcagttttgaactatacattatgctatcattaactatggtcactatgctgtgtaatagagctctaaatcttatttttcctttctaagtataactctgtcccttttgaccaacatctctcctcctcccagtccccaggcctctggtatcaaacattctactttgtttttatgagctcaacttttttagattccatgtgaaaatgaaatcatgcagtatttatttctgtgcctggcttagtatcctcccaggttttaaaatatgcagcctttaaaaagaaggaaatgacaggatttccttctttttaaaggctgcatagtattctcttgtgtgttgataccacattttctttgtccatttgtctgttgatggattgaattttgatgctttgcttcttcctgagaacacatttcctggtgtcaggttcattagaagagagcttgatggacaaagtcccatgtgctaggccatcccatccttaggggcataacaaagaaaaaacagaagaaacagaagaaaatgaccaggggccagagtggaatggagtggtggtatatttttagctgtgaatacaggaacccctgtggaccctagtatattggaccttctttgagaaggtgtgtctttgtttgcattgccctggctcagacgaatgagaataatagatcatcttccatagtatgtttatctgaagatagagaactggtgtggggtagggagagaacattttggaataattttcaagaaagaggagattgggaagatctgccatggacagcagaaactctgtgggtaaggtgagaggtccaaagtgtatttaggacgtgttgctgtgtggtgtgtgtgtgtgtgctgaataactcattccttggtttagaaaaggctttggcaaagaatgcatacattttcaatgcttctaaagttacatgtagctactctggggaacattattttgctgcaagtagctgaaagaagaggaaaggctggatctggtaaagagatataggaaaagactagaaaagtaaactattttaaggagtttgtcattgaagtgaaaaaaaaatgagggagaagagcagttcagtggagtatcaggatttgggattgtgttagatttaagacagagaggaaaggccaggcagacagggagaggttgaacgttcaaaagagaatggaagtcatggtagggatatcttatggagcacatttctagagaaaaaatgaaaatagagtacaagtggagctgttcacaatgaaaaggaaaagggttcttattctaagatgggatggaaggtggagaaagtgtttgtgggtggattgtgagttagatgttctcaatttcaggcaggtgggaagtagtaatgaaggactgtggggttggggaaaagtgggaaaggcttttaataggctctctcttaatgtggttcacgttgactagcgatgataatacattgctgagtagaaagtcagaatcctcagccctgagccagtgtcctcattttcaggggccaaattgttgacgtttaccttcttcacacctacaaactcaaccatgtactacacagctgtgagatacagagtggtggcccatctagttagaatcacacactgttgtagacaaggagaacagtatgccttgaaactctggagtgcactgggagccaggtgatcacatgaaagtagtctgcttctttgtatgaagttccagaaacatcattatgttctttacctcctggaaggctgtccctgctcagatattctctgaaccatagtcggtgtcaaaatcagatgaatttggttccagaccactgcaataaagtaaatatcacaataaagcaggtcacatgatttctggtttcccagtgaatataaaagatatgttttcactacactatagtctattaagtgtgcactgtcattatgtctaaacaatgacattgatatcttaatttaaaaataccttattgctaaaaagtgctactgatcatccaagctttcagcaagttctaatgtttttgtaagtggagggccgtgcctctgatgttgacggctgctgaccagggtggtggttgctgaagtttggagtgactgtggaagtattttaaaacaatgaagtttgcaacatcgattgcttctttcatgaaagatttctctgtacatgcgagaacatgctgtttgacagcattttacccacagtagaacttctttccacattggatgccatcctctgaacctctaccactgctttgtcaactacatttatgaagtattctaaatcctttgttgtcatttcaacgttgttcacagcatctataccagcagtagattctgtttcaagaaaccactttgtttgctcattcatgagaagcaactgctcatttattcaagtttgatcatgagattgcagcaattcacttccatcttcaagcttaacttctcattgtaattctcttgctatttcccgtacacctaccgtgacttcctttactggattcttgaacacctcaaagttatccatgaaggttggaatcaacttcttcccaactcctgtaaatgtggatattttgacctcctcccatgaatcataaatgttcttaatggcatctagattgatgaatcctttctagaaggttttcaacttcctttgctgagattcattataggaatcactactatggcagctacagtcttacacaatgtatttcttaaataatatgacttgtaagtcaaaactactccttgacccatggacttcaggagggatgttatgttggcaggcatgaaaacgacattcatctccttgtacatccccgtaagagctcttaggtgactagatgcactgtcaataagcagtaatattttgaaaggaatttcttttatttttctgagctgtaggtcccaacagtggactgaaaatattcagtaaaccatgctgtaaacagatgtgttaccatccaggctgtgttgtttcatttctagagcacagacagagtaaatttagcacaattattaagggccctagaagttttggaatggtaaatgatcattggtctcaacttaaagttaccagctgcattaaccccaaacaagagagtcagcctgtcctttgaagctttgaaaccaggcactgacttcttctctttagctatgaaagccctggatggcatcttcttccaacagaaggctgttttaccaacattgaaaatttggtgtttagtgtgccaccttcatcaatgattttagttagatctcctggataacttctccatcagaacttgctacttcacttggcacttctatgtcatagagatggcttcttttcttaaacccaatgaaccaattctgctaccttccaacctttcttcttcagctttgtcacctctctcagccttcatagaattgaaaagaggggcttgctcctactttagggtatgttgtgggtggtttgatcttctatccaaaccactcaaattttactcatgtcagcaataatgctgctttgctttcctatcatttgtgtgttcattggagtagcacttttaatttccttcaagaagttctcctttgcattcacagcttggctgtttggcacacaaaacctagatttggtctatcttggcttttgacatgttttcctcactaagtttaatcatttctatcttttgattttaagtgagagacatgcaattctccttttacctgatcacatagaggccattttaggattattagttagcataatttcaattctcttgtgtctcagggaatagagaggccctacagaagggaggaaattgggggaatggctggtcaccggagcagtcagaacacatacaacattaattggttaagtctgccatcttatgggggcacagtcatggtgtcccaaaacaatgacaatagtaacatcaaaatcactgattacagatcaccataatagatataataataatgaaaaagtttgaaatattgtgagaattgccaaaatgtggcacagaggcatgaaatgagcacatgctgatagaaaaatggtgctgatagacttgctcaatgcagggttgcaacaaaccttcaatttgtaaaaatcacaatatctgagaagcacaataaagtgaagtgcaggaaaaagaggtatgcctgtacctgtcactcctgaataactaatagaaataataatggtggtagttggtggtgtgatgctggtggtacctgtcacgtgcaagaaatatacccatactttgtaaatattattcatatgcaacattcatttaggtgtaattatcttgattgtacagataggaaagctgaatttcagggaggtttaacatcagagtaacgatttgaacttagatttgttacactcagagttcttttaaaaaagcaaaattacttcctgatttgtatgcttctcatcgattaaaatggctactttaaataaaatctaagtatacatttatttttgtgaaaaaattcatatttatttgactagaaatttttgagcatataaaactagaacttactgacataaaaaatagttattgtgtagtgtgatgagtactagagtagaggcatatgcaagttactatgttgagagagacgtggtgtgttttggggtgggacgtgatgcaaatggagtggcgcatattgggatggaacatgatgaaagcgaaatggtcaaggatgctcttctgagaaaatcatgcttgtatccatcttgacagatatgtaagactttactgggataatacagttgggcagaacagcaacttaagtgcagagagtgcttccagtcattgtttttaaacatttgtcattttctaattttgaaacattcaagaaagtggctatagaacaatggtttttaatcattcccttagacagccgcttgatgaagcccattacctgttgcaacagacctaccaaattttgcatacaatttaaaggggttcatgaactcactgatgctcctctatgacctgccagccaatactctctgatatagagaaatacttgaaaaaggaacataaatggctatgggtaagagtagagggcactggggtagctttttagctattattatattaaattcctacaatagcactatgaacttggtattaagtcaacttacagctgcataaattaagatccagttaagtacagtgactccctcaagttcacacagataataaacagcaaaactatgctgaggtccccttctggggtcttgcatcccaagctcatgtttgctccatatacatgatactaatttcctaatgagaatattgctgtaataagttatgatttctaacaattagcttacaaatgaacttttgtaaaacaacttgtagtgagttgaggattgcccgcatagtgaaaccttgttagttttgattaccagtctgtcatagctgataatttatgatttgttttattttgctatgggcttggctatagagtattttggcagcatctgtaaaaatttcttttgaaacaatttttttggcaagattgcacctaaagcttctcaattatctagagaaattccaagttgttattatgtgtttgatatgttgtgttagtcttatccatacactgtggcaggttttgtgaagaacctctaccgttatctcgcctttgatgctggagagcccagtttgttagtgttaagttctggaaagcaataaaagtgcatctatctaaacatgttctatactaaattgctttcactaatcaagcaggacttatccctatttagaagaattagtgaggttttagtcaattaggcttgatgtcaagttaatttttcctccattagtgtaatgaagaattgctgtgttgttctgtcatgcatgctgattgataaaaaaagttaataatgaatgccaatacatttttctcttgaaaaatgaaccaataatatatgaggttcaagtaaattattctgctcatcagaaagaattgcttattctactgtgtggaaagcccagtggcaaaccaggggaagcaatggaatatttaaatacttattctattgctggtcagtctttaacatcagctttttaaaagattgccttataaaggatgtccatttcataattgttggatgactaaaatagaccactttgttttctttggcttctgctatttgcttatttaaaaatatttatattgtgctctattctttgcatgctgcattctgcagtttgggaatactgaatcaagacctggtgagtaacttttactcagtggattgcatgatgaaagatttgccaaaccataaggtgttttattgtaataaatgaaatccatctcccttgaagaagcacttgcagaggcagaatttactctacattttattattccattttatttattctatatattcaaagtaaggattctaaatcaaaaagataccaaagctaatgcatcctgtaaatgaagtgtggtcttgccaaactgctttttgaggttgacattactatattatatagtaattagcagactggctcatgcacacatacacacatgcacacacacacacacacaccctcatctataatatttatttgtctctacaatcatatctattcagttttgtgtctgaggtaaatttccagataacaaatttcacttttataactattaatacttcactaataatcttagtgaataaaaaaagaattgaagatatttgaagaacaatttaagtgctgactcttaataaaagtattaagggttagagttagggcattgattaggtagtgaaatttgattctactatatgtctgcttcttagatagagaatttcagtcccattctaaggctctcaattcaattaataactcttcatttatttaaattaagtggtgacattctcctgcctttaactttgctctccatgctaattattggctcaatttatttagaagtattattatagaagttttgaatcctaataagtagaaagagagaccaatgtgtgagcctaattctttttcgaagtgattaaggtattattactttttatttgttatcaggtatcagaacattaaaagtaaaataaaagaacagactttattttactgaatctctttctacttaggaatatcaaagtgcttaatgaacatgactttatcgaacctttataccaacttagtgaaagtggataaaagtcagaaacgtttagcagcagaggaaacaccaatagagattacattggagggttccataagacattccggcctctggtcttatgctttctagtgtatcctcctctattaccaggttacaaaatatatattggaaaaaataagtgagggatcagccatcattatagtttcctgggttgcaaacaaacacccaaatctagagattatttccatttagaaagtagaatctcaaacattcttttctggacaaacatcacttttgcaaaaatagtctgtattttttttgtaatttttatagtgtttgtgactttgatcaaaatcccagaatcatgtaacttttatattaaaacaataatggcaatcttaaactgggcctctgtgatatatcaggctacttttgtgacaacattttatattctgaatgatatcctggtccatacattaaatcagtgatgctatattaaagcgtaggaagatggtattcagtcattcatttcatcatttattttcttctcatctattcagtgatcacctgccaagtgccaagctctgctctacaccttagaaattccatgacaaactagacagaaaatgttcatgcgctctgccattctggttcattctagtgggacacacagcccaacatcatagagttacaaatgccatgcaggcacttataagtaggagctaactaatgtgtacatgtggacatagaatatggaatgatagacaatggagattcagaagggtgagcaggagggaagagggtgcatgataagatattacttaatgggtacaatatactttatttgggtgatggataccctgacatcaccactactcaatctatacatgtaacaaaattatagttgtaccccatacatttatacacataaaatacaaaaataaattttaaaatgtcctgcagggaattaaaatgtgatatgatgatgtctgggtcactatgttagtgtgggtggtcagggatgacttcctcaaggagaacacatttaagttaaaatcagaattgtaagaaggaaccatccatgtgaatatccgagagaataatattatggctgaggaaacagccagtgagaaatctctatggtaggaaacagttcagtgggttttaggaacagaaagatgaacagagtaggtaggcacagtggatgcttgtataaaatgacattggaaaacattctagatagaaattcttcttcaaagtaagcattcctgtgttctaacacttaaacagtgttaataatacaagacattggctccaaaattacattttattaaatgttataaactaagaacgggtcagtcaggaaaacaactgtcttttgcaatcagtttttgcaatctgtaaacagtagattatatgtagtggatttgaaagctctaggatggtgttttttttctcctcaacaattggaagtattattttaattgtgtgtgaagtgttagcaatcctcagaacacctcagcacattagttcagtgtcttctactcaaaaccagaggtacttgaatcctggaggtactccaccttccaggatggagactggcaaacagcaataaaataataatttcttaccttatagcaacaagctacttaattcagaaattcctcatctgaaaaactcaattctcttgagcagtatcttgacctcttattgcataggcttaggagtcaaatagtctgggcacaaatcctgactttcccattttctagctgtgtcgttttgggcaagtcccttcttccagtgtcctcatttatttcctctgtaatcaggatgatgtacttatcacaggcatttagaaaagcatcttgcaaacaataaatctttaacaggttatctgctttcattgctaatattcttacttttatgccctccctttccaaaccatcttctgaaaaaatatgtaagtccacaaagttagatgcaagatggttgccaataaaagtcttctgccttgagggctgggtgtggtggctcacgcctgtaatcccagcactttgggaggctgaggcaggtggatcatgaggtcaagagatcgagaccatcccggctaacacggtgaaaccctgtctctactaaaaatacaaaaaattagccaggcatggtggcacgcacctgtagtcccagctacttgggaggctgaggcaagagaatcgcttgaaccggggaggcagaaattgcagtgagccaagattgcgtcactgccttccagcctggacgacagagtgggactccgtctcaaaacaaacaaacaaacaaacaaaaaactgccttgatcactagaatagaggaggaagcctctgagatccattgactgaaatgtattttgatatttcatttctctacttaattcagcacccccccccaccatttaattaaaaataatatttattgaacacccattaaacgctaaattctcggccaaaaaggaaaaaaacatcttgtcctgccaggagattttaatccagttcttcaactctcagtagctaagaattggcaaacaaacaacaaaagcatctctgcactgaattttatgttatattggtgaaccaatttggaattgattaatgaactttttttatgcacatcctttccatgttgtgcataaatgtccatgtgtttgctctttggaaagactggaatacatgcttcatgggacaatgatttgtgaacatgtcatgagagaagatgtacttttaatattactacacatttatttagtcaacaaacactcactgagtgcctacagtgctactacattctgggtgaacaggaaccaacaacacagaaaataaaatcctgtatctcctggggatcacaggcttagcttctttggcatggaggctcaaatcctgtttctgcacatttctagaggtatgactttggttaatttacctaacctttctatacctcagttccctcatttgtaaaatggggataatatctatatagggcagttgtgaagattaaacgatggtatatgtaaaatgcgtaggacagtaccaggagcatagtgagaatgcggcaggaggctctgttattactataaatattattatcactactgctctgtgctccagtggtgtattctgtatatttcatgcccgattcttcttttcttaaacgggtcagcacatctttagagtggcacagtgacagctttcagagggaatgtggtcctggtacccttatcttgtgtggctcctacttctcacgctccatgtacagagtagagacagcctctgtttttctgaactattgaaatataaaccagggtgccagttgccccttgcagagaatagctttatatttgtctctctgttggcaccttgcctattccttatcacccccacttggtcctaagtgcctgttctgtcatggtggttgcagttaccactggctctaatctctcttctcatctatttctttgcctcttaccactttccctaagctccttgaccgtgtgtttctagatcttctctgccacagaaagcagtctctctttttttgcaggtgagtcacatggagtatattgagtgggatcttgaatatttcagttcttgatgtaattcatgtcaaatgttaagacatgacaggcagctgctgcacggggttggtttctccacggcatcccatcctacccctgttttctcatatgaattattctgaaagccttgaggctgatcagtgtagatattcctatattttggaaacactacttttaaggatcctagcaactgatttctccaacttacattgaaatttaaacaatttcctggtgcctcctgaatccctttaagatgttgcagtaagaatgagagttgtgtaggcggggaggtacattttatgggctttttataagaaatgatatcctgtgtcctgaatgtaccagtgcattaatgccatcctcatctgtagcaacagtaagcagccttttagagtggtataaatagtccattaggataaccataaatatttaactattatttactttagattccattggcaaagtagcagatttcttgaaaacctctcaggtttctcctaaattgttcttttcaaggcagtaaaaatgctatggtcccaaactgaaaataactgattattaattaaactactaaagaccaaaacaactttactcacattccacaggattggagagacaggaaacaacttgcgaggtttctagaaattgttattttcttgttaatggttattttaattagcaaagagagttttggaaatagttttgagctttacctgaaactgaatgactggaaggtaagtgcatttgaattatatttggttacatgcattaaaggataaataatttctcttttctcatgtgaagcttcattttggtagttagctgacttttcaggtaaggagaaggaccaagtaatcaccagctataaaatacaaacatttatcactggaaaacctagtaatgaaagcaaagcctatcaaaactttatgtttacagaatgcgtttaactctttttaatatattcatgtctatgtaatccttttgttacttttttcatgaaaacttatttaacagtatatatagttcatagtattgtgttgtggaatgagcattagactttggatatgtcaaatcctttccagagagagatggcctactcaaataaggataaataataaataggggagagacactttgtaaaactctgagcacagtgtaggtgaaccacagggcagtaacctgaggctagtaacagtggagctgtcaacaacctatgaccaaagggaaaagggaagaaaaaaggttctctagaacttgaaaggagctagttttgtgtagaaagctactgtacgtggaacagtgatctttagttgtggacatagccagcctaagttaaccttcaaggagggagccaagggaataaatatcccgatccccactcctccttccctccaattttgttagagctcactgtctggaacctgctgagcacctggacatgagggcctttgatagagtgcctgcaggtcttatggggaaagaagagcggaaagcggatctggagggagaaatgaaagataccttgaatactctaccacttttctctctatcaacctccaatcttgtcctccatgtggttgacaaatgcatgttcctaacacagggtatgcacaaaatcccatcaactaccatatcattcccatgatgtcttttactaatactgcaacctgactaaaatattggtccccagcaacactcttcatataaaatattgggagaagaggatgcaattaaggaacattaattatagctgcagctcacttctggagctggtcatgaggcctaaactgctcattatagggcccccccatcgacaataccttctgtatttaccttactgtctgacatcaccttgactggatgagtcattttccagttagggcaattgaaatcttcatttctttaagatctgagtgcttggtagtcttgtttttattgggggatcgttgctattttcccttgaccaggactatcgggaagggagtactaagaggcatcccactgaattccctgagttttaagcactgtccttgtcttcattctgtagcagaaaatcaattccccctgatcattaggtgtgattaccctagctagttatagtgactttctcatctctgttggttcagggccataaataaatttaaattgccaggagttagtctctacttccagtgaatcagaaaatgaccatgtttcctggtataagaattactgccttggacagtagggccatcaaactcatcaagtccaaggtttcggggacaggaggcaagaattctttttttttttattattatacttaaagttttgggatacatgtgcagaacgtgtaggtttgttatataggtatacatgtgccatggtgatttgctgcatccatcaacccgtcatctacattagttatttctcctaatgctatccctccccttgccccccaccccactaacaggccccagtgtgtgatgtttccctccctgtgcccgtaagttctcattgttcaactctcacttatgagtgagaacatgcggtgtttggttttctgttcctgtgttaatttgctgagaatgagaatgatggtttccagcttgatccatgtccctgcaaaggacatgaactcatccttttttatgtctgcatagtattccgtggtgtatacatgccacattttctttatccattctatcattgatgggcatttgggttggttccaagtctttgctattgtaaatagtgcagcagtaaacatacatgtgcatgtgtctttatagtagaatgatttataatcctttgggtatatacccagtaataggattgctgggtcaaatggcatttctggttctagatccttgaggaattgctacactgtcttccacaatggttgaactaatttatactcccaccaacagtgtaaaagtgttcctatttctccacagccttgccagcatctgttgtttcctgacattttagtgatcgacattctaactggcatgagatggtatcttattgtggttttgatttgcatttcgctaatgatcagtggatgatgagccttttttcatatgtttgttggccacataaatgtcttcttttgaaaagtgtctgttcatattcttcacccactttttgatggggctgtttgtttttttcttctaaatttgtttaagttccttgtagattctggatattagccctttgtcagatggataagattgcaaaaattttctcccattctgtaggttgcctgttcactctgatgatagtttcttttgctgtgcagaagctctttagtttaattagatcccatttgtcaattttggcttttgttgccattgctttttgtgttttagtcatgaagtctttgcccatacctatgtcttgaatggtattgcctaggtttccttctagggtttctagggttttaggtcttacatttaaatcttcaatccatcttgagttaatttttgtataaagtgtaaggaaggggtccagtttcagttttctgcatatggctagccagttttcccaaaaccatttattaaatagggaattctttccccattgcttgtttttgtcaggtttgttgaagatcagatggctgtagatgtgtggtgttatttctgaggcctctgttctattctattggtctatatatctgttttggtaccagtactatgctgtcttggttactgtagccttgtaggatagtttgaagtcaggtagcgtgatgcctccaactttgttctttttgcttaggcttgtcttggctatacaggctcttttttggttctataagaaatttaaagtagtttttttctaattctttgaagaaagtcaatggtagcttgttggaaatagcattgaatctataaatttggactgtatggccattttcatgatattgattctttttatccatgagcatggaatgtttttcatttgtttgcgtcctctcttattttgttgagcagtggtttgtagttctccttgaagaggtccttcacatcccttgtaagttgtattcctaggtattttattctcttggtagcaattgtgaatgaaagtttgctcatgatttggctttctgtttgtctgttattggtgtataggaatgcttgtgattttagcacattgattttatatcttgagactttgctgaagttgcttagcagcttaaggagttttggggctgagatgatggggttttctaaatatataatcatgtcatctgcaaacagagataatttgactacctcttttcctatttgaataccccttatttctttctcttgcctgattgccctggccagaacttccaatactatgttgaataggagtggtgagagagggcatccttgtcttgtgctggttttcaaagggactgcttccagcttttgcccattgactatgaagtgggctgtgggtttgtcataaatagttcttattattgtgagatatgttccatcaatacctagtttattgagtgtttttagcttgaaagggtgttgaattttattgaaggccttttctgcatctatcgagataatcatgtgttttttgtcattggttctgtttatgtgacggattgtgtttattggtttgcatatgttgaaccatcctcgcatcccagggatgaagcctacttgatcatattggataagctttttaatgtgctactggatttggtataccagtattttattgaggatttttgcgtcgatgttcatcagggatattaggctgaaattttctttttttgttttgtctctacctggttttggtatcaggatgatgctggcctcataaaatgagctagggaagagtccctctttttctattgtttggaatagtttcagaaggaatggtaccagcttctctttgtacatctggtagaattcgactgtgaatctctctagtcctgggctttttttggttgttaagactattaattactgcttcaatttcaggacttgttattggccttttcagggtttcgacttcttcctggtttagtcttgggatgctgtatgtgtccaggaatttatccatttcttgtagattttctagtttatttgcgtagaagtgtttacagtattctctgatggtagtttgtattcctgtggatcagtggtgatctcccctttaccattttttttattgtgtctatttgattcttctctcttttcttctttattagtctggctagcagtctacctattttgctaatcttttcaaaaaaccagctcctggattcattgattttttgaagggtttttcatgtctcaatctccttcagttctgctctgatcttagttatttcttgccttcagctggcttttgaatttgtttgctcttgcttctctagttcttttaattgtgatattagggtgtcaattttagatcttttccactttctcctgtggatatttaatgctataagtttccctctaaacactgctttagctgtgtcctggagattctggtacgttgtgtctttgttctcattggtttcaaagaacttatttctttctgccttaatttcgttatttacccagtagtcattcaggagcagtttgttccgtttccatgtagttgtgtggttttgagtgagtttcttaatcctgagttctaatttgattgcactatggtctgagagactgtttgttatgatttccgttcttctgcatttgctgaggagtgttttacttccaattatgtggtctcttttagaataagtgctatgtggtgctgagaagaatgtatattctgttgatttgggggtggagagttctgtagatatctattaggtcagcttggtccagagctgagttcaagtcctgaatatccttgttaattttctgtctcattgatttctctaatattgaaagtggggtggtaaattctcccactattattgtgtgggagtctaagtctctttataggtctctaagaacttgctttatgaatctgggtgctcctgtattgggtgcatatatatatttagtatagttagctcttcttgctgcattgatccctttaccattatgtaatgcccttttttgtcttttttgatctttgttggtttaaagtctgttttatcagagactaggattgcaacccctgcttttttgttttgtttttgtttttgtttttgttttttttgctttccatttgcttggtaaatattcctccatccctttattttgagcctatgtgtgtcttcttacatgagatgggtctcctgaatacagcacactgatcggtcttgactctttatccaatttgccagtctgtgccttttaattgggccatttaacccatttacatataagcttaatattgttatgtgtgaatttgatcctgtcattatgatgctagctgtttattttgcccattagttgatgcagtttcttcatagtgtcaatggtctttacattttgctttgtttttgccatggctggtactggttgttcctttccatatttactgcttccttcagagctcttgtaaggcaggcctggtggtgacaaaatccctcagcatttgattgtctgtaaaggattttgtttctccttcatttatcaagcttagtttggctgaatatgaaattctgggttgaaaattcttttatttaagaatgttgaatattggcccatactctcttctggcttgtagagtttctgtagagagagccgctgttagtctgatgggcttccctttttaggtaacatgacctttccctctggctgcacttaacattttttcctgcattccaaccttggtgaatctgatgattatgtgtcttggagttgctcttctcaaggagtatcttagtggtgttctctgtatttcctgaatttgaattttggcctatcttgctaggttgaggaagttctcctggataatatcctgaagtgtgttttccaacttggttccattctccccatcactttcaggtacaccaatcaaacgtaggtttggtcttttcacatagtcccatatttcttggattctttgcttgttcctcttcattgttttttctctaatcttgtcttcatgctttattttattaagttgatcttcaatttctgatatactttcttctgcttcatagatttggctactgatacttgtgtatgcttcacgaagttcttgtgctgtgtttttcgactttatcagatcatttatgttcttctctaaactgactattctagttagcaattcctctaacttttttttcaaggttcttaggttccttacattgagttagaacatgctcttttagctcagaggagtttgtttttacccaccttctgaagcctacttctgtcaatttgtcaaacttattctccgtctgattttgttcccttgctggtgaggagttgtgatcctttggaggagaagaagcattctggtttttggaatttttagcctttttgtgctggttttccctcatcttggtgactttatctacctttggtctttgctgttggtgaccttcagatggagtttttgagtggccgttctttttgttgatgttgatgctattgctttctgtttgttggttttccttctaacagtcagacccctcttctgcaggtcttctggagtttgctgggggtccactccatcccctgtttgcctgggtatcaccagcattggctgtagaacagcaaagattgctgtctgctccttcctctggaagcttcgtcccagatgggcacccatcagatgccagttggagcccttctgtatgaagtgtctgttgagccctgctgggaggtgtctcccagtcaggaggcacaggggtcagggacccacttgaggaggcagtctgtcccttagcagagctcgagcactatgctgggagatctgctgctcttttcagagctggcaggcagtaacgtttaagtcggcggaagctgcgcccacagctaccccttcccgtgggtgcactgacccagggagatgggagttttatctataagcttctcactggggcggctgcctttctgccagagatgccttgcccagagaggaggaatctagagaggcagtctggctacagtggctttgccgagctgtggtgggctccgctcagtttgaacttcctggaggctttgtttacattatgaagggaaaactgcctactcaagcctcagtaatggcagatgcccctccccacaccaagctcgagtgccccaggttgacttcagactgctgtgctggcagcgagaatttcaagccagtgggtcttagctttccaggctccatggaggtgggacccgctgagcaagaccacttggctccctggcttcagccccctttccaggggagtgaatgattctgtcttgctggtgttccaggcaccactggggtatggaaaaaaactcctgtagctcgcttggtgtctgcccaaacaaccacccagttttgtggttgaaacccagggcccttgaggtgtaggcaccctagggaatctcctggtctgtaggttgcaaagaccttgggaaaagcatagtatctgggctggagagcactgtccctcatggcatggctcctcatggcctcctttggctccaggagggaggtccccggctccttgcacttcctgggtcctcaccctgcttctgcttgccctcagagggctgcacccactgtctaaccatcctgaatagatgaactgggtacctcagttggaaatacagaaatcacctaccttctgcgttggtctggctaggagctacagaccagagctgttcctacttggccatctggcctgtcagtaagaattctttaagtggtgtattaggcataaaaataagatagattactttatttatctgtttatttatttagagacaaggtctaactctgtcgcccagctggagtgcagtggcgcaatcatagctcactgtaactctccttcagcctttcgagtagctgggaacataagctcatgacaccatacctgggtaattttttctttctttcttttttttttctgagatggagtctcactctgtcacccaggctcggctcactgcgatctcggctcactgcaagctctgtctcccgggttcacaccatcctcctgcctcagcctcctgagtagctgggactacaggcgcccaccaccactcccagctaattttttttattagtatttttagtagagacggggtttcaccatgttagccaggatggtctcgatctcctgacctcgtgatctgcttgtgtcggcctcccaaagtaatatattttttgtatagacgaggtctagttatgttgttcaggttggtcttgaacacctggcctcaagcagtcctcccccttggcatcccatagtgctgggattactggcaggagcccctgagcctgacttataccccttttactctcacctcttggttcctggatttgtgcattctctacagcagagatgacaccatatacttggctgcccaacctatgaacagaactccaacctctcagggtgttatctcttggcttgcaccctggctgaggcttcatcaggacatttcatcattctgtcaaactggttgctactagagggtgcaggtgatgtgatccatgaattatatgtattgagcccactgtctcacttcctttgctaaaaaatggttaggagatagttttcacaggaaaccttggctatatatcagttgcactataagtccatgaatgatggtgcttgcagaggcactgaaggcagggaagacatatattgtatatgtctatctttgtgagtccaagagcatccccttataatgggaggaatccagtggaatcattctgctaccacatacagccacctggtcctcttgccctgttggacagtgatagctttttgggggctcagcatcagccttggcttttgaagtttgggacttctttagtgctggaaagccagattccccctggtaggagaagagaatgctgaacctatatatatcctccctctgcaccactctgtgctttatatgtgggtccattaagcaaacatttggatggttgatgaaggatactgagtgacaatcagattttcttgttcactttattactgaagctatcctctgtgatggccttttatgagatttagtggaatagaattagattcacattctgtacttattaaaagagactcttccatatattcttcacctcctcctttgtgtccttcttgtctgtccttatctttctcctccttttagtcctcttcctgctcctcttactcatgcttgctcgtttccttctccttgttctccctgttttccttttcctccttctccacatgctccaccttgtcctcctcctaatcatccttctcttcatcctcttcctcatcctccttctcatcctccttatacttgtcttcctcctcctcctcctcatgctacttctccctttccttgtgctccctattcccccaggcctcctcatcctctacaactttctcctccttccttaaactgttctgcaataagcccatttgttttctccattttaatttctaagtactttttttgaaaaaaattttgttttttgccctccaatttatgttgggattcaacatagtctccctctatttttttaactttggtgcatgatattctttctcccccattctgataacactacacattgctttgacttccatccccattaataactaagtgaaaggtgttacaagtcttgctgaagattacacggtaattcttctcacagccaagcttgaactcagttttagattccagacttagtgtcttttcactaggctgaattgcctcatcatggctgaggatagaaatagcctcatatttagagtaaaactcagacaagaaagcaagcaagtgaacaacaataacaatagaaaacaaaaatttaaaaaggaaagagagagataggcatattcactaatttaactacaggaacttgaatttagtgttctctctgctcagtgatttaattctaggtgaattaaaaaagaagtttctgtgaaggtttgctgactttggtttgttccaaaactattaaaaatgtataactcttacctgctcaacagtatcatttgggaccaaagcatgaggcataataaatagagtcaataatatctgtacttagaggtatgagaatcattcctgatatattaatttaatttcttctgtaaaattaagggtgtttgtatacagactctgtagtgatatcaggtagtcaagacttggttttgtagtcttcttctgaagtcatcacaataaggaaattttaaacatgtaattagacaaattagattggaagatgaaaacaactgctttaattcaaaataatctcattaagtatatcacggcattaagttttacaaagcccaggtcacttcctctgtggctttccctatgaccacctttgtttctccttcagctgtaattgcttcccgctctggggcattttttatgcaaactacccgatccacctgtgctaaattatgattgtttattgtgttgtgcgtttaagatacagctataaaataaaaagcccacattttaagaaaagatagaattttttatgcggataagctttgtttcttaaaataaaaaagatttgatacttactcaatgttgcatcaagcgttcagaagagttttctgagaggtggggaagtctccttgcgaattaccttcagatcctattacagagaagaattcccatccccgatatgtgtgtagtagtaaagcactgttgccaaaaatgcccattcactctttttttgtatctctgggtaagtttaccaacctttttgtgctttaatttcctcaactataaaatgatggtaacagttgtactttcctcatagaattgttccaaatgaattcggtatttgaagtgcttagaacagtgcctagcacattataaatgctatgtgcctttgctgttactatttctactacgaccacattggtgatgacaatgatgatgaatcctattactaacagtttcccattcatttcatattaattaaaaaaatatttgctccaaatgcttttatctgtgcctacaaacaaacaaaaatccaaaggtgcagatttgccactaacgaaatagtaaagagatgtattgcaggatctaaggctgattctgaaagtgttggtccccaaagtgtttggagtggtgaagtgatattggagtaactgtaaaacctcttagatggttgctctgaagtaagcccctctctgttggatatatattgcatgttttttttttaatgtatccatatatattatgacttgtttctccaatgtaaatacacttcttgaagacagaagctgtgttttccatttctgtgtatttcctatagcattcaacagagtgttttacaaatttcagaagttcaataaatgtaatgattagctgcttaggtagaggtgagaggaggagaattaggaataaaatgttctccagttaattgcaaagtgcttttgtacttaaaaatgaatttgcattttatctttttctacaacttctggaaagtgttttagttggcatttgtcatttgattttgtacaattttgtaaattttctggaaatctaaattcctacaaagagtccatcacaggattttctattttttaattgtttctacatgaaaggaagtgttagtgtaaaggctagcctgttccatttacacttcatgcaatttgttaagaaaataattaagctttggagctggtagagaccatattgttacagcctaaaccctccacagggtacctggaacagaatggaaactcaataagttgttgataaataaatgaatcatttagtacaatgtcttcatttcacagttgaaggaactctgtgataacttgctccctgtcacatggtggcataggaggggttagaacaaatgttgctgatgtcattcatcatgctctagttgtggatttcacatttaaattgtaacataaaaaagactttaagtttagtctttgaataacttccttcattttaaatcttgtgtataaataaatttcttaggttaatatctgctacattttagaaaggcagtaggaagaagtttatacaagtcaaaagaattgttttaaagggaaagtaaaggaaaatatctgttagtggcttattcgaggtgtgtcagttgatgaatttcctttctctcaaccataagttttctttgctctgttatatattattagggtttcctagttactctaaaagactttctgttggaacaatttgtttttctcaagcacaacccatctccaacttgtctgtatttctgagactttcaagaaatgttggttatcattttaattgattttctgctaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggtaaggagctctgttcatattgtaaaagtctgcttacttcttgatttcagtggaatgagacttttcaggtgacatgctcttaaaatccttctgatgcactaaaatgaagaccttgttggacattgatgattatctttgatatcatccagaaataaaaaaaaaactattcacttgatattttcttcttcttcttctaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatggtaagaagcttaaaatttgtattttcttttaatttaaaatttggaaatgagtatctggattataagttaactaagggtggccttctgctttccgcagtgtggaaggcctttctgttgtaattcagaacaatcccatttcaacagatcattctacttgagtagtttacactaatagtaatttgaaactgatcctcactggttctttaaaacataatcgtattgtttgaaggtgaaatgatttgtttttgctgaaatagagatattttcctctatctctattccccttgtggttggtacatcttgtcttatgttatagtatgtccctataggactttttctcctttttctccctcttttgtgtctatgccacatttggaagaggaataacttattagagtaaatagcattttgttatttcaaagttctaaacagtgacagctttttgggttaaactaaaactggtacactaaaattggtaaaattttgacaatagttatttgacatagtatatatttatatctgttcaatgtctgtgtctttgtatctgtgtgtatgtgtgtgtttgtgctcaaaagagcgtgcatggccgggtgcggtggctcatgcctgtaatcccagcactttgggaggccgaggcgggcggatcacaaggtcaagagatctagaccatcctggccaacatggtgaaaccctgtctctactgaaactacaaaaattagccgggcgtggtggcgggcgcctgtaatcccagctactcgggagtctgaggcaggagaattgcttgaacccgggaggcagaggttgctgtgagccgagattgtgccactgtactccagcctgacgacagaacgagactccatctaaaaaaaaaagagtgtgcatgtgtgtgtgtaagagagagaatatcctgtgcattttaaaataaatcatggaaatctttctataaaatgataatatggtagtgtatgaaaatcaaggactatttcttttgcatttggaactggatgtattacatacataatttaataatttgagttttttatttgcattcttacctccaaattatatttgtctagctctgttcgttgttctctgcagaccctcagaagagcaaggatttcatctcttagaaccaatgctacatttataacttttgtcacaaaattaatgtctcatgctatcttatagtcattttactttctgatataagaatggaatcttactagagttgttcagtttaaagaaataatactaagaaataatactcatcctggagtgagcaaaataggcacagttcaaggggcttttccattcatggggcttttcctctagaaagaggggatccttaaattaaacaacaaaaaatcacacagatgactaaataattacaaataataaaaaatgctatgaaataagagagaaagtagaatatatgatgagagatgataataaaggaatctagaataaactaggattagctagcaaaagtgttttagcaagatataaggtaaaacgtgaaggatttagtccactgaaaaattagagaaatacaagttctggtacaggtgatggtagatgtgaagattttgctgggtaaacttgaggtcatgaaagaatgggttgggtgaagcatagagagcaggtaatggaaaaggagaaagagaacataaaatgaggtaaattccatcccactgattgattcagttggagaaaaatactacttcagtacttttactcttgttgatgcctgaaagaactagatattcctattaagctatcagtactaaaacctttaaacatccaaagtaaatgatcataccacccctcccagcattctattacaggagcaccttgttttattgcacattgctttgatgcactttgtaaatgctaggttttttgcacattgaaagtttttggcaaccctgcctcaagcaaatctgtcagtgccattttttgaatagcatgggcttatttcctgtctctgtcacattttgttaatttttaaacgatttcaaaccttttcattattattataatatctgttatagtgatttgtgatcagtgatctatgatgttactattatgttttgggacgccatgaaccacattcgtataaaatggtgaacttaattgacaaatgttgtgtgtgttttctccctgcacccctgatcagccatccttccatctccctctccttgggcctccctattccttgacacccaacaatgttgaaattacaccaattaataatcctacagtggcctctaagtgttcaagtgaaaggaagagctgcacatctatcatattaaatcaaaggcctgaaatgattaggcttagtgaggagggcatgttgaaacccaaggcaggccaaaagctagactttgtttgccagatagcccagttgtgactgcaaagaaaggattgatgaaggaaattaaaagggctactccaatgaacacacaaataataagaaagcaaaacagccttattgctgacatgaataaaatttacgtggtatggatagaaagatcaaaccagctacaacattccgttaagcaacagcctatttcagagcaaggaataactctcttcaattctatgatggcttacagaagtaaagaagctgcagaagaaaaactggacattagcagaggtgtattcattaggtttaaggaaagaagccatctgtatgacataaaagtgtcaggtgaagcagcaagtgctgatgggaagctgcagaaagttatccagaagatctaactaagatcactgatgaaggtgactacactaaactaatagattttaagtgtagctgaaacagccttctgttagaagaacatgccatccaggactttccatactagagagaagtcaatgcctggtttcaaatcttcaaaggataggctgactgtcttactagggactaatgcagctggtaactttaagttgaggtcagtgatcatttaccattccccaaatcctagggcccttaggaattatgttgaatccactctgtgctctagaaatagaacaacacagcctggatgataacacatctgtttacagcatggtttagtgagtattttaaacccactgttaggacccactgctcagaaaaataaaagaaattcctttcaaacattactgctcattgacagtgcatcaaatcacctaagagctcttatggagatgtacaaggagatgaaagtttttgtgcttgctaacacaacatacattccgcagtccatggatcagtccatggagtagttttgacttacaaatcatatcatttaagaataatttgtaagtctctagttgctgtagatagtgattcctctgatgcatctgggcaaagtaagttgaaaactttctagaaaggacttatccttctagatgatatgaagaacatttgtgatttatggaaggagtcaaaatatccacattaattgaaattggaaagaagctgatttcaaccctcatggatgactttgaggtgttcaagacttcagggaaggaagtaactgcagaggtagtggaaatggcaagataactagaatgagaagtggagactgaagatgggactgaattgctgcaatctcgtgattaaactagaatgaatgaggggttgcttcttacggaggaacaaacagtgatttcttgagacagaatctattcctggtgaacattgctgaaatgacaacaaaggatttagaatattctataaacatagttcataaagcagggacagagtttgagaggattgcctccactttggaaataatttctactgtgggtaaaatgctgtcaaacagcattgcacactacagagaaatctttcatgaaagaaataaattgatgttgcaaatgtcattgttgtcttattttaagaaatttccacagccactcccatctttagcaaccactactctaatcagtcagcagccatcaagatggaatcaagactccaccagcaaaaagattacaactcacccaaagctcgaatgattggtagcattttttagcaataaagtatttttttaaattatggtatatacattgcctttttagatattatgctattgcacacttaatagtctacagtataatgcaaatatatctattatatgcactgggaaacctgggaattcatgtaacttgctttattgagatgtttgctttatcacactggtctggaaccaaacccacactgtctccaaggtatgcctctaagtgactgttttgtggtttgccacaagatggcaacagttatctaacaatatatctgtcttctagtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaaccatg

SEQ ID NO: 38574 - DNA, 49409 bp, Homo sapiens
ggcttctccctgcgcctgggactgcggccgcctctctaaatagcagccatgaggcgcctgggggcagtgtcctcgcgggccagcgacgggcaggacgccccgttcgcctagcgcgtgctcaggtaggagactctgcccggggctgcagctgagggtttcacggggctatgacagtgcagaggggaggcaggcaggcttccaaactgggcgcgaggtgggctcctgctgagcgaggaggatgggaatctgtccctagatccaggcaaaagattgagtctcaataaatctggcaccagagttccaaagtttgattagttcatggcggaaattcgtggagcctattgatgagatgggatccgacccatgagaggtgctggatgatggagtcaccctcttgggtggcagatttcaaacagcccaaggcccagggggctaaacagtcttcgctaattccaaaccgcagtgcagtacctggtctcacaacctgacgattgttcctgagcctgagcagcgtctgacgggccaggcggacagcagccacgactgcccccagggaccagtggctctgtgttgggctcaggaacggggatcagagaggtgggggaaaggtgggccttgctttggcaactttccagggaaagactttgagttcagatggggtcatctaaaaccaagtggggtcatcttgtctccaaaattggaaaggaggaaagtttcctagggccgctgcctcctacctggatgccttgcgctaggaactggcggtctttttagagctgaggtgatgtggtcgttctcaatttaaagatgaacgtttaaagccatctcatgtgcatagctggaattttggtttgatgggaagcactttgcctgtggtaggcagagcactgccccaatctttcacagctattcgattttgtttacaattttgaaaaatccatgtaccgtagaagagagcacaccggtaatgtgctgaccgctgggggaagataagagaggataggtgccttcttactctgtgctcttggtaagaagctaagaggagcgtgtgctgttgtgggtggaatccaggctgccccagaaggtgctctgtcactgtagggagggaaacaccgcggtggggctggggcagtccccagtgagaggaacctcctcatgcttcagggatgtggttcttaggaggtatttgtggtgcctgtaagatgctgggccttgctgtagatacttaatgaaaaagtagaatagcatgtttggcaactgaagccatgattttttctcattgtctatttcatttttttttttttttttgagatggactctggctctgtcacccaggctggagtgcaatggcaccgtcttggctcactgcaacctccgcctcccaggttcaagcgattatcctgcctcagcttcctgagtagctgggattacaggtgtgcatcatggcacctggctaatttttgtactttttagtggagaggggggtttcaccatgttggccaggctgctctcgaactcctaaccaggtgatctgcccaccttggcctcccaaaatgctaggattataggcatgagccactgggcctggccccattgtttatttcattcataacatgtatttcctctcaggattccacgtttaaccccctctcccctgcttgtcaagtctgccccttccattgatgggagggccctgagcgtcttgggccctggctgggagataaggatgttgttcttaaagaggtcctgggggtagctgtggcttctccgtttacaaaatggaattcctcttctaagaaggcagtcagagggcgagacctctgggaagcagagactccttcgggcgcctgggtgccctcaccctgtgcctacctgccctggttcctgctgtgcgtctgagagcgccccgctgcagggcctgtgcctcctttgtgcccataggcctagctggggcccctcgcaggaaagtggacagaaactctgtgaatgggcagcggggtcagtgaatgagtggagcgagtgaaggcatgagaaatcccagcctgggctgttccggggatcagtggatgagtgaagtgagggaaggcacaagaaatcccagcctgtgctgctccggggtcagtgaatgaatggagtgaaggcacaagaaatcccggcctgggctgctccggggtcagtgaatgaatggagtgaaggcacgagaaatcccagcctgggctgctccgggatcagcagatgagtgtgagtgaaggcacgagaaatcccacctgggctgctctggtgtcagtgaatgaatggagtgaaggcatgagaaatcccacctgggctgctccggggtcagcggatgaatggagtgaaggcacgagaaatcccgcctgggctgctctgggatcagcagatgagtgtgagtgaaggcacgagaaatcctgcctgggctgctctgggtttctctgctcactactcaccccttttcttgggagacggagcctgatctttgttgaagccactcctgggacatctgcggagtgagggcagtaaaagccttgctgaacacctggttatacctgaacagaatcacttctagctagaggggaaattcccatgtcagcctttgattcctgagacattaaaaaaaaaaaaaactaaacccagtttgcatccagcaaacactgagaagtgaggttcgacttgcgtactgagtgggtggggaggaagagtttactattgctttcagaagccacataccacaaggagccaaaatactgctgctgaggcaggagccggggagactacggttatgagcccagtggaccagcacgtctggctacaaaccttgtggtgccccttgttttgacattatttttgtattttttatttttattttattttatttatttcatttttttgagactgagtctcactcttatcactcaggctagagggcagtggtgtgatctcgactcactgcaacctccacctcccgggttcaagcgattctcctgcctcagcctcccgagtcactggaattccaggcacccgccaccatgcccagctaatttttgtatttttagtagagacagggtttcaccatgttggccaggctggtctcgaactcctgacctcaggtgatccacccacctcggcctcccaaagtggtgggattacaaacgtgagccactgtgcttggcccatttcaacattattaggaatttcaggacaatgacagcagggcagtaacccacgtctgcagactgcctgccctggaaatactgtgtagacattagatataataaagatttggaaacacggaaacaccacgaggagaagagcagaaggctctatttgcgatgcaattgtgaactttcgttctgttgtttgttcctttatttactcattcacttgttcactcagtttggtgcctgctaaactgcaggcttctgcgtgcccagagacctttacgaagctgtagcttgcacagatcacttgcatgtggacccaagcctggcagcgaacaaggaaggtgggaggagtgaagtcagctggtggggtcctgggtttccgcttttcggttgcccttattgttctaatatccgcgtgagcacaggggagaagggtgtgggcacaggcagcgggtgaggggtgtggagaggaggctggaggcggaccgtgggtgaggggtgtggagaggaggctggaggcgggccgtgggtgcggggtgtggagaggaggctgcaggcggagtgcccagctgcgtggcctggtggtggagttggggccgattgttcaactttccatattgcattgtctttagagtgaggaactgtaataaggtacaaggttgttttgggaattaaatcagatatgtgtccacatttggtatacaacgtatattggctccttgttctctccatcaaaaacctatttttaaaaatcccttacatcgtgactgaaggaggaaggtgagcccttcctttgatgcatggggagagggtagtcgggcagaaagaggaaacagccaacagtgctgggaagccctggatttcagtcccaccctcaccacacactggttacgcaatgctgggaagcgttcttaatttttcttttctttggcttcctcatctgtgacgagtgcgtgatggtgctgatctctgtgcagtgtatgggagttattttcctccaacccagtggacgttctgtacccctgtcctttacaaagtcatttctgtaaggggctctgcaggaagaagccaggtcctcatctggtgcgcgatgacccacaccacaggacggcactgaatggaaacgggtttccctgtacccattctgcgggagaattgactgacgcagaggcactgtgcgggggacaggcattctcagatgaggaaccctggcttctagccctttccctggactgggagcccatgcatgtgatcacagtaggatcaggagctgccatttggtgagcatttgctatgtgccacactgggtcacggtgccacacgcattaattaccgctgcaatcccttcaaatagcctatctccatattaagagaaggggaggggcttgcaaacggcatgtggtgtggccaaggtgctggtaagtggttcagtggatttgtagctgtccctcacccactgccctcaggatgccaagtcccgggaggtctctgggcagtgccatggcccctccatggcccagggaggcaagcactggcctactggccccacagtcatgagggtgagctccacgccaccagctgtgcccttcctctcccagcacccgtcagtggcatgcagtctgccttaataagattagataatccataagctacaactacataaagttgaatataaagacactgaagactatggatactgtgctgtgatatcttataaaactcaaaagcggccaggcacggtggctcaagcctgtaatcgcagcactttgggaggccgaggtgggtggatcatgaggtcaggagatggagaccattctagccaacacggtgaaaccccttctctactaaaaatacacaaaattagccaggcgtggtggcgggcagctgtagtcccagctacttgcgaagctgaggcgggagaatggcgtgaacccgggaggcagagcttgcagtgagctgagatcgagccactgcaccccagcctgggtgacagtgcgagactctgtctcaaaaaaaaaaaaaaaaagcaaaactcaaaagcaagcaaggctgggcacagtggctcacacctgtagtcccagcagcttgggaggccgagagaggcagatcacttcagcccaggagtttgagaccagcctgggcaacatggtgagaacctgtctctacaaaaaagacaaaaattgcccagacatggtggtacatgcctgtagtctcagctaccagggaggctgaggtgggaggatcccctgagcccaggaaattgaggctgcagtgagccaagatgcactactgcactccagtcctgtcccaaaaccaaacacaagcaaaacgtgacagaatatggtttaagaacgcataatgtgtaggaatcctgcttaaaccccgccagaggagaagttcgcattcaggatggcgtcccccaggggagggcgcgtggatgggagcggggctggggctttggggccggtgaggcaggtgcactcaccagtgtctgctgtgtggttagacctcgtcattgtgtagttgtatacacacattaactcctaatgaactagaaagtgaacatcaaaaatgacaccttgaggtattaataattgttgaagctgggcaatgggtatatggaagttcatggtactgcttttgtgtgtatctgacattttccattataaatgttaagaatgatgagagcctcagcaggacaatgcccggccccgtgatggctgtgtcactgcacggggcgggctcccatccacgccccttctcagaagagtcgggagcccccactttcctcttggcctttccactcctgtgctttgtgaagtcatctctacttctgattcctcgtggattcttgtaggatgtttgaagaaagggggatgtgggcagtttctgaattaacccctttttccaccacccttcccacacgggcagggggcctcggcgtggtggcagtggagccgggatttgagtagggtcgccgtggacagggtggtgtgcggaccatgtagaccatcatagtgtagccaaagctcatgggtttactttttgtgactttgagcttttggatttttctttattattattattttttttgagacagggtctcactctgactgcccgggttggagtgcagtggtgtgatcaccgctcactgcagcctcaacttcccaggctcaggtgatgctcccacttcagcctctccagtagctgggactacaggtgcgtgacactacacctggctgcttttttgtagagatggggtttagccatgttgcccaggctgatctcaaactcctggactcaagcaatctgctggccttggccttccaaagtgctgggattacaggcgtgagccactgtgactttgtgctttatagtaccttttttcccccgagccattcttggacatccgggatgagagacggcttcagctttaaggtctgtaggttttcacagaggtaggatttaagttctgtcatcttcggcaagtgaagctctcccacgcgcgtgcccaagccctggctccgccctaactctaatcctctctcccttcccgccccgccccttcatcaacccttgcctcagtggaaacggacatttaacatggaatgttcatggcagtaaccctagccgtctccacgtcatctttttgtctgtgaccattggaggcgatttttttcagatttgggagaaggatttcaaatgacttcccttcgagctgcagggctatcttgggcatcttgacctccacacatttctgggagaactcctcgtgcagcaggacatcaggtggcaaaggtgggctctcgccagccagaggcggggtctctgtagactccatggggccctggctttcgggatctgtccggaccaccctcccctggcttttgtagcagggctctcacggggctgttgatgtgggaagccccccaccacagatggcctttctctagcagctaaggtgaccttcattttggacctgagagggccagctggcttggaattgtgggagagaaaatggagggtaccctgacccccaagccttgcaaaccgaaccattgctccacccactgggtcacataggagtctatagtgtctcagactcggaaagttgaacccgagcccctgacttcacttcacctcctcagttctgtttctcagcagctggctgcactgttcacctggctgctcagaacaaaagctttaatctttgatttctctctgtcatttcccacataactgatcagcaaaacctgtcagctttgcttccagactgcatcccatacctctgtcatcacctccacccacacgtggggtccagctgccatcctcgcccgctgtgctgttgtggtcaccctggcttggtctccttgcttccgttgctgttcccctaagtcccgtctcaagagcagggagacccttttgtaaagccgctcgctgatccagaccctctgtctcatacagagcaacccccaaagctgctgggcgccggctcctgtctcctgtcctctgtgcccaccaggccagcccacctctccccgcactgtccggcatgcactgcctcaaggctttctctgagccgccctcacccacctgtcagcgaggcttccctggcaaccatcctgaacagcagcatgtgtcccggccactggactctgcctcactcttccccacggcgcttacccctgcctctgtctgtctctgtctgtctgtctgtctgtctcttccaataggaataaaaacataaatgttcttgctctactcctggtgcctagagctgtgcctgacatttggtcggcatccacaaatgtttctgaacgaatgattaaccaaacgaaaggctgccaggaagtatccggaagcatggcctttgggatggacagatgctcctgtggcttccatgctctgcggagccccagtcccagctcgccacggctctttatcagctgtgctccagggctgctgtccgcactctgcccttctggcctgtccctctctcccctcctgtccctttccctctgtttcccgggcctctcccttcaagttgagtagtttccattgccctctttgttttccgagttttatttatttattatattttatttttttttgggacggagtctcgctgtcatgcaggctggagtgtagtggcgtgatctcaggtcactgcaacctccgcctcctgggttcaagcagttctcctgcctcagcctcccaagtagctgggattagaggtgcccgccaccacacccagctaatttttgtatttttagaagacatgcggtttcaccatgttgtccagactggtctcgaactcccgactttaggtgatctgcccacctcagcctcccaaagtgctggaattacaggtgtgagccactgcgcctggtcttgttttccaagttgtaacgcccttcacgatgaagaaacaaagaggtcagcacgtacccgcccctcctgggatggtcagatgtccatgacacccctcttcctatgggctcggcccccacctccccaggcccctgggttcctaaggccggggctcctctctccttactgatctcaccgaggaaggccaggtgcctgtctcctgccacctaaggagatgtgggggcgtggattccttgtctgtgaatggagccgctaagcttggggctcctcaggcgccttggctgtttcctttagctgtatctcagcctccctccgctgtgcccagctctgcagaggctccatgtctgtggctggctatgctgtgtggagacccctactccactctgtgtaggaatcgtttgtcccagagatcagatcgaactccttggggtgggcgagccgtaggccttcaatcaaggctcactgaccagggctggcatgcacttggtgcctggtgctgaccctggggctgctgtggaagcttctcagtggaggctcatgattggtgcttgagtgagtgaggagcacccgccatgggggcccagacagcccttccaggcaccaggagggctacaccccttgcctccgaggcctgctcactgtcactggctgcccggctgttgcagttcccatcactgtttattccttcctctgtgtaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggtaaccgctccctggactctgggctgctgggcagtggcctccgggccagctgagagactcccatgcaactgcgcagttccacggaaaagcacaaagccccagcaaatctgcttaccccattgggtctcagtttccccatctggaaatcaagggttgggtgacatgatgtctaaactgtcttcggccatggaattcctaattctgaagatggcaatttatttgcaactcagccctctccggggggaccttgctggaaggcacctggctttccgtcagaccctgcacacatggcctcgtgtgatcctccccatgagatgatctcatgtggaccattttacagataaggaaatttgagggtcagagaaaatttgcaacttgtgttaagttcccaaagtgtgcttctacattgcttcctgagagctcttaatattttattttaaaaattaaaaaatccctggtggtctagtggttaggggaaaaaaaaaagacaggaacttttttttttcttgttgctttgtctgtaatctgctcccggatagagatagttctgcaggtgaggcatgggtgagaaagtccctgaggctgcggtatctgaagcctccagagcagcatcttcaagtaagaaaatgaccagcttctacaaagcagaggcaacaggtccccaagcctgggggagcccggtgtgaaatgaaaatgtgggccccttgttcaaaattacagaacccaagaagggacagcagagtgtgtgccagtgtcgggtggcagggccggggctgcaccggccgcagcagagtccaggccgccgctgaggggagtcacgtgggtgccgaggagggggcgggggagtcacgtgggtgccgaggagggggcgggggagtcacgtgggtgccgaggagggggcgggggagtcacgtgggtgccgaggagggggaggggagtcacgtgggtgccgaggaggggaggggagtcacgtgggtgccgaggaggggaggggagtcacgtgggtgctgaggagggggaggggcggccacgtgggtgctgaggaggcgggggaggggagtcacgtggttgatgagggggaggggagtcacgtgggtgctgaggaggggaggggagtcacgtgggtcctgaggagggggaggggcacattgaccttttgcaacctgaatccggtccgccccctcctcatccgcggtccgcttgggccttcagcttctcctgtggagcgtctgcggctctttttattgaaacattagagaaaagtagattcaaacccatgatcaaaacagtcaccacgaaagacaaaccctgctcagcccgtgttgtacaaaatgaaaaggtcagccctctcccggggcacagggtccggacagctcggggccaccctgccaggctgtgcagctctggctgggggcttttttccggctgtgttagccctgctgttggaaaccaagtggactgtcctgcagcccagacaagcccagtggcctttgtgcttttaattgtgataaatgtacctgctttagaaaatgtttaattatgttggaagcaacttaaactgttggatgcctacggctctctcagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggtcagtagcctgcactggtgggggccgtggggtgggctccagggtcctttctgggcgccgcctttcccaggtgctgttgggagggtccttcccagctgtccacgtcctgggtcccctggatgtgctgtcatttcccacatgggtagggtcccttctcaacctttgcaggctgggaagtagggcaggtctgagggtgctgtgggtcagccgtcctgcgtgacgggtcacctgtcctcccaagcctcggcctcctggtccgtgaggttggggaggcgatgccagcttggggctctgtggggatgcagtggtggcaccaggagtgggcacacagtgaccggggacccagcccctgctccttgctctgggacagtgacttacaaagcactaaccctgtgcaggcagcgagcccgaccagggagcagatcaggtgtccgtccagcacgtgccccgcgagtccgcaagcgagaggcgagcaccaggggcaaggagcggtttagaaggattcaggatacccagcatgtcaggaattgggttactcaatggagaaaatggtgtgtgccagcagacttcatccctgccggccccagcatgtgccgtagccccccagggtcgctggaggtcaaagaggagaggcagcgtgcggcacagtgccagcttctaaggaaacagacacacacgcagtcaccattcattagacaagcgtccgttgagaatccaccaggcaggctcagggctgggatgaagaagccgcggcctgtctcctcacagtcccgccgttcggccccggacacggggtggcatctggtctgagaaacacagcacgcgccgcccccccaacccccacaaccccctgtgttttggatcctgaaacctctgccaactccacatttggctggagaatcttcctgagcacacgagtcaggctgccgctgactgctggtggtgcttgagatgacatttatttgccattccaggccatttcagataataataatatattatctttacatttagagggaataatatattgtctttacatttagagagaatgacaactccttttaatgggaaaaaagtctttttttaatggttaaaaaaatggctgtaggtgagaaaacatttatctgtattaacaaatgtgtttcccagaaatatgaaaggtcatagttcttcttataggctttatcaaatgaattttttttttgctttttttttttttttgagatggagtttctctcttgttgcccaggctggagtgcaatggtgcgaccttggctcactgcagcctccgcctctcaggttcaagtgattctcctgcctcagcctcccaagtagctgggactataggcgcgcaccatcaacgcccggctaatttttgtatttttagtagagacggggtttcaccatgttatccaggctggtctcgaactcctgacctcacgtaatccacccgctttggcttcccaaagtgctgggattacaggtgtgagccaacatacctggcctatcaaattaattttaaaatcatttactgccattctttaaaacaacattgataaaaccagtaatggggcctgaataacatgcgctgtgggaggtttgctcttctgacacctgacggcctgtctgtgccgtctccccttgtgtagaacaagccaggcaggctgaggtcctggctttctcctctctgacttcccatggccctggggtgccgtggcacttgttgtggccagcagggatgtgaagtcgctggcacacgagtttgttcagcttgtaagcaggtggcgtgacagtcaagcactgtccacggatcttcctcaactggctataaatatgtcgaagtatcttaggttctcaataaaataactgacatgcgccttcctagctgggttggaaatgaccccaaatacgatctaggtaaaagctttttgttcgtagatttgtacatgatttgcagggaagccaagcaaacagtaaatgtcagccacgttttgtttctttgagcgaggagagagctgcgttgtggtgatggtggaagtgagccagcagttgaaatgttagcctctcctggtagagaaataacttgtcattagaactttatgtagtcaatcatcctgaaaatgaaaaggatgtgggaaaaatgtcattgtgctcgctgggtctacattacaaaatgcatggagtgttgagtggggacgtgtatagaaatcctgctctggagtcattacctgcagggacatacatctttatgacccctgggaccagtggacaatgaacacttcaaaccttgccaaattggccaggtgcagtgggtcacgcctgtgatcccggcactttgggaagccgaggtgggaggatgacttgagcccaggagtttgagtctacccagggcaacagagtaagaccccatctctggaaaacaaaaaacaaaaacaaaacaaaacaaaaaaacaaccctgccaaattgtgaacagtgcttgaaaacagccttggttcttaagatgcgtggacagggcaagtctacaaggcggaggcgacggggaccgtggagaaaccagggcagccccgccgtggatgggaggcctctgtactctctggtcctcagtgctgttggtcctgaaccagggattaaaatactttttctcgtgacaaccagcacggtgtcttccagggcatattttgttcaatccccatcagagctgaggaggaccaggctgggagggcttacgctgggttttgcacaggaaggaaagcagtttctgactccaggtttgggttccccacactgcaggcacagccgtgaggcatttggggtgcctgctgcccagcactggctgaaatgcgcctggccctgtacaactacagacacaggtccattaagcagagcccttgggagatggcatgtaagtggattttgtgattagctgagagatataaagaaaacgtgtgttaaatcctcttctttagaaagtcttgctgtttttaatgacttatgattctttctctcctgctttagtaacgagagtttgtgggacacagtgtaatgtgtggtgcttttcagggtctctttccgtgcctccagttgttactatgaactatttttctttgattttttttttttttttttttttttttttttttttagagacaggatcttgctctgtcactcaggctggagtgcagtggtgcacttatagctaactgcagcctgcaactcctgggctgaagagctcctcccacatcagcttcctgagtggctgggactacaggtgcacagcaacacatcctgctatttttttttttgaaatggagtttcgctcttgttgcccaggctgcagtgcaatagcgtgatcttggctcactgcaacctctgcctcctgggttcaagcgattctcctgcctcagcctccagagtagctgagattataggcacccgctaccacgcctggctaatttttgtatttttagtagagacggggtttcaccatgttgaccaggctggtctcaaactcttgacctcaggtgatccacccgccttgggctcccaaaatgctgggattacaggtgtgagccaccatgcccaacccctgctaatttttttgtagagatggggtcttgctgtgttgcccaggctggtctcaaactcctgcctttaaatgatcctcctgccttggcctcccaaagtgccaggatcacaggcatgagccactgcacctggccaaccagtttttaaaaatcagattagagacaggcagatggatgcaggtggaggttggtcagaagctatcatgacaaacttgtccttactgctttatctttaggaggagaggagacgagggtgagtagtcatgctggttagtgagtctcgctctggggttttgaagcctgagcaaggtgtggtaaagacacactggcgtgccagcacatcccagcttggacatgtcacttgattctcgtagctgtgtcttcacctctagagtggacatagtgcccgccccatgtagggggagaggtgaaattattatgcaaataagtgaatgccgtgtacaaactccaggagctttcttaagcagtatgagaagagctggcagacctgcttagtgttaattctttacgagtactgatggagcacccgccttcttcctggtgctctgggggaccgagggttgggtgagatggagctgtgtcttctcagagttttcagccagtgggagaaagagcagactgctgtcatgtaggcggtgtgaaatgctttatgaaggaaacattcttccgccctcatctcagccacaatcactattggcctggaccgtggcatgggtggtcaggttatccccatgagctccaggcatgaagtccctgggctgcctactgcctcgggctcgtggctcgctctgcccaaccacctggcttcccgtcatcccctccagcccttcccccttgtctgtgcacctgctgaccctgtcctcagaacacttcttactctgtgcctggctacccctgctcagcagcttagcctgagaaccacccctcagaggggcttttcggatcttgccgtctaaattatggctcctttgttgaggttattgcctcattttattcttgcgtccggtgttgctaatgagaattcttatgtccatctgattctcattcacaggtatgcagtctttaaacctgtttttccctcctgggtagctgacagcattttctctttattcttggtgttctgtgatgttgctctgacatgtctgagttacttttctctgattttccccgtgtggttctccgcaggccctttcacagagttctttcatggctttccttagcactgggaaatcgcagctactaaatcttcgcagccacgaaggctttgttcctctctttccggaattgctgtcagagcgacattggcatttgtgagtttttccttcaactctcaacttcgtaacttcaaaacaaacaaacaaagcctgcatttcttattagtgctgccctgtgaacaatgcttcctcctcaccgctggctccacgaggcctcttcatcctgggtcaccggggactcgcctttctgcggagtggctcccgcacagcgtctctgctcggctctttccgctgcagtgtgctgttgttcccggactggcctctcccatgttatgaggacctccattcaccgattgcacagtcagcgtccggctgctccactgttccgtcttctctgttctttcttctgcacgatgctggtgcccctgaaacctctggggattcttaatgctgagtttatcttgttagtggatatttcttgctaaactgtcaatacttctcttttcttcttacaagataagaaagcaaacttgagaactacttggagcctcagagcagcatgtgggtgttgatcgtgggtcagcccaggggcagcccacaggcttttcagtaggtggccctgcggggctggggctgtggcacgggggtgatgtggggatgggcctgccaccatcgctgtgcttttctctttgttacttggatttaaatggaaagtcccctccgtgaggccagataatcagctttggggattttgtggagggatctgtaatctcaactgagcctctctccaagacaaggtgtgtgggccacaacgtgtgtgggcggcaagccgtccaggtgccgaggcaagagaccgagggcacgagctggtccagtatgataaaatatataaaacaacaagagttatactctatatgctctctctatatatagggttgttttgtatattttatcatactggaacagctcgtgccctcggtctcttgcctcggcacctggatggctggctgcccacaaaggtgcaaatggagagttatagagaagtaaagtttacgtgaacgctggcacaattgtgcagagagggaaggtgaacttgtagcatatcagcgcacacacgcgcacacatacacgtgcacacctatgcacatgcggacacacgcacacacatgcacccacgcacccacgcacacgcatgcacacatgcacacacatgcacacacactccctgtctgcaaccattcagaggagggatagtgcaacaggtaagaaatacggccttataaaaatgactacagagccgagtcccagccagcagagtggccctgttgagagaatccggaagagcctcccggagaaccaggtgagaaggcggaccctggacaggagccggctgaccaggcaggctgggcagagggcacagagtagggaaagaccggggtccgatgtagagaccacactgaggagaggctcaagtactgcacgtcatttatagctgaatctagagacataatagaattccatttgtttcaggacagtcattttggtgtggattagagtggggggagaagactggagtggaggtgttggtgtccacaggccttcctgaggcccctggcctcactgcgcacatctctgaactgtgccttgtagggtgtctccaccagtgattcaccctctgtctcctgcacctgctgagccttggaagtgggtggacgtgcccacctggtcacaggcagcccccgtggtggaggccctggctgagcaggagcctgtgccctggggggctcacactgatggggccagtgggatgctgacatagttcatccttccctgagtaccaagcagatgaagctcagggagaggtcggggtgacgcttcccatgggggcgcctggagacgctgccgcccttctcattggtgttagggttggggagagccggcgtttagacgcggcactgtgcacccagggacagactaggagcccgccaagaggggtaactggtgagagaaacacaggccctttctaagagagaaggtagggcagggagacaaatagccctaaaagcagaatcaggggcacccagagtagcggctgggctgcaggcggggagggaggtagggagagaaggggcttggccacctgcagggacccggggagaacgcttctaactgttcttcctccacaaatcactctgagacgctgtgctggccagacgagctgctaaatggatgtgacttcttccacaggggatgcgggagagaagggagacaaaggcgcccccggacggcctggaagagtcggccccacgggagaaaaaggtacctgcagccctgggccggccctcagagctctgaggatggaggcaccgctcctgctagagccgggtggggaggtgggggtggtggttccagagaggacaggccctgccctctgggtcccagggaggcagacggcatgggacttgggtcgggagcagggaggggagagtggtccttcagcactgctccttgtgctgacctgtggggctctaggaaagaaagtgtgtcctggaactcagcagaggctcctggcccctttaagcctcatctgtaagacgggaataacagcttccagatcatttgtgagcgctaagtgaatcagtgtcgttatgaaggcggcgtggcagagtacacagataggaccctcatcactttgcgtctgtctcctccttcgtaaagtcgtgtgattctgcctgcctcgtgggactgtgccgaggctcatgggagctagatcatacgtgtaaaggaaatgtatcatgtgtaaagtagctgcacagtgcatggcaggggttaaatatatggtggctattatctttatatactccttgttactgcttaaaatttttttaagtgttttttctttttctttctttctttcttttttttttttttgagactgagtcttgctctgttgcccaggctggagtgcagtggcacagtcttggctcactgtaaccttctcctcccaggttcaagctattctcctgcctcaacctgttgagtagctggcatgtgctatcacacccagctaatttttttttggggggtatttttagtagagactaggtttcaccatgttggccaggctggtctcgaactcctggcctcaagtaatacattttttccaagtcattaaagattgtctctagaaatgctttctcagtatgtacacatcattctatgagaacatatactacagttagccaaccccccaaccaatcttttaacattggagagttaagttgtttccaattaaaaaaaattattataacaacacaaagataattaaatatatatttaagcccatacgctgttttttgaaacgtttttgaggtataatttatggtcattctcattttgagattaccgtgcaatcagttttgaccattgccctcgcccgtacccctcatcctaagcaagagctggaacattctttttttttcttttttttaaatcagctttccatttattaagtttagagaggaacaattctaagtaaagctttaaaaaatcttcaacacagatattttttataggcaatacagaaggacaggatgaccaataagggtgctcagagtaaaactcctaaagttgcacaagttgtagaagaaaatttcttataatgaaaggacatgagtatctagattgaacagaactaccagaaacctggcaaagtaaacgaaaaaaagtttcataccaagacaactgactttgaaatttcagaacacaaagataaaaacaaaatccaaaattttccagacactaaatatcacatacaaagaattaggaatccgaataacatcagtcttcccaatattagcagttgaagaaagaacagtacctttaaaatcctgagggaaacttatttccattcaagaattctacacccagctaaactatccatcaaggctgagagcagaataaaatattttcatgtatttcagttcacaacaatgtacctcatatgcaccctttctcaggaatccactgagaaatattttctttcttttttttttaaagggattttatttatttatttatttatttttagtatttattgatcactcttgggtatttctcgcagagggggatttggcagggtcataggacaacagtggagggaaggtcagcagacaaacaagtgaacaagggtctctggttttcctaggcagaggaccctgcggccatccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcagggggttgggggtaaggtcaaagattaacagcatcccaaggcagaagaatttttcttagtacagaacaaaatggagtctcccatgtctacttctttctacacagacacagcaagaatctgatttctctatcctttccccacatttcccccttttctatttgacaaaaccgccatcgtcatcatggcccattctcaatgagctgtggggtacacctcccagacggggtggcggccgggcagaggggctcctcacttcccagaagggggcggctgggcagaggcgccccccacctcgcggacagggcggtggccgggcagaggctccccccacctcccagatggggcggctggccaggcaggggctgccccccacctccctcccggacgcggcggctggccgggcaggggctgccccccacctccctcccggacgcggcggctggccgggcgggggctgccccccacctccctcccggacgggggggctgccgggtggagatgctcctcacttcccagacggggcggctgctgggtggaggggctcctcacttctcagacggggcggctgcccggcggaggggctcctcacctctgaggcggggcggccgggcagagacgctcctcacctcccagacggggtggcggtcgggcagagacactcctcagataccacacggggtcgtggctgggcagaggcgctcctcacatcccagacagggcggcggggcagaggcgctccccacatctcagacgatgggcggccgggcagagacgctcctcacttcccagacaggatggcggccgggaagaggcgctcctcacttcccagactgggcagccgggcagaggggctcctcacatccgagactatgggcggccaggcagagacactcctcacttcccagacggggtggcggccgggcagaggctgcaatctcggcactttgggaggccaaggcaggcggctgggaggtggaggttgtagcaagccgagatcacgccactgcactccagcctgggcaacattgagcactgagtgaacgagactccgtctgcaatccgggcacctcgggaggccgaggctggcagatcactcccggttaggagctggagaccagcccggccaacacagcgaaaccccgtctccaccaaaaaaatacgaaaaccagtcaggcatggcggcgcacgcctgcaatcccaggcactctgcaggctgaggcaggagaaccaggcagggaggttgcagtgagccgagatggcagcagtacagtccagcttcggctcagcatcaagagggagatcgtggaaagagagggagagggagaccgtggggagagggagagggagaccgtggggagagggagagggagactgtggggagagggagaggactggaacattcttatttcacttagcgtaatgccctccaggttcatccaggtcacaaatgctgggattttcttatatttcaagactgaataatattccgttatatatgtgccatgttttctttatccactgattggtcaacagacgcgtaggttgtttttatgtgatggctgttgtgaataatgctgcagtcagcatgaaactgtagggatctcttcaagatccgatttcattcctttggctatggacccagtagtgacattgttggatcatgtggtagttctgcttttgattttttcttttcttttttttttttaagtttttaaactttttatttgcatatttaaaaaattgtgcattccaataattaaaatcatttgacaaaaagaaaaaaatggctctctgattaaactgcattacagcctgcaggacaccttgggccagcttggttttattctagatttcactgtcatcccaccccacctcttccttcaccaacatgcaagttctttccttccctgccagccagccagacagatgggagagacaggcgcggccttcgttgtccgtagttctttgatgtgaaaggggcagcacagtcatttaaacttgatccaatctctttgcatcttacaaagctaaacagctaaaagaagtaaaataagaaggcaatgcttgtggaatatacagtgcatattggcggcgcacgcctcactacgatttgcctgcttgcttctcctgttcagtcgtttctttggaaggcagtggatttttctcttgagtctctgtcttcttcagtttcgacttatcgaatttctcgatctcagccatatcgggtttgtcagacatggttgtggaggaaaagcggagcgaggcgtgcgagaacgagagaagtctggtctgcgcagtggccaccactgagttgtcgcttttgattttttcaaggagcctctgtactgttttccattcccaccagcaatgtctaagggctcgcctttctccacatcttctccaatgcttaatctcttttgactttttgataccagccatcctaacaggtgtgaggtaatgtctcattgtggctttagtttctattttcttgataattgatgatgttgaccacctttccataaacctgttggacatttgtatgtcttcttagaaaaatatctattcagattctttgcccatttttaaattgggttatttgtttttcggctattgagttgtatgaattccttacatattttggatattaacctcttatcagatatatggtttgcaaatactgtcttccattccataggtacctttctgttttgttgattgctttctttgctatgcagaaacttgttagttggataggttagtaccacttatttatttttgcttttgttgcatgtgcttttggggtcatatcccaaaaaatcattgccaagaccaatgtcaaggaacttttcccttacattttcttttaggagttctgtgatttcaggtattacatttaagtcttctattttgagctgatttttatgtatggtataagacaaggattcagttttgtttttttgcatgtgaatattcagttttcccaatagcattgtgaattctttgtgcctttgttgaaggttagttgactgtatatgcactcatgggcttatttctgtgctttcttctctgctctattgtctatgtgtctgtttttatgccagtgcttgtttgagcaagtatactggtttgattaccatctatctgtaatataatttgaaatcaggaagtgtgatgccttcagctttgtttttcttgcttaaggctgctttggctatacatgaccttttatggttttacatgaattttaggatttttttttccatttctctgaaaagtgcctttggaattttgatagagattgcactgaatctgtagattgcattgggtagtatggacattttgaaatattaattcttttgatccacgaacagatattttttccatttatttgtgtcttcaatgtttcatagttctcagtgtacaggtacacaacacttccttggttaaatttattcctaaatatgtcattctgtttggtgctacagtcaaggagattgtttccttaatttttttcaggtggctcattgttagtgtatagaaatgctgctgattttcgtgtgttgattttgtatcctgcaactttactgaatttgtttattagtgctaaccagtttttagtggagtctttagggttttatttatataagattatgccatctgcaaacagagccagctttacctctccctttccaatttggatggatccctccctccttctttcccgcctccctccctccctctccctttctcttcctttctttctctctttccttttctttcctttcccctttccttttctctcctttccactttccttttttctttcttgcctaattgttctggctaggacttccagcactatattgaatacaagaggcgagaatgggcatccttgccttgtttctgattttagagtaaagctttcagcttttcaccagtgagtatgatgttagctgtggacttctcatacatggcctttattgtgttgaggtgcattctttgtatatgtgctttcttgagagcttttatcatgaaacaacactgagttttgtcaaacgttctttcagcatctactgatgataatatgatgtttattcttcattctgttaatgtggcatatcacatttattgatttctgtatgttgaaccatcccaggcataaattttgcttgatcatggtgtataatacttttgtttttgagacggagtcttgctctgttgcccaggctggagtgcaatggcatgatctcggctcactgcaacctccgcctcctgagttcaaccgattctcctgcctcagccgcccaagtagctgggattacaggcacgcaccaccacgctcagcaaatttttgtatttttagtagagatgaggtttcaccatgttggccaggctggtcttgaaatcctgacctcaggtgatccacctgccttggcctcccaaagtgctgggattacaagcatgagccaccgctcccggccgtgtataatctttttaatgtgctgttaaatttggtttgctagcattgtgttgaagatttttgcatctgtgttcatcagggatattggcctgtaatctttttttcttgtattgttcttgtctggctttggtatcagggtaatgctggcttttaaaaattagttcagaagtattctctcctcttcaattttttgtaagattttagaaggattggtattaattcctatttaaatttttggtaaagtttggcatgaggctaccaggtcctgggcctttcttcgattggagatttttgactacagaatcagtctcattacagatctgttcaaatttagtattttttcattattcagtctttgtgggttgtatgtttctaggaatttatccatttcttctaggttattcaaatttttgatgtataattattcgtattactctcttatgacccttcatatttctgtggtatcagttgtaatttctccattgcatttctgattttatttgagttacctcttttttcttcgtctagctaaaggttcgtcaatttttttttttgccttttcaaaaagcaactcttagttttgtcgctttgctacagcttttctagtctctctttgattatttctgctctgatcttcgttatttccttacttctgctaactttgggcttcatttgcttgtttttttctagtcccttatggtgtaaagttagattgtttatttgtaatctttattttccctccatgtaggtatttattgttataaaatttcctcttagaatatctttttgctgtagcccataagtttttgtatgttgtgttttcattttcatttgtttcaagatattttttgatttcttttttgactcatggattgttcaggaatgtgttgtttaattttctcgtatttgtgaattttcgttttcctcctcttgctgattcctagttttatcctgttgtggttagaagagacgcttgatatgatttcagtctccttgaatttgttaagacttgttttgtggcctaacgtatgagctatctcaaagaatgttccgtgtgcactggagaggaatgtgttttctgctgctgttggatggaatgttctctgttagctccattcggtctaaagtgtagtttatgtacaatgttttcttactgattttctgtctgggtgatctttccattgttgaaagtgaggtattgaagtcccctactattagtgtattctatctgtttgcccttcagatctgttaatatttgctttacatatttaggtgctccaatgttgaatgtgtgtatatttgtaatgattatgttttcttgatgaattgaccttttatcattatataaaaacccttttttactcttggctacagtttttgacatagtctattttgtctgatataaaataaatatagctacgcctattctgttttggtttcaatttgtgtggaatatctttttccatcccttcatttttagtctatgtgtgatcttaaagctgaagtgtgtcttttgtaggcagtgtatatagttgggtcttctttttatttatttatttttattaagctactccgtgtcttttgattggataatttaatctatttacatttaaagtaattattgatagttaaggatttgccattgccattttgttaattgttttctggtcacttggtagatcctttgtttccttcttcctctcttgctgttttcctttgtggtttgataattttctgtagtagtatgcattgattcctttttctttcttttgtgtatgtactaggttttttatttgtggttaccacaaggcttatataaaacattttatagttataacagtctatgctaaactaataacaacttaactttgatcacacacaaaattctacacttttacacccaccccccattttatgtttttgatatcacaatttacatcttttttattgtacatctattaacaaatcattgggccaggtgcagtggctcacacctgtaatcctggcactttgggaggctgaggcgggtggatcacgaggtcaggagttcaagaccagcctggccagcatggtgaaacctcgtctctactaaaaatacaaaaattagccgggtgctcgcctgtagtcctagctactcaggaggctgaggcaggagaatcgcttgaacccgggaggtggagcttgcagtgagctgagattgtgccaccgcgctccagcctgggcgacagaatgagactccatctcaaaaaaaaaaaaaaaaagtaaaatatattagctgggtggtatgtgcctgtagtctcggctgaggcaggaggattgtttgagcccaggatctggaggctgcagtgagctatgatgatgtcactgcactccagcctgggtgagagagtgaaaccctgtctctaaaaacaaacaaacaacaacaacaaattattgtggctatagttattttaatatctttgtcttttaacctttatactagagttatatatgatttacacataaccattacaccatcagagtattctgaatttgactattgctatcatttgaatgtttgccccctccaaaactcacgttgaaacttgatctttaatgtaatagtattgagagagtgggcctttaggaggtgactggatcatgagttctctgacattatgaatggattgatccatttatgagttaatagattaatgggttattacaggagtgggttagttatcatgagagtgggactattataaaagccaggtggcctctctcgtgggcctccttactgtgtgatgccctgtgctacctcaagactctgtggagagttctcatcagatgtggcctcttgaccttggatttcccagcctctagaactgtaaaaaagaatttcttttctttataaattacccagtcacagatattcagtaatggcaacagaaaacagactaaggcaagtatatagttttatcagttatctctacacttttaaatgttttcatgttactaattagcatccttttgtttcagcttgaagaactttcctttacatttcttgtaagggaagtctagtgggaacttctttagcttttgtgtatctgggagactcttaatgtttcctttatttttgaaggatggctttgtgagtacataatcttattgccagtttttttctttcagtactttgaatatatgatcccactttctcctggcctgcaagttttctgctgagaagtctgctgatagccttatgagggttctcttggatgtgatgagtttcttttctctttctgctttcaaaattctcttctcgtctttgatttatggtagtttgattataatgtatcttggtgaagttttctgtgggttgaacctatttggagactttaagcttcatgtaccttgatgtccacatcactcccaagtttggaaagttttttaggcattaattctttaaataagctttctattagcttctctctatattctcctaatacaacttccataatgtgaatgttagctttcttgatggtgtcctttagatctcacaggctttcttaatttcttttaatgccttttttcttttctcttctctgattgaatatttttaaatgacctgtcatcaagctcacatattctttcttttcttttgtttgatcaattctgctcttgatgctgtctgctgtattttaaattttattcattctgttcttcagctttagagtttctgtttggttctttttttaaaaaaaaatctctatctcttcattgaattcctcatttttaatgtattgtttttctgattttgttgagttgtgtgtctatgttctcttgtatctcattgagcttccttaaaatgattattttgagttctttgttaggcaatttgtagatctccatttctttgggattggtttactagagtattattgtgttcctttggtaatgtcatgtttccttgatactttatattccttgaagtcttgcattgctgttttctcatttgcaaaagcagtcacctcctctagtctttatggactttttttgggagagagatttctttacaaaacagcctggctagggattctgaggctctctcagaccatttctgtggatgcacctgctccacaccttttgcttctcttggagaggggtgaatttttaaagagtatatgccttttcttgatcccacaaaggcagtctaggtgctactagcctctcattagtttcccctagggcagtgctctgaaatgctcaagttcttgtgccttctccctccccatcccacacagtcaagctatctgtctgtgtgagatgctggcacttgccatctgtgggggtgcctttggggagctggcagagtgttgggtgaagcatgtgagcatttgggtgcccgtggtccagttgggatggttcacaggaaaggcgtctccatcagcttgttggggggcttcctaataaaatctgcagagcaattattagggtccatagcctttcttcctagctcccagtctctcccaacttctcctccatgtcagtcacctcagtattggaggtgagacaagaaagaagcagactttttttgggcagcatcctgcatggctgggggagctggaagctcacttactacactttcacttactccagtgggaaaaaacatgggccaagggggtttccctgggcactgagctgtgttgctcagctcacagttgctcagcttacagttgtgggaaacggtcacacgggtaaagtgaaactgttcttaccctcatcagtgcatctattcttggatttttttctctaacagtgtgctggaacttctccactggacttccagactcctacaaagacacttttgttcatggggagttgtcaacatggaagcttctttggggggactatggtagaaagctcctcttctgccatcctcctaacatcacccatgtgtgcatgtcttgtcttcctaattagattatacattcctcaagggtagggatttgtggatcacactctgccatcctgcgagtaagtggttccaagtccctgatatagtagttattcctaagtattagattgatagatttacagagggtcattaaacatacattgactaccccagagatatggggttaaagtctgatagactcttttcatttctacctcttaaagaatcttaatcaaaggatccacaaacacaatggtttgctgatccaaggcggcaaggattctctattaaaacctctgaggaattcccttctccctccctcctttcttccttccttctcccacttagaagtggcagcaggctttttcaggctccgaggcctgtccccactgatgttcaggtgtaggtcaggcttccatgctcaagcaggcctcaggtccctgctgaggggtgggcacggatggagggtgagcctgaggcaggatgtgcaggacagcgactgctgagacagcgttcttggctgccttgtggtgggtggggggccatggacccagcccagggcgggggttagggaaggcactcgggaggctactcgtaattcagggtttctgaaatctggagacagggagggctaggagtccataaagggatgtggcatttggcatcccagggagtcagcttaggggaggggcgtttagcactcaggggtctactctgtgcctcagcttggacccatgagtttggaaagtttcttttcttcttttttactttttttttttttttttttgagacagagtctcactctcgctctgttgtcaaggctggagtacagtggcataatcttggctcactacaacctctgcctcccgggttcaagtgattctcctgcctcagcctcctgagtatctgggattacaggcgcccaccaccacgcccggctaatttttgtatttttagtggagacggggtttcaccacattggccacactggtcttgaactcctgacctcaagagatccgcctaccttggcctcccaaagtgccgggattataggcatgagccgccatacctggcagactttgcaaagttatttaacatctctattatctgagttgtcaggcagggatagtcataacattgtatttactttttccagcagtcacagccagtcgtgacagcttctgacatctccaaaaggaagtgcacctcgtcctttgtagaaatgggatcacagggtaatggatctggaaatcccaccttcacacttaagttggaccctgagatgcagagaataggcaaccactcttcccatggccacatggcttggacagaactggagcagaagccccatttctagatggacgtggtttgctgggagggaggaatattgttaggcacaatgcggtcccagcctcagctgagcagtgcagagaccacagacgtggaaccagacagtcctgggctcgctgggcctgtctgtatcgtggctccaccacctgtcagttatgtcagcttctggaatcagcttcgtcttcccaagccccctttttctgtacctgtaaaatggggggtggggggtggggatctacctcccatgactcccagaagggttaaatggaaggatagacgcacaatgtcttggatgcggcagttgcctggtgcctggtggcctggtggttgctgttattattctccgtttgcacagaagaaagtctgagccctggtgcttttgttcatgggaactcactagggaatgagcatgacttccggcctctgcaataaccaactgacattctttctgataatcgtggctgtttccgtcagctgtaagtgctctgttctggataatgtttattctcaaggacattaggtcaaagagagaatggaatatgtttacaaggacattaggtcaaagagagaatggaataaacttaggactttttatacacaacctgggatgaatctcctccctgagacctaggacaccctgggcgctctgcctgtgtggtaggcggtgcccgggccccagggggcgcagatgggctgggaaccaggacctcagccgccaccaccctccacaccctccctggagtctcactttccagtgggacacagccctgccaactcccctggcccactggctcttctgcccgtgggcttgctagctgggtgctagtggatagctttctagctcgttgcagcgggggcacagtggcagttccctgatgaccggtcacgaacatctgtggcttccatggcattatgctgtggagactcacctggagaaaaacagtgacctctgcgggaacttgggggccaagacttcctggtttctagggtcctgggaaccactgcagtcctgggcaaactgggggctgcaactcaacttcgcctgggcatgatgacgctggtcacgatgctgtgcatgacgacactgggcacgatgatggggggcatgatgacggggggcatgacgatggggtggatctgggcatgatgatgctgggcaagatgatggcatggtgatgctgggcacaacgctgggcacgacgatgggcacaacgatgagcatgatggggtggatctgggcacaatgacactgggcatgatgatggagggcacgatgagcacgacgatggggtggatctgggcataataacggtagatcggggcatgatgatgctgggcatgacactgggcatgatgacggtctgcatctgggcatgatggctctgggcacaacgatgctgggcatgaagatgggacacgatgatggggtggatctgggcataatgactctgggcacgatgacgctgagcacagtgacgctgggcacgatgacggtggatctaggtatgacgatgctgggcatgatgatggtagatctaggtatgacgatgctgggcatgacaacagcgtgaatctgggcacgacgatgctgggcacaatgctgcacacgatgatgctgggcataacactgggcgtgatgacaaagtgggtctcagcacctgtcccagtgcttcttgaaggggctcctgaaggggaggagcatccctgggaagagcgggacctgggtgtgacagccctgctcccatgccagccctgctgttgcccagcctgtggccactccaaaccattgttttcaacttctgacatcaaaatcacagccttcacagggcgttgctgccatgagtgggcctggggtctgcagatccgctctcatccttgcgtcttcaggtcctagcatgagacctgacgtttggaaggccctccatccactgttggaaaaatatcctgaggtttcatatcttcaaatacctctgcaatctgtgggtgatcccagtctatggccaagggccccccatctgtgtcatcctcccttccccaggtgaagcggctgccccgcagggttctagagagctggtctgtgggacgaggcttccggccatgctgggcgggggctgtgttctctgcctatctatggaggtggggctctgcttcaggtttctccaggggctctcatttaaatgcagctgctggcccaggagggcggcctgagaccctgcactggtcttaacagcacccaggtgctgctgctgccagcctgggctgtccccattggtgggggtccagatgcctctgcttccgcaaagtgcatgctctgcacatggggacctggctgcagtgggggctgccctgaacaggctggctgggtgtgcgctggggctttgagggagtgtcctgttgggaaagtgagaccccccaccccccattcgaggaggtggtgcggttggatggcctattctgagataaaaagccaggccatggcccagagaaagcccagctgttaaaaatcaccgaggaagctgaatttcaaatgctctttttgcctcttctccacttcagaggactgtgtgaagtgttcattaaaattaataagaactccacacctgctttgagctgccctcaatcctcatgcgtgtccagaggacagatgggaggcgcagcactgctcacaatggtgatgagatgtgggatgggctgtggcgttcgtgcccagtgtgccgggtgccacagccagaagctcctatggcagagagggaagggatccaggggcatcaggtgctgcattcctgttgtcgcacgcagccagcgggagggggcgttgcttgcctcttgcaaaaagctttctgtcacttggaggtgcacgaggccttgggagagggaaaaaggcgttagggctcttgttctcatctgctgtccttagagaacctctggatctgtaaccacactactgtccggccaagggttagtttccaagagaagtcttcaagttgaaataagtcagctacagaaaaggttgtggtatgaagtagagaatgtgttgacaatctcagtggatttcaacggttctcaccttttcttcttcctccaaacaccccaaaatagaatatttctgtcagaaacaacagctcacaccaataggtcccagtgtgtgtggctggtatgtggaggttggggtgtagtgagggtctcctgggtgcttctggggttctcagtttaagcctaggtgctgaccaactgtacaagcttgagctgtgtgaggataaaagtaggcttatgtacatgcactcatgcacacacgtgcacatagatgtatgtgcatgtatagttgtatgtatggatacatacctatatgtatatatgtgcatgcatgtgtgcatatgtatatgtacctgtgtgtatgtgcatatgagcatttgtgtgtatgtgcatatagcgtgtgtgtgaatagtatgtatgtgtatgtgtgctcctgtagtatgcatgggtatgtcatgtgagtatgcctttgtctatgtatgtgctgctggatgccctgttttgagataacaaagccaggccacgggtccagagaaagcccagctgttaaaaatcactgaggaaactgaattccaagtgctcttacatatgtatgtatatgtttgtattcatgtatgtatgtttgtgtacacatgtatccacgtatgtaggtttgtaagttttatgtatgtgtatatgggcatgtttatatgtacatatatacgatgtgcagttacatgctatgtgtggttgtatttatacataaatgcatgaatgtgtgcatgcatcatgcatatgtgtatgtatgtgtgtttttatgtgtgcatatgttacgtgtttgcatattgcatatctgttaatatgtgtatgtttgcatgcacatgtatgtatgtggaggtgaatgcacatctctatgtgtatatgcatgtgcatgtgtgtatgtatgcatatagatgtctgtgcatgcatatgtgtatagtatgtatgtgtgcatatgtatgtgtatgcatatcagggtagtacgtatgtgtatgtgtacatgcatgtatgtgtgtatagtatatgtgcatatgtctgtatataatgtgtgaggggacttcaaaaagtttgtggaaaagtggaattaaaaaataaaaatacaaatataaactttatttctcaatataagcaccatgaagttcaagacacttttgtaagtaattacaccagccatttagtccatccctaaagaactgagggttcctcatggtgaaattcccaggaattcccatgtggtcttttttacattgtttactgaagaaaaatgagtgccctttacagattttttaagatgaggaaacaagaagtcagaaagagccaaactgggaaagttggatgcttaatgatttccaatagaaactcttgcaaaattgtccttgttttataaggagaatgagcaggagcattgttggggtgagaagggctctggtgaagcttcctgggcatttttctgctaaggctttggccaactttctcaaaaccctctgatagtaggtacatgttattcttctttggtcctccacaaagagaacaagcaaaatgccttgagcatccgaaaagcctgttgccgtgaccttcactctcggccagtctgctttgctttcctggaccacttccaactcttggtagccattgctttgactgttttgtcattaagattgtactggtaaagccacgtttcgtcttctgttacaattttgaagaaatgcaatacaatacaggcccataatctcagcactttgggaggccgaggtgggtggtcaggagttcgagaccagcctggctaacatggtgaaaccccatctctactaaaaatacaaaaattagccagacatggtggtgcacgcctgtaatcccaactactcaggagactgaggcaggagaatcacttgaacctgggaggcagaggttgcagtgagccaagattgcactactgcactccagcctgcacgacagagcaagactctgtatcaaaaaaaaaagaaaaaattaaaaaaaaagatgcttaggcattcttcaaagaattttaacagtaaagcaaagcagactggccgagagcgaaggtcatggcaacaggttttttggatgctcaaggcattttgcttgttctctttgtggagggccaaagaacaataacatctgcctactatcagggtgtttagacaaagttggcactggctcatccggtggagggagtgtttctccacccccaggcccagctgtgcccagtgcttggcccttcccccaaaggcctccctgcaaggctgaggggaccgtggaaaggggtctggtggtccaagctatgggtttagggcagaagggaataaggagggacgggagggtttgggccacctgtagccaccctaactccccaccagccgggtatgcttggtcacggctgacacaggcgagagggctcggaggggcccctgctcggagggggctctgctcggagggggcccctactcggaggggactctgctcggagggggctctgctcggagggctctgcctgctgctttgcacactctggtctcttggtctctgtctcctgcctcctgggcttgggagtagggcactgcttgtcctcccacaggaacacaatcctgcgccatgtgtccagcccctggctcttagaaatgcaggcttcccgcagttcctggcccgtggagggtggctttggctgtacccggggtggaagtctcacaggctggggcctacccacagtgggggtgcagggtttggagccctggacgtggagtcaggaggccttggtctgagtgaaatccacgccatcagtgtgcgctcgcgctcctgctcctgatgctcgctgtgacccgaggcacggaatgccctgaggtgccacttgacagacagggaaactgaggcttacagagggctgtaacttgtgcagggtttcatgggtggagcactgagatttggggccaggcctgtctgatggcagaggctgtgctcggaatcacggggcactgtgttctttcctggctcactgtatgacctgtggtggtcacctgactctctgaactcctcttctggagcagagggcagtgtctctgtctctcaataccacacagcgggcagcttccaggacagagatgatttcctcccggctgtggaggctggaagtcagggatccgggtgccggcagggctgctgctcctgaggctgctgtccggggcttacaggcggtgtcttcctgctgcgtctcacgcggcctttcctccatgcatgcacaatcccggcctctctttctcttcggtaaagccacagtcctgttggaccagggcccacctgtgtgacctctttaaagaccctgcttctagtaggactcacactggggttagggctccatcgtcagaattttggaggatgtaattcagccctaacagatggtgctgctagggacgttgtgaagctgaaatcagcgtgtacgtgtggatgtggtttcctggcacacagtctacctgggagtattctaatttatttctgaaagatggaaaaatgagcagaatcccgggacccccactgagtccccacttggagaggggcagcgtcagagcacgggaaagaaaaccaaagtcccagccctaggaacgtcaccttcccatgaaaaagcacaaacaccacgggctgaggagcgacgtgtcagaggcggattgtggcccttcacctgaacaaagagccaactatttgctaagaagcttccacctggaaaagatggggagggcgcgaggggcttcctccccacctgggagctgtttctccctgagacccctgagagatgagatgtgaagctgttcaaggacagtgacagggagagagaagcggcccacaggccccactttcccgtcttcccacccacacagctcctccctggaggacgaggccaggcccccaggctgacaagtagaccaggaccgggatggtgaggcccaggagacagtggaggagaagcccctgggcacagatgcacttggggaggctcctcccatcttcgggaaagacttattagtggttcagtccatcagttggaggaggcacgtggcctgctgctgtagacaagttaaaacctgagagtgagttgagagcatttggcctttagccatctctgaatcacacggccagatgttaaagcaaatccaaggtcatcgctcacacttggcacctgtctccggcgagtagagctcagctcctgcccttggagaagtgtgggacccagtccctgccatagggggttctgagaaacccttgcgctggctgcttgctgattgtgagggtgctgtgagcgcgtccagcctgatctggcagcctggacctcctcgcgaggggacagagcggggaccacagctgaccgacgggggagcggcgtgaagacgtggagggggaaataagaagcataaacattgaggctgtcccaaccttcctcctgatggtcagcacagaacctctggaatagtgcggtggagagctgggcgagtttgtctttggacagaaggcccgaggaagatgcgtgttcccgaccttcctcctcatggtcagcacagaacctcaggaccggtgcggtggagagctgggtacaggaggcccgaggaagacacatgtttcctgcgcagacagggcctgggacaacacgaaacagcagatgtgcattttcagggaatatcagcttttctgtaggaccctctgcgggaggccgagcagaagcacggggctcacctttcagcttcagaccacggtgagggacacctgccctcacaaactcatcttgccctaactctctcccaaaggaactgtctccaaataccagcaccttggggtcacggcttcaacagaggaatttggtgggggacacagttccatccactgcaggaggtgacggtgctcaggccgtgactgggcactcagtgtgggtggctgtgtccatccttccgaggaaccaagacactccagggtacgtcctggggaaaggcagccaggatagggcagggactgcaggtttctagctgggtgaagggaagatttcagacagataatagtttttaaatgtttagaggactcttggagaaggtgaattcagctggctttgcatttctatgggcgcaaaaccaggctggctgggcggacccagcagagcagcaacttcccagctcctccagccatgagaactgactgtaccgtgcctcctcctgcagcaaagcagggcccctcagttatattccagggagaactgcaaattgcttcccttgcagcgagttttgggcatgtataatgggttggctagttgattgaagctgtttgttccagttgcccttctctctccctgctgtggcattttactgttacagaaatcttcaggttgaaattgtcatgactcagaacagcaggaacgggtacctggcatctgccatcgggaagagcaggccagttggctccagcaggcgctggactcacaggctgccgtggagagggattcagaggagggcagggctggccccctgacgatgaaggcaacgcactgagcactctggcagggccccctctggtgtgggggccctgcccctccctctgtgagacctcctggctgtccacctggtcccggccctgcccatgtcttggaccctgtcctcactgggtgcccccagcgatagtgcctctcaccgccttgctgtgcccctgcctgccccgctgcccttgggttcctcccccagctcctcttcctcacgtgggcccctgcctcccactggacacttctctcaggtgccctcctggcccttgtcaccgtcccatgatgatccctctcccctgcctgtccccctctcccctgcctgtcccccatcccctgcctgtccccctctcccaacgtgccccgtgacatccccctctgtgcctctccagagctgtgtctccctgcgcctaccttggggaggcttggcactcagtgccagctgtgcgtgcctcatccacacatcccatcacgcacgaggttctgccaacactgcctcctgggtgtctccccaatctgggcgtttttcttatcctcccagaacccgcctgccatgacccccttcacccccagcctgctctgcccttggtctccttttgcgcctttcagtctttccagcaagtgttgccagatgcttcctgaacacaagtctgatctcgccgccctcttcgccaaccctccacatctcctgcagcacggagatgcaccacaccctctccgatgctttcctgggctctgaggacggacgaggaagtggtgtccccgttgccccttttctattcccttccctcgcacgcactgcagttgctgggccgctgtcccgacttaccggcaaaccctgagctctgatccctgcagccagcgccctgcacagctggcaacacacagcgcctggtgtgcgaagcagagtcgcctccgtcctggctgtccagctccagcctaggtgccattaggatctccctctgcctccctcgtccctgcatcgtcccccaggctggatgtggcccccagctgccagcatcaggagagcagcctgggcctcagagcagcagagtgtggctgttgtcctggctctgccatgccgggccatgtcattttcatagccagataagagaatgcatgtgaacgtgctttgtgaatcaaggctgcattttattgcaatgtaaaccactctctgcaggggcatgtgtggtttcattttagcaaagctcactgaagtctgtgttccatcctctggtttctgtctattctgaattgggggaacgttacatctgcttcgcaaaacaagactaggagttcctggcagggaagtccttggttctaaggaggcaggtggcgtcactgcaggacagagtgttatctgcgtgcgatagaaagtccttcccgccaccaccgccgggcgcagtggctcacgccgtaatcccagcactttgggaggccgaggtggatggatcacgcagtcaggagatcgagaccatcctggctaacatagtgaaaccccatctctgctaaaaatacaaaaattagcctggcgtggtggcggatgcctgtagtcccagctactcgggaggctgaggcagaagaatggtgtgaacccgggaggtggagcttgcagtgagctgagattgcgccactgcactccagcctgggtgacagagtaagactccatctcaaaaaaggaaagtccttcccaccacccactgtcttgcaggattgcccacattgaatttcccgcattgaatttcatttagttcctgcaatggtgggttataactgatcatgaagtcctaatagtgtgtaaacatgtccatgaaaaagaattgctgagttaaatcaggttgcctgtttcttttcccagtttttccctatgtacttgtttgatgtctgctggttgggttggtggtcagtggtgataaccagcagacaggtaggagcagttgctgagggcttaacactttgcgggagggagtactgagaaactccaccctctggcttagtttgttctagggactgggtgacagcggcattcttcaggcttggtccagtgatcagagagacaatcccgtgggatcttggtgtccctcttgctatgaatgagagaagggtgggggacacacaccaccccacaccaccactgcatacacctaagctggggacaggggccagcaggtcacggggatcaggcattctgctgtagagcaggtcaggtcgggaggcatctgatgaagtgtcctaggaccctcctccctggctcaagttcacacacccgagaggagccaggggcttttccacctgccacccacccaccagaccgtgttcctgacagtgccagttatgtccatgcttacagagttgtgggtgcgtggtttggtggggtgcaggagtaggagctgggaggcactgccttgctgggatggaggaaagacgagctctcgtctcacacaggcacggaggggatggaccgtggttgagtttggaacttaggggtgccccgttcagcccctccattctatagtgtgtatgacttctgggggaagtgcatcttcctttggaagctgtatcaacaggcgacctgcctgtgacagtcacatacgtgaccttgaagagatgtagagctgtctttcttagtctcttctatgtgcctgtgatgtaggaaggagggcggtcgggttatccgtgcacgtgtgtgatggaggaggccacggtgtcacctgtgcatcgaccaactttgctcttattgttttctacaggagacatgggggacaaaggacagaaaggcagtgtgggtcgtcatggaaaaattggtcccattggctctaaaggtatttgcaatgcgattcttgcctcatttcccccctgcccctagggtcagcgtctggataccctgagaataattgtagcctgaattgtctcgtctggtgctcttatttatattcggtgcatggtagataagaaatctactgcagtacttccatttttggggtgcttggagctagttgctggctctgtgcttacagggtgcggtgaagcgctccccattctgcaggattttcacagcgccccaggatggaggggctgcagctagtgtgcttgggcaagactctggctgtgtagccacaatgtccttaacaagtttggtaacagacttagagcctcacgtaaggagcggacgcaccctgctctggaggcacggcatctgttcccccagctcaggtctcaggtatttcgaggtgatgggatggttcttggtgagaacagggtgtgggatggcagcagcgggtgtgggcagcaactatggtgccagcacctgggctcagtctgcacctgcgggttctaattgcaccgtctccgctgctgcatttggctgcacggccgtggtaaggcgggcagatcagctgcgcctcccgtgatgagagactgaggccaggacaggcaaggggttgctcagaaggtgctgctcctatgcgcccccgccccccgccatctggtcagtggacgtctttggagcgcctggcttgttccaggtctatgctgggctctgggggacgaagtcggtgggagggcaaggagctggccgtccctgagctcttcaggtgtggactcatgaagtctccttggggtcccgcacagtgtagcaatgcggctaagctgccctgagcactggcggtggagggagtctgctgtggtctgtccaattcaggggccaggttcttctacctcattcatctgcctcggagcaggttggcccaggtaccaagaggctacggtctggggtttgagctgtgagggggttctcatggtttgttctgatccatggtcacagacctccccctagcccagcctgtacctggtagaaagggctctgtggccaggagagcgatggggaggggcctagctcagctgcgggcctcccctggaaaacccgtgagaggcaccttccctgccacggccaatgcagtgaagagcacgcagagaaccacaggatctggagggaggcgtgggcttcacaaacccaaataacatcatggtaaaatacttatatccccaaacttgccattttaagtattttaagtgtacaattcagggacattgagtacatttgcaatggtgtacagccattaccactatttccaaacccttttcatctctccaaagagagactcttcccactaaccagtggctccccattcctcctcccccagccccggtaacctccaatctacttcctgtctctgaatttgcctattctagatatttcacatatgtggaataacaatgtttgtccttctgtgtctagttgatttcacttggtgtagtgttttcagggttcacctgtgtggtagcgtgggtcagaatcccctgcctttttagggaataatattccaccatatggatggaccacaattattgtccattcacctgtcgatggacacatgggttctttccacctgttgccttttgtgaataacgccacattgcgtattgactcacacatggggatgtgtatacttttaccatgcggtgtgtgctctgggcagattccggcatctcctaaggggcagctggtccaggctggccttgtttggctttgcttatttgatttgcttcgtgtctgagattgtcatcctgggttctggtcaagctgtgctttcatttccaagctcccgatgctgataaaggaacacagaggaatcaggtgggtggagactgcgaaactccttccctccttatgcgaatggaattggaatctactgaagtcttttctcagaggcatttggggcctctctgtgagaataaagagaatgcattagaacttatttctattaagtcacatgacttaattttagagcagctagaaagccctgttgccatcattttgttcaacccccttgttttggacgttgaggagaactgaggggcagggtggtgaggtggcttgtcccatctaactggaggttgggtccaggccaggatggagcccaggctcctggcatctgggccctccaggacaccaggctgctacgagcagggatgggaaggaccttgagccagggcaggaaggagtgcaccgactcttggattagatgagctctcaggcctgcgtggcgctcccatcatgctccgtctggattttcctgctgtcatgagagaggtcgggtgctgctgttgggaggagtggccactcactcatggcaccagggattcatgaggcgatgtctgcagagtgttctatcagatatcctggattttccagaactgatttaaagaatgatcactcgataatccctgtcaccccatgacatgtatatggttcgtatcacataaatagtgccggaagcaggaattacctgcagaatggggctccggtactttgtagcaacaagagggcctgggataaatccgcgagacaaatcacattttcagtcttgatgtttttaacacatagaacatgtccatctctgcctggtgacttggaccttgttttttattttcaggtgagaaaggagattccggtgacataggaccccctggtcctaatggagaaccaggtatggcataaagggtccaaggatttttaataaaatgtattaaaaattgcacttttgaaaacaatgtagatctacaccatgtagatcccacagtggacacccacccctgtcacatcccacagtggacacccacccccgtcacatcccacagtggacacccacccccgtcacatcccacggtggacacccacccccgtcacatcccacggtggacacccacccccgtcacatcccacggtggacacccacccaccatgtagatcccacagtggacacccacccccgtcgcatcccacagcggacacccacccccgtcacatcccacagcggacacccacccccgtcacatcccacggtggacacccacccccgtcacatcccacggtggacacccacccccgtcacatcccacggtggacacccacccaccatgtagatcccacagtggacacccacccccgtcacatcccacagcggacacccacccccgtcacatcccacggcggacacccacccccgtcacatcccacggcggacacccacccccgtcacatcccacggcggacacccacccccgtcacatcccacggcggacacccacccccgtcacatcccacggtggacacccacccaccatgtagaccccacggtggacacccacccaccatgtagaccccacggtggacacccacccaccatgtagaccccacggtggacacccacccaccatgtagaccccacggtggacacccacccaccatgtagaccccacggtggacacccacccaccatgtagaccccacggtggatcccattcggaaggtgctttccgagaaggatctgactcttggataccagggagaaaagagaggggctggatttctgaataaaagtccttgttttaaaagctccttcggcaccgcagagatgaggaggaacggctgcttggaaggtgtgcttgccggtgtgacttggctgagtgtgagtgcgctgagatcagtgtcactgactggccgagcagcatccgctcagggcacctccaggcactcagccaacctgaggggcccggacaaagcctctgggagacagaaggacctggaggcaggtgacggcggggcaaggagaggggacgtcccatcccggggctgagctgctatcgtcaggcctagcttggtcagagtttggaggttaaatgaggaaaggaatccatccacttcccctgacagggatctctccagaaagcctctattacctcaaacctcagccagcttgaagataaaatatatttaacaaattttatcttagataaaacttccattaagaaaacccccaaaaccaaggcaaaccccaagaaagatcgagtttcaaatgtgcaagtgtgagtggagggggggtgtctcacgtatgagggcgaggaaggtggtttgggctctacgtgattgccgacgtccagaaagagggattgaacttctacaggatatgccagactgcagggtgggctgagactctgcccagtggaaactgtgggaaaaggcgtaaagcccacccgcacaccgcagcgatgggggtggatggtgaggtgctgggcaggcccaggctccgatcctggggacaggcagaggctgctgggccacggggagccccggcaccacggaggcgatgaccaggtgtcactcttcacaggaagaaggttagggtccgtccagggactaggaacaaactcgcagccggagggaatcggttggcagaactgggagggcggagtgtagctcagttgattagcgagagaagacttaggacagctgcgtgttctggacaccgtgccgtctgcgaggcatcagagggacttcccgcctagccacaggggcacagatactcgattttggagcccagactgtctgcctgggcccagatctcaggctctccatgccccgtggctctcagtgatgtcagatgtgatgcagggataggagcagcacgcgtgtggtcacaggcgtatgggaacggaatgagctcattgagaatgagatctgttgccagaaaggcctgtgaggtgttccctgttatttcagtgtgggaggtggcttcccaccatggctctgcgtcccacccatgtccctctcatcaggccacttgtgttgctcactcttgtgtgtcaggacagacaccggcttcatccctccctccctatcagctccctttcaccaccgtttcaatatatgcaagcaattcttgtcttaaagcaaaacgactgcaaagccgcagagctcctctctagcggcctcacgtgtgcagctccccagagttctgtaccccgggcccctgtctttccctccacattcctgccgcatcatccagctgggacagcccttgatcgctaggtggtgggtctgagggccgctccagccatcctcccaccagaccatggcagcacctgtcctgtgggcgcggcctgccttcctcacttcctcccaggcctcacccacggcctgcaggtgctcctggtgatgctgctctgtcctccctccctgagccgtccctcacgccctgtgtgtgcccacgatgcccagctctgccctggcccccactccccacctgacatgtcacaggcacctgagtgttggcagattccacctcctttgcccagccagcaatggaatggccccaccacctcttccattcctgacagacgccactgcgcccttcagctcccctcagccctgcagtgcccccaagccatggaggcctgctggccatccccaccatcttcctcagatgttctagcttttctcactgcacgccctcagccagacctgcttccctggttcccaaccctgccctgggctgcttcccacccctgcacctccatttctcttccccctacagctggagaggtttgaaatacatgtgtctgccctccctccactcctgtggaggtccttccctgctccccctgcctttaggatgaagtgggtgatggttattgcggcctcaaaggcccgtggggcacgtttgttgagtaaaatgtgcatttccggggaggggtcctcgcctctcttctgagtccgagtcctcatccagcgtttgtaacgcgtgggcctggcccccgcaggcctcccatgtgagtgcagccagctgcgcaaggccatcggggagatggacaaccaggtctctcagctgaccagcgagctcaagttcatcaagaatggtatgtggctcccggcgccgccctcgctccctcccacctcccagccctgtcctgagccccccggcaagggctctgccgtgcccacgcctgccctgcctgccctgccggcccctgctgcctgtggctgtgccttaagtttgttgcacacatacaagtgctcacttttcaaccctgccttaccccacagctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtcc

SEQ ID NO: 38575 - DNA, 130108 bp, Homo sapiens
gggaccgggcgggccgggcgctgggagctggctgtcccaggagcaggtgagggcggaagggctgtggggggtggagagggtggtctcgggacagttcctctccccggcccgcagttaggagccaggcctggggtcacctttgcccccacctccccgcccaggtggatcctctcctaccgccggtcacccgcgcgccggcacacgggcctggccccagtacttggggtgcgggtccgcgtctgcgtggggtgccaaggggcccgggtcccagcgtggcccaaacgtgagggtaggggctccgcggaggagccaggtgaatgtgggcggaggcctgcggggcggcctgcggaggccgcggggcggcgggaagggcgagcggaggcctggggtcccttgctctgtgcggcgcgggcagccggggacacccgggtgctctggctccctacctgtcacccggcttttggcaggactgcagcccaccaagtcccccagccttcccagcttcccactgggctaaccctcctctcccaaccccccactcagtgctccgggcgccttccctcctcgccagcgctggctgctgtccttagtcgccttcttcccaggaagatcagctctaaccctccccctcgctctcttcctcccccttcctccttctaccaaagggtcctgagccccgtctaccttgcagcactgtgctggggagaggcgccacacagatcaaggggacaaactccctcctcccctcaaggaaagccaggtccagcgcgaaggggagggtgcctgggggtgggttgaggagctgccctagtcctgtccagccttttctcactcaccctcttcaatctcctacccttctccggccctgctccagaagggccccaaaacagcctcctcatggcccctctcccctctgctcagggcgcagctacattcactcaccacctgcagccaggtctagtgcgtcatgatgccctcctcctggagagaggggttcacgaggcacttgagggtgggagaggagtgtgactctgtgtcctcaagggctgggcagcagggcagctggctctgaccctcacgtatttaaggagctcagggaaggagagagctgggagtgcctgaggttctagggcagcaaggtttgagcacaggtgggcactgaaggaccagcgggatctacctgggtaccaaaaaggtaacccggccaagtttccagatgaggtagacaaggtttcttcctcagccagggcctcgcctggtagtttgaacaattctagtagagagaaaggatggacaacaaggggagaggagaggagaagccagcctgaccaaggatgctgttaccttccagagcagtctccctgtccagatcaccaggatccctgcttgctggagaatgacccagatgtcccaggtgcaggagctcttccatgaggcagcccagcaggtaggctcaggatgtgccagggtctgtgatggaggcctgtgagcacggggatccccagacagtgggctggatgcaaacattacagcgcaccctttagatgtaattaactccaaagtctattttggtcatccagttcaatgagaaaatattatagccaaaatattatagccattattaactgttcatatacagaaaacctttggcattatttgtggtggattttgaatcctgggatcccccacaactccaaactccatcctgagaggtcttccacagacagtcacagtgaggactcagataatatgaactcattttaattctgaatcaaaccaatgtaagaaggtaaatttatttctgaaaaaactcttatgttctgaagccaaaaggatttctgaatgccctggtgtttgctatttttttttcttcttttttctttatcttctccctgctgatcattagttacatgcattctgtagatatggaattgaagtggctctacccagaaatggagagctgatcccttaagaaataataataataataaaccatactaaagtgtttatccagaaactatgtgcacccagggtctttgccatccatgatcactcaacatgaagttttcaccatcccttgggtttctttcctgcttctagagagtggcaggagggtttcccagccttgtaacagggggacaagccccatcagaggggagagaatcaacaatgaacaagaaacccagacagaaaatgtgaggcccaggaattcccaaaggagagacaaataagacattctgagatctcccctgtgatggcatctgttcctctctcccctgtttaaaaccttcagtgtctcctcatgtgcaccactcagggctcaaactcttcagcctcagccctatacagtctgaccccacctgagtctcaagtcgagttccccacatcttcttcttcctgccacaccttccagctgaaccacaccattccccagagcttatatctttcccttgatctttgctgatgcttcttatcaacaatttgtcactgaaaccttcacccaagtatttaagtggtatttaagtatttaaattggtatttaagtggacagtaaattttagttgattgatcacatgaacaaacaacagaaaaccacaatgcaagttaaattgtcataagtgccctaagagagagttgatttctaaaatgtgatggatacaatgacctctgtgttgcctccttctcccttaatagctaaacatcgaaggattggacatggcccaatgcccaattttaaggcctttggtgttcatgatttagaaatccatcctttctttctctctccctcccctgcactgtcttgttaaggtaccatttcttgattggatgattcatactctcctaagttctttttccacattgctactaaagtgatgcttttatgaagcatagatctgtgcatttgacccctctgcttaaattccttcaatagcttctcactgccttcagaattcagctcagactcctcatcttggccgccagggccctccgtgatggttaactcaccccttctgttccacagcatcctgtgtcactgcacttaccatgtagcattgaaatgagctgcttcttttctgtctcccttaaagctgtgaacttaaattcaggggcatgtcttatttatttttgtatccccaatacctggcatggtgtgttgtgtatagaagttgccccatcagtgttggttctactgaactgaacttacctggctaggaattgggtgagttgccatttgcattaagtcttaaagtaatggtggaagtggaacatatggtggacttgggaagcatattccaggtgggagggtgagaaaatgataatagctaccaattagtgggcacttactgtatactgagcacttaatatgcattacctcatttatctccactacaacattctgaagttgatatgattattttggtttgacacaagaataactgtagcactgtaaagccaggcatgtttgatgccaagtcccaagctttcatcctttttgctatgtgcctcctgctccaaatggtataagcaaagccacccagatggcaaattaaggacctctgcgtgggaacagagagtaagttaggtggctaaaatgctggaagctgaactctaggagtggctagccctcaagaaatttcctgggaacctttgaacaattttattccagtcttggggatcagaaattctgctaggagctttggggcctgcagaacacaagattaggaggcagtgcccagtgggaagacaggctagtgggtgtcatgccaccttcagtcttgacctgctcttctcttggtcacggtgattagaaagtggctcacaggaagtttggcaagggtggggacacttggaagttaggtggagggtgaatgaatggactcttggtttggctttaatcattttaggaccagatagggtagctctctctctctctctctctctctctctctctctgtgtgtgtgtgtgtgtgtgtgtgtgtgtgtgtgtgtgtgtgtgtagattggtcagtaataagtgaaccagctgggaaggagctgtagatctgagtgttaatggtgtggtggtcgagggtgcatgtgctgcctgggtcaagtcctggctctaatactttgtgaccttgaacaagtttcgtaacctcactaagcctccgtttcctcacctacaaaatgactgcccagtgattgaaactaccatagagaatgaagacaattaaaagagataatttgtgtaaatatttggtatagtgcttggttcctggtcagcattcagcttatattatataaatggctaataattaaactaaggggagtatgtatttaatccagggggtagtggtataaatgagcagaaggatccattggcaaatcaatgcatgactcagcacagctgagtcaggcagaagacataaggcaggagtctcaaacccaaaatcataccttgggccaacaccagaatgtgggacattgttccagacaacctgctgggtgggcagtctattgaggatgatgtgtgctttctaggcctgggtgagtctggagtggtttgggaatgtgagtgtgtgtttggagacccaccgaacttctggcaggccaagccttgttccaggggcctctgtctggaggcactttgtgtgctctggtggtagactcaaacctgggttctgggtttcccattctgactgtgctgctggataggctgggcccttgggcaagttacccacaggctcccagtctatttccacaactatgtgatggggtgagtggacctgattctcagggtttttatgagattaaaggagatgccatatgtggaagggtctgggccagtgcctctctcatgacaagcactaagtaaaatgctcatttgatgattggatgaagccgatcgcacacagaagcccagcggagtaggctgtgaaacttggggcttgaaaactaagaaagaaacagccagtgcagagggaggtgaacagaaggctaatgagccatgattgggtgcttgtctgtgccaggtactggacagacaggactgtgacgatctgggtgtttcaggaagactgcgttggcaggagaaagcaggtagcctgagacaaaaacagatggcaagctgacaagctgtgtggaggtctgaagtcctgcagaatctcatgctcttagcgttgggaatagggagaaaactcggtttcatttaccaggtgtttattgaatgacagttcttgccaggatccccagttcctgctggatatactaaaacaagtacaaaaccaacagcaatctcctagttcttatggaataagaagtgcctccagctagcctgaggcttttgtctttcttctctcagggttggagggtctcaacaggaacttaaaagggaagctggcctgagaataagtcaccaaaaaccaatataactagtacactggattcatgcttttctgcattctgctctaccacagagacttgaagtgtagcactagtgggtccatgtggacccttttctaggaggtctgcaggccaaagtctggctaattattctagaaaaaacccgctgcaggccgtgggagcaggctccccgtcagaaccattgtgactggcccaagcacaggaggaggagtttccaggtcgctgagacctgcctgggttctgactctgctccgtcttcttgtacagcgtcccagctctttcccttctgtgtcctctcctctcttgctctctcatggtttgtatctgtgtccccaccaaatcttatgtttaattgtaattcccagtgttggaggtagggcctggtgggagatgattccatcctgggggtggtttctcaccaatggtttagcaccattccctcgatgctgttctgatagtgagtgagtgagttctcatgaaatctggttgtttaaaagtgtgcagcacctcccaggacctcttgctcctgctctggtgacataagatgcctgcctcgcctttgccttccaccatgattgaaagtttcctgaggcctccctggaagcagaagctgctatgcttcccgtacagcctgtggaaccataagccaattaaacctcttttctttataaattacccagtctcaagtatttctttatagcaatgcacgtacggactaatacacactttttctctgtcttttcctcttcaattagatggcttacctgagttagcttggtgtggtaagatagagcctggtcaagttttggggcaatggtgaatagagaagtggcactggcaagagaggtagatagaaatagaaccaaacaatcaagacatggaggagtcctcagagatcttctggcctagtccatttgcttgtcgtgtcaagaagcaagcccagagacttgagttccagcaatagtgggtccaggaggacgtaaatattgagtgacttgcccagagcaaggttagaaggcagaaccaggttagaagcaaggctactggccccagaacacagccctgagttgaccctgacatatccaattttgagtatgggtgtcaggcttcattgcaaaagcttggctcatattttctgagtgctcattagccagtgtatggttaagaactgacttttatttttactatgcatttttcagggctgttttagcatctttaaaaagctatgtgagcctcagcagccatgtgccaggcaatagcatattgctttattagtagatgtagaaaaatgaatgcagctgaggaggaaggaaaagggaacttcagacaagacagtcttgttagcccctcttttttttctttaagcatatttatatctcttgaagcccctctttttaagatgaggacactggggcccaaatggttgggtggaagagcagggctcaattctgggattcctagagccatgaccccctcactatcccaggtcttgtagggcatgaagcttataccatttttatggactctctagtaaaaaggatacaaattgcaaatagaaaatttggcataatctttggaagggaccaaatgccaaatgatgcgtcctaaggcttaagctgttagcttcaccataaaaccacctctggtcaatggacggaagcaactttaaaggcagcagaagacaagaggcttatgctcctggagctggagagaagtaacagcagatcctgttctcaggattgagatgcggcggaagcatttcatatgcacactgacatcctttcctctttctcctctgtctttccccctttccactttaaagacctgttggttactttgcctgaaaatgacaactgggccccaaatgctgcatatttgtaaaaaatagagtggggacattttctggataaaagtgtcccacctagaaactggagtgaaagtgttcttcactgaaatgagttaggcagggttctgtgactcatttgtacccgccgtattttaacttacagaggtgagaacatgcagaggtcgatgccactgaaagatttctgttacttaccttgcttgagaagagagaatacactatgccacgcagggtcacagggaagcaccagggatgctcagggggctgaagacaggagtgagggtttattggggtttctgcaggagaggaaaggcagggcacggtggacagcttaggactggcagtttgaacaattctagtgggctctgggttataggggtggcctctggttgccgggtgtctggctctgggatgattggggtcaggagaaatcttggcttggtgtgtgagttagatgaggaggtggtctttggtggtatagactcagcattggttgttttgcttaagaaagctgtgttcatggctaagccttttgctctctctgagaattgactaggtctgagagggtcagtctttcctaggccagcaagattttaaaacatttttaagttgatatataataattatacgtatttatgggggtacatatgatattttggtacatatatacaatgtgtaatgatcaaatcagggtaattggggtatccatcacctcaaatatttatcatttctttgtcttaggagcatttcaaatcttctcctctagctattttgaaatatacaataagttattgttgactatagttacccttctttgctatagaacactagaacttactctttttatctaactatgcagttatacccattaaccaacctctcttcatccccccaatccccttcccaccctctgataaccatcattctactatttagctcaatgaagtcaactgttttagctcccacatatggataagaacatgtgatatctgtctttctgttcctggttaatttcacttaacctaatgacctccagttccatccacgttgctgcacatgacaggatttcattcatttttatggctaaatagttttccattgtatacatttaccacattttctttattcattcatctgttgatggacacttaggttgactccttttgctattgcgaatagggctgcaataaacatgggtgtgcaggcatccctttgatatactcatttcctttcctttggataagtacccacagtgggattgctggatcatatggtagttctatttttaatttttaatgagcttccatattgttttctataatgcctgtaataattcacattttcaccaacagtgcacaagggttcccttttctccaaagccccacaaacacttgttattttacattttttggataatagtcattctaacaggtgtgaggtggtatctcattgtggttttgatttgcatttccctgataattagtgctgttgagcattttttcatgtgcctgttggccatctgtgtgtcttcttttgaggaatgtctatttagatgttttgcccactttttaatgggattagtcattttatgctgttgagttgtttgagttccttgtatgttctggatattagtcccttgttgcatgaatatcttgcaaatattttatcccattctacaggttgtcttttcactctactgtttcctttgcagtgcagaaactttttagatcaatatgaccccatttgtctatttttgtttctgttgcctgtgcttttgaaatcttagccataaaaccttttcccaaaccaatgtcccaaagcatgccccctatgttttcttctagcaggtttatagtttgggtgttacatttatgtctttaatccattttgtgttgctttttgtataggttgagagatgggggtctagtttcattcttctgcatgtggatatacagttttcctagtaccatttattgaagagggtgtcctttccccaatatatgtccttggcacctttgttgaaaatcagttggctgtaaatatgtggatttatttccagattctctattctgttcctttggtttatgtgtctgtttctataccaatatcatgctgttttggctaccatggctttgtagtatattttgaagttgggtagtgtgatgctttcagctttgttctttttgctcaggattgctttggctattctggcttattttttgttgttgtttcatacaaattttagggttttttttttctatttatgtgaacaatgtcattggtatttcaatagggattgtattgactctgtagattgctttgcatagtatggccattttaacaatagtaattcttctcactaataattctttttttttttttttttttttgagatgaagtctcgctcttgtcccccaggctagagtgcaatgatgcgatctcagctcactgcaaccttcacctcctgggttcaagcgattctcctgcctcagcctcccaagtagctgggattataggtgcctgccaccacgcttggctaatttttgtgtttttagtagagacggggtttcaccatgttgggcaggctggtctcaaactcctgacctcaggtgatccgcccgccttggcctcccaaagtactgggattacaggcctgagccaccgtgcccggcttctcattaataattctaagcatgggatgtctttccatttgtttgtgtcctctttaatttatttcatcagtgtttcgtagttctcattgtagaggtttttcatgtccttggtcagcaagatttttaagttgtcataacatcattagatacagatttaaaaaaaaaaaaaaaaaaaacatggttaatacattccgcctagctatgaatagagggactaggtaacttcaaaccttcttactgccttaaggtaaatttcatccatggtcagatatagacaaaatactgcatttgccatcatttaatcgtctggggtttgcaaggaaagcctagatgctatggtaatgcctctgaagtactattcttgtaatttgaataaggtgccattaggtggtgcttttactctggccgcctggcctgattgaacaccctggcttcctgtaggggagagtaactgagttttagcttaccttttcattcattttatactttctctggccaaaacacatctcttcagaataacagttaaaacattagatagttctatattcctagaacattatcaattaattgtagtaggattaagagaaatacacatacggctgggcgaggtggctcatgccagtaatcccagcactttgggaggccgaggtgagcagatcacctcaagtcaggagttcgagactagcctggccaccatggtgaaacaccgtctctacaaaaatacaaaaaagtttagctgggtgtggaggcaggtgcctgtaatcccagctactcaggaggctgaggtgggagaatcacttgaacccaggaggcggaggttgcagtgagctgagatcaaacccctgcactccagcctgggtgacagagtgagactccatctcaaaaaaaattaaattaaaaagaaatacacatacttcagtataattcaattcagtatctctttttgctcttcaataattatcaagtataatttaatctaattcctaaattttttctttctgaattttaacaccttaatcaaagggtgggtgcgcttgacgtgaaaagtctttagaggtagtacctatttaagctttgatgcttcttttttttttttttttttttcaatcatggcttactgcagcctcaacctcctgggcctgagtagctgggaccacaggtgcatgccaccatgcctggttattttaaaaatattttgtagaggcagggttttgccattttgcccaggctggtcttgaactcttgggctcaagcaatcctcccatgggcctcccaaagtactgggattacaggtatcagccacctcacccggctttgatgcatttctaatacaataatgctttaacatttaccactgcttgggagaaaggtcctatttacattccttttgttttttgtttttagagacagggtctcactctgttgcccaggttggagtgcagtgatgtgatcatagctcactgcagccttaaactcctgggactcaagggatcctcccacctcagcctcccaagtagctaggaccacagcacatgccaccatgtctggcaaatttttaaattttttgtagagatggggtctcactatgtttcccaggctggtgatgaactccttgcctggcctcaagtgatcttcccgcctcagcctctgaaagcactgggattacaaatgtgagccaccgtgtccagcctgtttgtttttgatttgttgtgtgaatgtcttcttccccacacgaacagtcagaaagaaagaaaaaagggtagtgtggtaaaaaccactcacctgtgtaaaaattctagcatgttcttttcccagtttgcagatatccggtaaatcacatccatggtcactgtccctggttacaggctttaggagcttactgattaacttgaggcaatggtggctgagcaaccctcactaagccaaaaatagttgcgttcctgctctaccatgagtctccgtgttcatagaattcaacttaaaaccgaaagccatgactccttttgagtcactttcctttttaattttaggtagttattagtaaagaataacacaaagcaaaaacaaatttaaaaacttagagatacacaaagaattttgaggtagacattgattttacaaaaggattcaccatctttaagtattccatgtattcaatacattttaaaatgtgattgaaatcacaggaatcttttggtgaattcatccactgaataaaatgacatatagccataaatggtatccctaatgccaggtcagccaaaaaacccattctgtttttaaaatatttctaataatgtggtaattttttctttaaacataaaataagttagttcttgttgttgttgttgtttttctttgagacagagtctcgctctgttcccagctggagtacagtggcacgatcatggctcactggagccttaacctcccaggctcagatgatcctccctcctcagcctcctaaatagctaggaccacaagggcacaccaccatgcccagcttattttttgtatttttagtagagacggggtttcgccatgttcccaggctggtctcaaactcctggactcaagcgatccgcctgcctgggcctcccaaagtgctgggattactggtgtgagccactgtggctggtctagggtttttatcatagaagtactacatgcatgaagtgagaaggattcacacaatacagcatgacatgaaatgaaaagccttccttccctcttccttcacttctattccccagtggcagtcattgctaatggcttctggttttcatgtcttctaattgttctcactgtaactttaaataatattcttatacctcagtttcttaggttaccaatttgttatcattttacttcctgtttcccatatgaaaaataggacgttggcacacatacacttccttccatttctctcatttcatttccattttttaatagttgctttattatttttacattgtcaaggtttataccatttttttctggaactgtattttcatgtttattatagttggttataaaaatgtattttattttatttttttttgagaccaggtcttgctctgtcacccaggctggagtgcagtggcgtgagcatagttcattgtagcctcgaactcctgggctcaagcgatcctcccacctcagccttccaagtagctgggactacaggcatgtgccaccacacctggcctttttttttttttccttcttctagagaaggggtttgattatgttgcccaggctggtctcaaactcctggcttcaagtggccctcctgccttggcttcctaaagtgttggaattacaggcataagccactgccccaggcctaccatcttaactatttttatgtgtacagttcaatggtattaaatacattcataatgttttgcaacctatttatttatttgacaaaattttacacttacagaaaagttgtaataatacaataaaaaaccccacatactcttgactcagtcgattcagattgaccacttgttaacactttgcctttttgctttatcattagaccattttctctatatatatgtatatattttctctaaaccatataaaaacaatttgcagacatcatgtccttttatccataaatatttcagtgtctatttcctaagaacaagaatgtttttttacctaaccacagtatctttttcaggatcaggacatttaacatagaaaaatcctattgtcagccgggcatggtggctcacgcctataatcccagcactttgggaggccaaggagggtggatcacgaggtcaggagatcgagaccatcctggctaacacggtgaaaccccatctctactaaaaattcaaaaaaattagccgggcgtggtggcgggtgcctgtagtctcagctactggggaggctgaggcaggggaatggcatgaactcgagaggtggagcttgcagtgagccgagatcacgccactgcactccagcctgggtgatagagcgagactccatctcaaaaaaaaaaaaaaatcctattgtctaatctgtagctctacattaaaattttaccagttatcccactaacatcccccagcttctccccaagacctccttccaggatccaatccaggatcatacatgacccttagttgtgatttctctcgttttattttatttgagacagagtttcactattctcccccaggctggagttcagtggtgagatctcggctcactgcaccctctgcctcccaggttcaagcgatgcttctgcctcagcctcccgagtagctgggattacaggcatccgccaccacacccagctaatttttgtatttttagtagaggtggggtttcaccatattggccaggctggtttcgaactcctgacctcaggtgatcacccacctcagcctcccaaagtgctgggattataggcctgagccactgcacctggccagttgtgacaatctctttagtctcttttaatctggaatagtcccttggcctttctttgtcttttatgaccttgactgttttgtttttttttttttaaagaacacatgttggttattttgtagaatgtcctcaggttttcttatttttgtttttttgtattttataggcagaattggggatgatgtccctcagtttggggcatgacctgtcacaggtagatttaggttttctatttttggcaggaacaccatagcagtgatgcagtacttttcccaggacatcatagtaggagctacataatttccatttgtcccattattggtgatgttaactttggctatttatttaaggtggtgtccactaggttaatcccctctaaagttactaatttctcttttttgttaataagtaatttgtagatgctttgagactatagaaataccctcttcctcattaatccctcactcactagcattagcatccattgatgattcttggcagagctggctattgctgtgatggctgcaaaatggtgattttctaaccccataattccttccacatggatcatttggttttccactgtaaggaagggctttctcttcttgctcccacacaggagtgatacccttgacagagccacatcagtataaaaggggatatatttggcactacagcaattccagttgctcttccagccctcagcctccaggtccactcagtgacaatgagcagaaatagatatattatgattagtcatggccaggtggggtggctcacacctgtaatcccagcactctgcagggctgagacaggaggatcacttgagcccaggagtttgagaccagcctgggcaacagcgcaaaactctgtctctacaaaacatacaaaaattagctgggcatggtgatgcatacctgtaatcccagatactcaggaagcttaggcaggaggattgcttcagcctggaaagttgaggctgcagtgagccgtgatcatgccactgtactccagcctgggtgacagagcaagaccctgtctcaaagaaaaaaatcggttaattaatttatttatgtctgtatggactcagattcttattctattccttgaatattctattgctattatttactttcagggccaaattgtgccagatttggctagtgggagccccttcaagtggctcttgtgtccttttgacacatccttgtcatttttttctttttagcacttccctactttctggtacaagatattccagactcattttgtacgttctctgccctagccttgaattagcaacttctgcaaggagccctggttccttaaagtgaagaatgatatttagaaatcaagatctgggtgctaggtatgttcattgccactgggatgtcttggcttatagtcactttttttgtttgtttgagacaaggtctcctttgtagcccaggctggaatgcagcagcatgatcgtagctcactgtgaccttgaattcctaggctcaagcaatcctcttgcctcagcctcctatgtagctaggactacaggcatgcaccaccacacctggctactttttctattttttgtagaggtgtggtctcattatgttgctcaggctggtcttaaacacctggcctcaagcaattatccagcttctgtctcccaaagtgctgggattacaggtgtgagccactgtgcctggccttatagacactttaagtgggcagagggaaagaatgtaaatataaatatgtacagtgatctatctaggtctctatatattaaaaaccataaattcatactaatacgtctaactccaattcctcagtatgggggttattcttctcttatttccttagttggaattccttctccaactgtgagaaacttgactcttattcaatatattttgttatttgcttataattcacagaaagcagatttagaattggtaattcatactcctacaaatacccaaattttctatctggcatttaatattaattgcagttatttttgttttcgaatgtgatacatagtcaaagtactgtgttcataagttactctggttagttctttttccgctttaagtatggttacgtcattcatttgaaatacagctaggataatttgtttctctttgcattctatttagatttttaactttcatctttgttgatttaattgtatttgattttgagtatatgtaaaatattaacatgattccaaaaattttaactatatgaatgggtctactcactacataagaattcttaaatggatagaatagtggctgatccactgaagcacctggaatgataacctttttgcagctgatgtttcactggttcgcctgttattagggggagggcattagggtctattttgctcctccttgtgttaaatccaggtagacttcctagcggcagcctgtgtccagcaggaaaagctctgcccttttgctaaggaggttgggaagggcagaggaagcccttgtttaggtggccttgacatggctgctgtggggttttgtcatttgccagacgacatcagatttccagagctcatctctgggctctgagttttgaggctgctgtgtggtcctgggaggcagaacttcggcatcaaagttttcacagcctctgatggtcttgccactctgcgggctgagccatgtgtgaccaggtcatgcccttgtgagaatcccagccttgaacaagtgtgaagatgcacagatatggagaaaaaaaaaaaacaacagattgagtctgtgggaatgactagatttcaaccccagctttcataccagctctgtggtagaagagactgacacagccacgaagacctcacatttctaggaatgactaaatctatacagaccaagggtgctgcccagatcctaacccagggaaatcagactttgacggctccaattggatccttgcttccttggctacagagccatttccatttccagcatcagtcacatggggcagcactcaatggaggtccattctggaactcccactacaaaacagaagggatgggctctctcttactcagaatgcctgggctgggcaggggttagagatgcagctttcagggctgagctgtagagcaaggattccactttaaacatgaagacaagttagctggggaaagcagcaaatgcagtcaaaagacttctttgtcttccttccaacttccctgaagaaatcctcatgtatatttaaaatcctctgttgtgttttgtgtttacacaaactttcacaactatcatctcatctaaactttacaaaacccccctgaggcaggcatgtagctgcacatgtggactgtggcccatggaacccacagccatgctggcgcccggcccagctctcaacccctgtggtccagcacatggggccggttcagaggcaggggaaaggaatgaggctcctcagtctgcccattggactgcagttcagcagcagcttgggtatattctctgatgtttaattaataatccaatattaactttcagaaagccatctgctggttcgcatgtgtatgtaatccaggtggaaccagtctctgcaggtgcactttgggagaaaggggcaggctgggtcttgcttccacctacacccctgacctgaatggacagaagcagaatttctcacctgattgcttttcctccagctcccagaaaggagaaaaggtgtcatctgacattgcagatgcattcatgaagacttagctggtgactgtttgaggcaaaaggcttctggggctgagctcatgtcattgcctctggcagaactttccagcctcttactcagctctgcttgctggatgcaggattgagagtatttcctactcaggtgcaacttccccacctttctagacaaccccctacccccaccaatctgccccccacctcgctcaagtatggagattattcacaggagaacgacttccccttctgaactaaaaacacccaccaggcagtcatggtttttccagcatggggcgcaggcccctgggctcagagggacaggagtctggcttcttgtcctgggggcttgggaaggaagaccctagcaatgaggagcatggcagagggatcatcctgggccaggcgccaagtcgccgcacccctggaacctgtcaagctggcccctgccaggctgagggtcttcagggaggagaggactcttgccctcaggcatgttttatgctgccctttctgagggattgatttgccccttgcttttcttatccccctcatcctctatctctactttgctgtagactcaatcctgggtgtagggtacattccttttccccagcccattatgtctatgtaataggatgttgaatgggattcatgttatgctggaattgaggactggggcccaaatctgggacactaggtcctaaagagagctacccatggttgggaccagacctctctcctggtgtttaacaagagagcctggaactggcctaagcttcagcaaccatcaccccagcgcttccaccccctcctcccctgggcaacagaaatgactgggtggtggcactcagagaatcttagcgtggactttgtgggagggcctatttgggttgaggggttccttccttctgcctcaggggaaggaattggggatgcagactcaggagaatccagtactttgtgtgtatgtggacgggagctgacattctgtcctcatgttacatgtctgcccgtactgcagaccgtggtcctgcccctcagcctgtcagagcaggagctgaagagaacgggagagcacgcaggacagagcaagagctctcacgacgcaagggagctgctttgagttctccagccagtcctctcccaagaggcgagctctgggcactagctaaagtctgaatggcatcacaaatgtggcgagcctggacaagggatctgtgagaagagcggggacacacaagctgctacttctttttttttgagacagggtctcactctatcacccagcctggagtgcagtggtgcaatctcggctcactgcaacctcagcctcccaggttcaagtgattctcatgcctcagcctcccgagtagctgggactacaggcacacacaaccacacccggctaatttttgtattttttagcagagacagggtttcgccatgttaacgaggctggtctcaaacccctgacctcaagtgatccacccacctcagcctccaaaagtgctgggattacaggcatgagccactgcgcccagccccaagctgctatttctacatggatgcctgggaggcagcgtggcatctgggaaatatccctcgggggctttatttggcattttattctggggctttccatctcatcctcttcccctttctctctgttttggtttcgtccttttccttctttctctgtctcttgctgggcttatgtagtgtctctctctttctccaagaacatcagggttactcccttggagtcaaacctacgctcttcccacccagtctccgatgagcagactgtgggaagactgagttatagttttttgtcatgtggtgagaaaaggtaggtacacacccctcaatatcctgaaacaagctgccagggctcagtcaccaaacccattttaaaccagttatattttcattctcagggtaaagggtttcctgaagtttctacctgctctaagtttctacccttgaggctgattgactagtccagtgagatcaaggaaatgaaaggcatttcacacaccagcaggtaaacaaacgcatatgcaaaccagccttcagaatgggaaaatgaaggcacgcgtgaaagaggaataaggtttctgtcatcacaaaggcattcatgggtaaggcagatgtattcgcagttatgcaaagtccagagtgttagaatttgaaacctgaaagacttaaatttaggggcaaaaagggcaagtaatgtttaggtgagtgtggggcagggaaaagcacagatcttacaagtgctgggggaagccctggctgtgagactgggccgtcaggtttcttctctcagcctccatctcctcagccctcagtggggccccctcccggcctgcctcacggggctgccgtgaggagcagagcagagagctcctgtggaagctgatggcactctctacagtattagtctttttgttgctgagagtcactgttattactgaggaacagtcggcctgtagcaagccacgataggaagtggaacacaagcagagacaggaagttgggacccatcctgaatttcgagatgaggatcctgggaaacactcctgcattccccagacaggtcctttggtaccatttgctcaaggacaagcctagattggcagagtctttgttccgaaccacgaggactgttctgacaattattgactttcaggagattgctcatttgtggtttgtgaaggacaggcaagcagtcatgtacatgcataaatgaagcttacggagttggagactgacggagacacaaggggtcccctggcccatcagtcccatgtggctgaattgagatccctgagtatttctcgaggccccttcttgatctgtggatgtctgatacaggaggtggaagaggagctgggatcctcccttttggttttgagcacatgccgttggccttagcctttggttctagatcctgggcgcacccattgttctcagccattcaggagccatgccccgtggactctggatcttggatttttccctaaactcttgatttttctgcctttttattgtgtttatggataacatttgctcaccaggtccagattcattgcacacagtgactcctagctttggatgcctctctctccccacccaccccacccagctgagaaccgtaatcactgctgtagtcgtttgtggtcactggaagactctgttcatgcctgagtttagattaattgccaaacctacataagagcattcacagtgtgagttactactggttttgtttaagatcattttagtatatccacgaagttatggtttttttagtaaagggtttccatttgagtgtttataagtgcctttgttatttgtgaattggaaaaatgagcaaggaatctgttttttcattattcgcctctgattccaaacaattgtccagtaatgctgaagaatcctggggtatcagcagagatcactgtattagtgctcagtaaggaaaacagaaataacttcagtcattttaaacagggaatctcatccacagggctgattgcagaggtgttagaagggctgaaggagcaaagagcgcttcagtaaggttggccaaatgtcaactgccggaagctgctgtccctgctaggactggaggatgaagagggctcatgaccatgagccccaggaggtgaaacccagaatctcacactcacttagaagtgtcatctattgcttctgcctgcattccatgggctagaactcagtcacacagccacttctagctgcaaagaggctgggagtctacctgactccctgactacttgagtgatgaccagaggaaaaggactacgtttgtgaataatgagtctctgctacatatggatacggaatcactgttgttacaagagaacagtgatccttttgtagaggtatgcttcaagatgtgtgtgtgcgcatgtgtgtgtatgtgcatgcatgtgtgtatacacacacacttgccctggcacaataagacaggactgtttttaagctgagttctcctacctccctcctcctgttccactctcatgccatccctggccctcccaatggcccctcagctgatttctgtgtgttctgtttgcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtggtgagtgctgagttggtggcctggagcctctcacgggcccaagacaggaaagctctgccactcttgcattctacagtgcaggccacagattcctgaagcacagatgctcctgaaacacgaaacagaagcaagcacgatgaatagctagcattgcttgttaaatgagcatcctgtgaagataggcttccgaatttctaatggaaacctcacaccatagatttaactgcagaataggagcacagaagtcagggctcatcatgagccggacttgagatgggtcagagagatcagattgatggcaattttgcctccagcttgtggccctctgtagttttcccggtattcttcacttcatcttgggcccgcccacatggttgccttcccccaccacactgcaaccctgtaggtaagactgtgcatggggatgcttggtcagaggtgtgggccgcctacctctagggatggattgcctaggatggactctgctgtgtgagatcctgggggtcagttcatctccccctgtagaaggaacaaaaggcctcttctttaattcttatgcaaagcatcctaggaccttccaagcagatgtgtgcctggggcaggggttctcagtcccacacacagtgccatctcatgcagtgggacttcagtagaccacacaggtgcgcagaacaaaaggcaagccagtcaccatctaaacatggatgagcacctgctgtgggccaagcactacttagtgccagtgggatcacaaaagacaagacatggcctgggccctcatcccctcctctcttccccgccccgccctatgagctaacagctgtggtgggtagatattgcattaggagagttctgaaaacagcattaagtcccttggggtggaacaggctatgagtgctgcagtcactgaggtgtcaggaagccttcctggaggagatgcagttgagccaggctttgaagggtgagctggactagatgggtgaaagagaggaggccattcaaggtgtagaatctactagtcaggattctccagagaaacaggccaatgccaacaggagatgtaagtatgtcatgtatatattagcaggtaaggattgatgctgcagtcttgagtctgaaggctggaaatgcaggaagaatttctgtattgcagcctggaggcagaattccttcctctttgggaaaccagcctttgcttgtaaggccttcaactgattagacgaggcccacccatactatggagggtaatctcctttacttaaggtcaactgatagtaaatattaatcacatctgaaaatcacctttacagcaacatttagactagtgtttgactaaacaattagttgccgtagtctagccaagttgacatataaaattaaccattacataggcaaatttggggagatttaagctcctttatagtgggatgtacaggattcttagcccccataagaagtctgggcaagaccagaccttcctaagctctcattctacaccacactcagatcctcagctcaggtttcggccttagccacagccagggtgggtctcagaccagcagtggagcccttgagcattatattataaacactggaacagagtacaactgacttccaggacaattttccagctcatgttaggccactcagctcttgaactggctctgcccactcctaggaccctctccagcactcacaacacatgaagtcttgactatcaggagtcttccttgctttctattgcaaaacatgtgacattacatctccttcttagaagtgctgtgtccactgcctctctgcgactcttgcttttcacactgaaatgtgtctgtctacatgtgttcatctccagccatgcatggtttgtttattcgctcaacaagcatttaatgaacacctattttgtggaggttatgctaagcactgagaatatgaaggggaagaaaacatgatcctgctccgtattagtccatgttacattgctataaaggaatacctgaggctaatttatgaagaaaagaggtttatttagctcacagttctgcaggctgtacaagaagcatggcaccagcatctgcacttggtgaggcctcagcaagctttcactcatgggggaaggtgaagagggagcagcgtgccacgtagccggagagaaggcaagagagatgccaggctcttttaaacaaccagctctcctgtgaacgaacagagtgagaactcacccattactgtgggaggacaccaagccattcacgaggggtccacccccatgacccaaacacctcccaccaggccccacctccaacattggggatcacatttcgacatgagatttggaagggatccaaatccaaacatctaaaccatatcatcctcccctggagctcacagcctagaggtcaaaactggcttggaaacagactcaatatgacaagtcctgtgaaaagtactaagccctggcactggaggagcccagagaaagggttacagggccagcttcctggtgagaaatcctaaacgttgaggcctaaaggatatgctggagttaacctgacaaaggtacagaatgagcaggagaggccttccaggcaggggaatcagcatgaggaggggtgggggtggggagagaacttgtcgctgcacgtcaggcacaaagtgagattaggaggcacctcgtgagggcatcagcagctctgactgtaccctataggtgggagagtcattgaagaatttgcagccaggacgcttcctttcacttagaacttcttcctggccttggctgttgtggtgcttgctttgtcctttttagttgtcctgactctgtgcccccacccctggcccctattccagtgctgtgggaggaggggaggtggtcaatgcccccagcagggagctggcggggcctcctcacctaatccaaccttgctccttgctattctgctgcagggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacaggtgaggcctgcgcccgggatgcttcccctgcctggccctctgccactttcttcttgtccatttcctcacttgacctggggagaagcgagggtggggacaattgccgcatgtgacagacgagcaggttggggctctgaagggaattcagcagagagtcaagtcactatccagggcctgacctcttagtccagcactcctttccctctgccactcccgcctcctggatgcctgatgtgaccagcagggcagggcctggccagcacattcttgctgttcaatctggggaccagattgcatgacagtggctgaagcccaggtggcagccaggtggcagccaggtggcctgggccctgggacgcttttttactgaagatgggtattttgcctgtgccaaagggctttcctagaagcaggcacttctcaaatgagcaggagctcccgggagcatttgatagctcgggtggccttcacagggaggctgacagcctcttgtgtggacgccctgtctgagagggagaatgttaatgaggagtgtgcttcatcagaatggacggaggcactccgaaaacgagcgagtagggggaaatcctaaggcttttttagctaaaacacaggcatggtgacttaatgctgagggaacaaagtacagacattaagaagcagttctttgtcagcatttcttggattgaaaaaggcttttatgagagtgcaaatggtggtgggtggttgaaaaaacagtttaaagagaagaatttgtctaagttagagtgtgcaagaatctccccagagaaagcatcggttttgtttcttttatttttaggcagcaggagcagggtgtttcagcataaatatatctgattctcgaacagcacagagctgcgtgtgtgcatgtgtgggcggtgggggtgcctgtgtgtgtctaagacagtgcaggaaaggcaaacagatggcctctgcactcttaaaaagcacttgccttgactgcagaaagttatttaagtatagtagttggagaggggagtaataaatggtcagtttactttattaccctggggacttggtatataaattttttttttttttttacttctctgctattttatagccaaccaggctgcaaggtaggcaaaatcctgctttccccctctcggtacagacaccaagtgagcctctagaggcagatgccatggatgggcactggtgtgaacacccctggacaaagacaggcatctgtgctgctgagagtcccacttacatgggctgatttggaaaaaagatgttcacagataagatgttttctaagtgctggcagccacggcctgagacgccactgcaccagcatcccagctattttcctgcctttccacttgggccctggtcccaaacattagagtccccctggtcactgtctctggagtgcctgtgctttgtttgtcgctggcgcgggccaggagtccctgatcagggtgtggttagtgtgtaatcctttttataaattgctgaatttggtttgttaacattttgtggaggatttttgtgtatatattcatgagggatattggtctgtagtttccttgtgattctttgtctggttttggtgtcaggctaattctggcctcgtagactgagttggaaggtgttccctccttctctattttttggaggagtttgtgaagggttggtgttaattctttaaacatatggtagaattttgccatgaagccatctggtcctgggttttttttgatagaaagttttttggttactaatggaatctctttacttatataggcatattctgattttctacttcttcttgatttagttttgatagtttatatcttcctaggaatttgtccatttctttttttttttttaatctgggaattttgttttgttttttgttttttgtttttgagacgccgttttgctcttgtttcccaggctggtgtgcaatggcgtgatctcggctcaccacaatctccacctcctgggttcaagcaattctcctgcctcagcctcccgagtagctggggttacaggcatgcgccaccacacccggctaactttgtatttttagtagagatggggtttctccatgttggtcaggctagttttgaactcccgacctgaggtgatccgcccgcctcggcctcccaaagtgctgggattacaggcgtaagccactgtgctcggccatgaatttgtccacttcacgtaggttatctaatgcatcggcatattaattgtctatagattttcttatagtcctttttatttgtgtaagtttggtggtaatgtctcccctttcattcctaatttaaataatgtcttctctttcttttttcttgatcagcttagataaaggtgtgtttacaaagaactaattattggttttggtgattttctctattgtttttctgatccctaattcatttctgctctgacctttattgattccttcttctgcttgcttgggttcactttgctcatctttccctagtttcttaaggtgacaggttgggttattgatttgagctcctccttcctctagggtgcggttggggttttgaggctccctattccttgttcttattaactccctcagccctcattccagggcatgtgtgcattcatttatttctaatgattgtcaaaacagattccctgattttacccccaagcaggggtcagcaaacttctataaagggccagatcataaatattttgggttttgagggtcatatggctctgtcacaactactcaaccctgccactgtagtgtgaatgcagccacagataaatggcttacaaaaaacgggtatagttgtgtcccaataaaactttatttaccaaaataatcagcaaaaaggatttggccagtgagccagtttgtcaatcccttccctagagcatcaaaactgaggagatattaacacttaaagtaatgattttaaaagcttgcaggtcgggcgtggttgctcacgcctgtaatcccagcactttgggaggtcaaggcaggtggatcacctgaggtcaggagttcgagaccagcttgaccaacatagtgaaaccctgtctctactaaatacaaaaattagccaggcgtggtggcgcacgtctgtaatcccagctgcttgggaggctgaggcaggagaattgcttgaacctgggaggcagaggttgcagttagctgagaatgcgccactgcactccagcctgggtgacagagcgatactccatttcaaaataataataataataataataaaaagtaaaacaaaagcttgcaaaggctcgtcattgccctgcatcctacaaaacccttcccccttcatccctctcaggccttggtggcagggcctgctctgtgggaccaaactctttgtcaggggaggagacgatggactacagactcccctcactccctgctccacttacctgtgtgggcctgagggttcttggtgactgtttaccctgaacaccaaaatgtctagcttcagcctgtgctgacacgtggaagaacgttcattagtggctcacatgctttgtgctggactctgtataaaaacaatgaatgactggaaagtttttatggacctgatataggcctggagtttttgttatgggtgttaacgcatattcaggacatatgtgttaatccaccaactctttaaccttaaacctggaagtttgtgtcagaaggggaggggtgttgaggggcagcgctggtcctccaggtaaggtggaaggaaaatgcctgtgattgtcaaggtgcaattttgctaaaagaattaccttggaatggaagcattacaccctgaaaataggccaccttctctctttaaaatggtgagcaacacccactgtgtcttgtgagaaggaattaggcttttctctgtggagaatgaaaaagaaaaggaatgcctggtctaagatttaggaggaaatagaatacgtttaacgtataacaaacccttaagacatttacacattaaacaaaccaccaggaatgttttccaaggaaaagcagcattcaggttggaaggggtaccgcctctggggtggctggattgctctagggaaggctgggcagttgctgagtgtgtggacgaaggccttgagtcctgggctgcttccctaaacctgggcagacagggtgatgatataccctgatttagtttttgcgtaaacataagggtacttttaatatgtttgcttgtattttttaataaaattctttgacagttacataatgatattcattgtagtcagttaacacattggagacaatgaaaataaagagctttcccccacacccttgaggtgatcccagtgttctcttttggaacatttccctcggcttatacacatgtatttatggatttttgaagtgcttgcttgtttttacaaaaatggggacaaggccaaggccaggcgcggtggctcacgcctgtaatcccagaactttgggaggccaaggcgggtggatcatgaggtcaggagttcgagaccagcctgaccgatatggtgaaaccctgtccctactaaaaatacaaaaaattaaccaggcgtggtgatgcacacctgtagtcccggctactcgggagtctgaggcaggagaatcacttgaacccaggaggcagaggttgcagtgaactgagatcacgccgctgcactatagcctaggcgacagagcaagactctgtctcaaaaaaaaaaaaaaaatggggacaaatttcatacattattccatggcttgtagttctcactttaagtaatagatatatctcttggtcaatgttttaaaccaatgctttttaaatggttacttaatatcgtatagtataaatataccataatttatggctcatttctattctccattcattctttttttaattttttttgagacagggtctcagtctgttgcctagggtggagtgcagtgacgccatcacagctcactgcagcctggcactcctgggctccagtgatcctcccacctcagcctcccaagtaggtgagactacaggcgtgcaccactatgctcagctaatttttaaattatttttgtagagacaaagttttgacatgttacccaggctggtcttgaacttctgggcttaagcaatcctcccactttggtgtcccaaagtgctgggattataggcgtaaaccactgcacccggcacccagccttgtatttttttgtagagacaaggttttgccatgttgcccaggctggtcttgaactcctggactcaagtgatcctctcaccttggtctcccaaagtgcagagattacaggcatgagccactgggcctggccctctattcattctttactctcctctgtatatgtagtttttttcctaatagtctatatttttgcattttctcttttctttgtaatcaggctaccagaggcttatctatttaatttttttttaaaagatcagcttttgtttcttgtatttttcttttgttattttttcttctatttcattaatttcatatttctttatataaaatacttctctctattatctttttatttatgttgatatttttgtgactgaagttaattcttcgttcctttatttttcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctatttttctttttaactaataaaatcatttaagactatacatttttctcttctgaacccaagtttagttatgcctcttgagtttttgaataaaacattctcgttttcattactttgtaaaaaatataaaattttatttttcatttcttttgactttggcaacatgtgtcagttatttttctattgcattttggttgatttggaagttctactatgcttttagttcttctagtagtgacagtctaccctcagaagtcataattaaacttatccttttctatcataattttctacacttctcaaccaagacacattatttactagctcctctaccaacaaaatattaaacttctatgatacatttactttcctactctccataaacacccccacttctacccccagactcattgtgagaagacggtttaattttggactgttaattgctttccttaaagtaagtctctttggtttcaagcatccttatttacaacttatattgcaaatttccagtgatggtaccatcatctatttagcatcaacaaagtatcttatgatattcatagctagctactgtttcctcttcttcagcagcgaataataacaaagtcataataatgacggtagctattattattattattattttctgcccaggctggagtgcggtggcgtgatctcagctcactgcaacctctgtctcccgggttcaagggattttcctgcctcagcctctcaagcagctgggactacaggtgcacaccaccgtgcctggcttatttttatttttagtagagatggagtttcaccatgttgcccaggctagtctcagacttctggccttaagtgatctgctctccttggcctcccaaagtgctgggattacaggtggtagctattgtttctacaactctatgagccagatattgttctaggtctttacataaatcatctcatttagttctcacagtaaccttttgaaggttactatcattatctgtatttcacggaggggttaaaacactttcccaagtcagccaggatttggccttagatattttggcttcgcaattcatgctcctaaccaccatgcccttacaagcctcctgaggagcttcccccaccccctaccctgccccatcccctgttgctggcatctttgggctaaaaagcaattttagatacaaaccagaaggatgagatccactggagttactgggaacaaaaggcagcatttacagcttggctcacattgcgtgagcaaattgttctactgctaggaaaaaaaaaacagtttggaagctttggatgcagatggtcccatggcatcatcctctgcatgtcagagacatcaggtacctgggaaagtggtgcccatataaatggtatccattgctacatttttgtcatttattttatttacttttattttgctcagataattttgaccatgaagagtcctgttgacctggccaaatactgatgaaataacgtcactatcacacatcacactcttggtgtttagtaaagaggaagtttgagttctgagatgaatgcaggaaaacattagtctctctgtctttctctttctctctctctctctctctctctctctcagaaatgattgtatttccctcacatttcttgggctttccacctcatcctaatatggacagaaatgtttaccactatgggatgctggaataactgttaagctaagtgtaaatttgggggatgctgacaaacatgatatgtgcctagttgcaaagtgagctgatctcattgaagaatggggccttgttcacaagctcctttcaaatccagaagttgtattacccttttgcctttacacaaaatggctggaactcatggagcctgcttcccagagcaccttttatatgatcagcatatcacaaagtatttattgaatgcttgcaacatacttagcaaatgcaagtatttgaagaggtacaatcagcataaacaattttttaagatatttgcattcttggtggtggggtggggagacaaacttacgttcatgacatgataatagaatatggaaccagataattaattgtatggccttagcagttagcttactatttattcagaaaaagaggttgaggagaggcctcatggaaaaggagggacttgaacgaatgaggccctaatagaatttgttcccagagaatggcaagggcagggctacagtgattagagtgaccagctggccctgggggcagtgaaggacaaacctgaggagagaagaaggctgaggctgaggaattaggaaaagtgagactgatgttattttcaacaatttaatttgaaatgatctttcaaatatttcccaaaagataaaatcatgattctcaggcaaatataagaaaaacatgtgccaaggatttcatttcatttttttaaaaaaagattatataacaaatactcataggaagcctaacctggagcagggattttatttaatttatgaattaatggaggagccagtaagatgttaaagagcatctgcaaaggatgctgggtggacagaggtcagattagtaaattcataactaggcagttgaataaataaatgttaggataagattgctgggttagatagaaaatcagttaatgtcttacaggacaacaaatcctaatcttttgggttatatgttccactggacagaagttatttgcatctgtactggaaaaaaatccataaggtaacatgtaactttattaaatctggggcatataatgcatttaatcaacagcaaatagtgagtaaaatgaagtacattcacctagatagtccttgggtagcctttgccacatatgacgttgaaaaagacgtgccactcacttttttttttgctaagttttagataattttaaaaataatactgacctatagagaaatgaagaaaaatctggtttactgcagtgtccttttaaggctctgtagatgggaccccctgtgtgttcttgttctatatttagttcttgaataactcggactgagaaatccggaggcctctttagcccagtgtcccatcttcttcctcccatagtcttttcatctttgttatcactgacagccagctctcagcttgggttcctccttcattctttagttgagatgtagacaagtagaaatggggcctgaggcaggttcacgggtgggaagggctggtttaaccctgcactggtcccaggcactgtgccttggtgccagtgagtgtgtccgatgggggtgcagggttctcagcgctgggcggttctgcccatgggcccatggctttctgtcctgctgactcttctacctggaatcgcatgtcagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccaggtaagcctttcagagtccagtatgtggccttatggatcttcactgctttagagatgtttgtaggtgtgagtttgcccaccccatctccccctaacccccataggctttacctacaattggtgtgagctgttcctggatcaggtgagcaggtgtgtcttggagcagcttcatgaggctagaagctcctcttcacacagacatcgcctagcacattttctatgtgtccttttattttctttttttaatgtatatttatttatttattattattatactttaagttttaggataacatgtgcacaacatgcaggtttgttacatatgtgtacatgtgccatgttggtgtgctgctcccattaactcgtcatttacattaggtatatctcctaatgcaatcctcccccctccccccaccccacaacagtccctggtgtgtgatgttccccttcctgtgtccatttgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtatttcatggtgtatatgtgccacattttcttaatccagtctatcattgttggacatttgggttggttccaagtctttgctattgtgaacagtgccgcaataaacatacgtgtgcatgtgtctttatagcagcatgatttataatcctttgggtatatacccagtaatgggatggctgggtcaaatggtatttctagttctagatccgtgaggaatcgccacaccgacttccacaatggttgaactagtttacagtcccaccaacagtgtaaaagtgttcctatttctgcacatcctctctagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgccccctttttgatagggttgtttgtttttttcttgtacatttgtttgagttcattgtagattctggatattagccctttgtcagatgagtaggttgcaaaaattttctcccattgtgtaggttgcctgttcactctgatggtggtttcttttgctgtgcagaagcctttagtttaattgtatcccatttgtcaattttggcttttgttgccattgcttttggtgttttagacatgaagtccttgcccatgcctatgtgtccttttattttcttgctattaaaaaaaccaggccaggcacagtggctcatgcctgtattcccagccctttgggaggccgagacaggtggatcacctgaagtcaggagtttgagaccagcctgaccaacatggtgaaaccctgtctctactaaatacaaaaaaaattatttagcgagatctgtttgatgctaaagctgttgcctgaggtgagaagtggggcctgtttttgcacgatgatatgctgtctttttgtgacagcaactctgcttttccccttggaggccagcccggatgtgcacctacacagtcctgccttttagaaaaatgttggttgtgggaaggtcagcattcggttggcatccactgatctggccttactacttctgagcatgttaaaatcttctgttggaaaactgtcactcccctgaactccctgagtatcccctaccctctggcatcctagtccctctccaggaaccttcagatgccccaacgatccggcacctaaagggttaaccccagggcccactctaatgctcagggccaatgtgatgtccatactgatcacctggagcccaggctttgcagcttgctaaatatttgacgcatctccaggaaggaaacagtgatttttttttttttttcctggccatgtaccaccctgcagagatggcccgcatatggagggagacttgctggcctttggctcatcaaactgtcagtgaaggaaagacagagtccactcaggtccctgattccttgtacttccccctccagtgacacggttgctggaagagctcaattagtgaaattgcaaggccgtgctactggcttctttgaaacctcacactagcctgatgtattttccttcttcttgattagaagttcttggctgctcttctaagttactccaaatatttttccttccttctggtcaatacattagtagagtgtagtgtgagatgaaatttattttcaatcattcccatagcaactggctcctcaagaatctgtttttggtatcactgatgtttcatatgggatattttctttgtggttaaaaatccaaactgaaaccaaactataaaccttcaaaatgaatttaacagagtgatttcaactcttaaaaaatgaggacatatacatagacatttgaaaaaaagactggaaggaactatgcataatagcaactatctttctgttgagattatatgtggctaaattatcttatttctacttttccttcaaatgaccagtgttacttttttaaaaaaaattaattcacttttagagcagttttaggtttatggaaaattaagcagatagtacaaaagttcccacataccccttttctctctcccccaccacagtttcccctattattaatatcctgtgttaatgtggtacatttactggaagtgatgaaccaatattgatatgttattgctaatagtttagggttcactcagtattatacattctatggattttgacaatgtacaatgttacgtatgcagcattacagcatcatacagatgagtttcactgccctaaaaattccctgtgctttgccttttaatgctccccaactcctggcaaccactgatctttttactgtttccatagttttgccttttccagaatgctgtatagttggaaccatacagtatgtagcattttcagcttggcttctttcactagtaatatgcacttaagattcctccatgtctttttctggcttgataactcatttctttttatcactgaataaaaagaaactggatgtagcactgtttgtccattcacctactgaaggacatcttggttgcctccagtttttggcaattattaataaaactgatataaacatccatgttcaggtttttgtgaggatacatttttcattcatttggataaatacctagatgcatcattgttggagcatgtggtaagactatgtttgtaagaaactgccaaactgtcttctaaagtggctgtaccattttgcattcccaccaacaatgaatgagagttcctgttgctccacatcctcatcagcatttggtattgtcagtttttttgtttttgttttttagtaattctagtagatgcatagtaatatctcatcattgttttaatttgcgattctctaatgacgtatgatattgaacgtgtttttgtatgcttatttgccatctgtatatcacctttggtgaagtgtttgtcaagatcttttgcccttttaaaaaacttgtgtttttttgtttgtttgtttgttttcctatcattgagttgttttgttctgttttgagacagggtcttgttctgtcacccaggctggagtgcagtggcacgatcttggctcactgcaacctctgcctcccgggtttaagcaattcttatgcctcagcctcccaagttgctgggattacaggcatgcaccaccacgcccgactaattttttgtatttttatcagagatggggtttcaccatgttggccaggctgttcttgaactcctggcctcaagagatccacccgcctcagcctcccaaagtgctgggattataggcgtgagccactgcgcccggccactgttgagttttaagagtgctttgtatattttggattcaaaccctttatcagatgtgtgttttgcaaattttttctccccagtctgtggttggttctttcattcttttaacagtgtcttttgcagagcagaagttttaaactgtaatggagtctatcttatcagtgtttttccgtggatcatgccttgggtccttgggtgctgtacctaaaatctctttgccaaactcctagattttctcattctagaagttttgtttgacatttaggtctatgatccagattgagttaatattttgtgaagggtgtaagatgagtgtccaggttattttggtttttttttttttttttttttttggctcatgaatatcaagttgttccagcaccagttgttgaaaagactctcctgtctccattgagttgcttttgtgcctttgtcaaatatcagttgactgtatttgtgtgtttctgggttctcttttctgttccattgctctgtttgtctattctgtctccaataccataccgtcttgattactacagctttatagtaagtcttaaagttggttagcatctatcctccaactttgtcccttttcaccagtggtttctttgtttgtttgtttttttgagatggagtttcacccttgttgcccaggctggagtacagtggtgcaatcttggctcactacaacctccatctcttgggttcaagcaattctcctgcctcagcctcccgagtagctgggattacaggcatgcaccaccacacctggctaatttttgtatttttggtagagacagtgtttcactatgttggcaaggctggtctcgaactcctgacttcaggtgatccatctgccttggcctcccaaagtgctgtgattacaggtgtgagccactgcgcctgaccagtgttactcttaaaatcagaaaaaaagtttttttaaagtacacttaagcctaactttatttcttcccatttctttaaatataaacaacgaaacaattccaaacaatcctgaaatgtataatgtaaaaatgtaaaaagtaaagtaaagaatgaaagtctcctccttcactcagtttctccacttctttccagagggagattggtccacgtattagttatctattattgtcaaacaaattaccccaacatttagtggcataagataacaataaacatttgttatctctggccttttctgtaagccagtaatttgggtgtgacttggctggcggccctggatcagagtctctggtgaggttcagtcagatgtcctcagggtctgtggtcatctgaaggcttaattggggctggaggatctcactggcaagttggtatttcttcttgttaggaggcctcagtggtccatgtggttctttcctgagagctgttttagtatccttaagacaaggggtaactgacttctcccagagcaaacaatcagagagagacagacagggagagagagagaaagagggagagggagagagagagagaacagagaagatgaattttttttttttttaagaaggagttttgtgcttgtcacccaggccggagtgcagtggcgggatctcagctcactgcaactgccacctcccgggttcaagtgattctcctgcctcagcctcctgagtagctgagattacaggcacttgccatcatgtctggctaatttttatatttttagtagagacagggtatcaccatgttggccaggctggacttgaactcctgaactcaggtgatccgcctgcctctgtctcccaaagtgctgggattacaggcttgagccaccatgcccggcctaattttcaccttttcttttctttttttttttttttttactttttaattttctttttttttttttaatttttttttttttattatactctaagttttagggtacatgtgcacattgtgcaggttagttacatatgtatacatgtgccatgttggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggcgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttgcctgactttttaatgattgccattctaactggtgtgagatgatatctttcaatggagaagtgtcaaagaatttgaagtcacatttaaaaaccacaatagttaattttaaaatcagaaaacagttataaatacacttaagtcaaactatatttttctctttatttttattttaaagacaaaatcaatgtctttgtttcataaaaatataaaatatcctgaaatttatcaagtgacaagtgaaagtttcttcccttcactccattttcccactcctactccccagagggagatcggcacatagcttctcagtctattttctttctttctttctttttttgtttgagacggagtctcgctctgtcacccaggctggagtgcagtggcgtgatctcggctcactgcaagctctgcctcccaggttcacgccattctcctgcctcagcctcctgagtagctgggactacaggcgcccgccaccatgctcggctaatttttttgtatttttagtagagacgggatttcaccgtgttagccaggatggtctccatctcctgacctcgtgatctgcccgcctcagcctcccaaagtgctgggattacaggcgtgagccaccacgcccggcccccagtctattttgtatacatgcacaagctcacatgcacatgtgcatgtacataaacacacacagcacagctctttgtaaaagtgtaattaaattccacattgttttgctactccccactctttaacatatcatggatatccttcaatgtcagtacatttaggatgtcctcattcttttaaaacacccacatagcattccatattagagatttaaaatactttatatttaaagattagcttactgatgagtatttagatttttccagtttgttgctatcataaatattgctgatgtgtacatcctgcacaaaagtttgagctaatttctgcaggatcattgcttataaatagaattcacaggacaaaggtcaaacactttaaaaattttgttaggttctaccagattgccttccaataaagttgttgcattctgaacgatcactaacagtagctaagagttactgattccccataccttggaaaatattgaagaggctcaatttttcaagtttctgtcatgtgatgggcaaaaaaatgtaatctttttcttttaatttgcttttcttgaatcattaatgaggatttttttttgtattttattcccacttgtatttttttctttgaattgtctataatctttccctgtttttgctttctattttccctattttcttttccagatttctttttctacaatcttgttctgctctccctgtcagatgctgccagctttctccaaatgtctggtagtcgctgtccatccattgttggtaatgaggcaccacagagctgatcgggagttccatccacaacccaagtgggtggcagttgtgacaggtgggcatcacagtagggtgattggtggcaaactgcgttgtttcattggaagtcccccaaatgttcgtttctgcaggtctttctctggtatagttcgtattctccagagaagaattctctcatctcctgccagggacatgcccggctgcatcagttcggggagcagagtggaggtgggcaaaggggctggcagcctcatactcaggtgcagagtgtcattcgtcagatgctttcccctggcacacccctccctccactgtgtccttccgtctcaagttgtcttcccctgtcaccctcactctatgtcttgtctctcatttcatctccaaacttccaataacagtgggtccttctcatcgtcctcatttcctcacctcctgacttcttgatctgcagcctggcagcctgggcccctcttcctttcttcacctcctgtcccatccttccaaaaacaagcatcactgcacaaggctctctgaagacacagagcttcttcactgtaaaaagctaaatagcacgataacttaatttaaacaagaccctctcaggaatttgtttggcttaaagctactaaaatgccattctgttggctcatattttcatttatgtaagatgagtgtcatgccaaaatgattttattgccatagaagtcaggcaaatatagagaaaatacattttagaaaataaagtgacatgtggcacatttgaatcctatgttctgcatttagaaatgaactcatgcctctccaagctgaagctttttggttatctaggaagacggtagcctggtctctacagggttccactccagagcctgcactgcacactctctgtcctgccatggccctctgccatctgtgggaggtggatcagttgggccaggccaggcacaggtccatctcacgctgaatgtagcagacgggagctgcttctgctgggtgagggagggggcttgtgcttggctgtgaggacaaggtcactcctttggagctgtagaagggatggggcaagcatgcctgcctctgctgtctgctgagattcctttatctcaggctcccataatctcctgatcttcaaccccaggaccttgactcatttcttattcttgaaactttttgcactgttgaccacctatgctaatttgaaatggtctcttcctacttcttccacaatacaacactggcttagctctcttcttggttttcctgttccctgatgtgggcagggaggccacggggctcagtcctctgctatcacgtcactgtttttgtgcctttttcctcagaaataaacttccaccatcgctgcaccagtggctctcccctgcttctccagctttcttcaatatagctctcatatcgccagctcctgtcggatctctacctggctgtctgggcaccatcttgaattaaaggcagacaaagcgaaagccctcaatttctcactcctctctttagttagccttttcttcccccactgccctttccaccaattaatcaacaagccaataatcagcttatcatctgaatgcctatcaccatttccccaagcctggaaaacttggaaaagaacttttatttctctgtctagcttaagctcttttatcctttacaaccccacagttctcaccttagattagcacatgtcatttcctctgtgggccatttagataatgtccaaatcagaatttatcccttgaggatcttccctttggttgtccccagccatttcctaagggcgactgacacctcctatgcactgaagccagatcacttttcgtaaaacagtgctttgcctcggtcactctccagcttaagcagcatcagttgctttctattgctattggacaaaacccaaacccattctgtttgcattcaaagagccacatgggctatccctaaatttcccatttggttgtatctccaattctgcccctttctgaacaattctccgcaaaacgtgtttattcactgatttatgaagcatatgaatacagctctccttctaattctggaattctcttcaccatgccgtattagacctaagttcttgctcttggatgaagtagttcaggaaattgtacatgaagaaggcatggtctgaaatccaggatcccctgtgtggtcttgagccatgttagatgttctcagctttggttttctcattggttaaaaacaaggatgaaaatcatatttacatctccaggctgccttcctgcctgtcttagcatggctgccaggcccaaggcccgtggagatcctttgggtgaggggctataacagtctgctcaggaccccagggactttaatgagggcatttgggactctggttccttgttaaaatttttaaggctgggtgctgtgtctaatgtctataatcccagcactttgggaggctgaaatgggtggatgacctgaggtcaggagtttgagaccagcctggccaacatggtgaaaccccatctctacgaaaaatacaaaattagccaggtgcggtgcatgcctgtagtcccagctactggggaggctgaggcaggagaatctcttgaacccgggaggcagaggttgcagtgagccaagattgtgccattgcactgcagcctgggtgacagagggagactctgtctccaaaaaaaaaaaaaagttttaaaaatgtactgatgaatgctttcaagtatacaggaaagagtataacagatattcatttatccaccacccgaatttaatggatattattttgccagttttgcttcagagctctatttaacataaaaataaataaagcattacagatgcagtttaagctgtaccttcaccgaccccgtcctgttccccaagggaccactgtccggaggctcatcctccccatgtgtttttatttttctaccatatgtagctggccctaagtgatgtcggctattgttcagcgtttgaaaattttatatacattgtatcataccgcatggatcctttcacttgataaataatttgaatggtgagtgaatgattgtgcaatttgctttctttcagccaacatattttcgcaatttatccatgttaatgcatgtcatggcatttcattcattttaactgttcttcgtgcaagggagacacagaagagttactgagtggtgaaagtggtgtgagaggggtttgcacagggcacccgggtctcctggcgctccccgtacagtcggagagtcaggaaagactttttagaggagattgtctgggagctgagtgttaagggagacggacgcagaggccttgtctgccacccagcggggcttgggctttattttgggggcagcgggaaacctgactcaagttcatattttagaaagattgctcttgtcccaatacggaaactggcccaggatagggatgaagaaaggaggcaggactcacttgagaggctgctacggcaactcaagagagccaggcagggcctctagggtggaaaagagacgagatgggggtggggtatggggtgaggccaagaaaagggataaggctgacacctgactggctggctggtggcttcacgttctgggactcgggaggaacatggcagctggaacaggtgtgggggaaatggcgaggctagtgtgagaggtcagccgaagacagtggcccagatctcggaggtgtggtcagggctggggtaaagcgccccgcagcatgggagcaggagaagcggtgggctgggcgaaacgcttgggcagcctgtgctggtttggaagcggaaagagccatatttgttgagtgaatttaatttaccagaagaggcattttcactgttctatatatttttaaaaaaacctttctgacaaaattccaaacatacaaagtgggtaagctaaaaatcaatattctttacccagaaacacacccagaatctccccaggtggctgttccactcgggatgcagggaacacatggatgttctggctgctctctgggcctcgcagctggcctggcactgtgtctgcggagggccaggcctggggtcttcctaggatgcacggtgctggcctattataggtattcaggaaatacttgtgcaaagaacgaacacactgcgtggaaggttgtgatgcctgactcagtggccttttctgcccggacgggtgaggatggctcatccatgggtgcctggagggagccctccatgcccccatggggaacatctgcctgggtcccccttggatggggctctgttatcctcctgagatgaagagccagcagttagctaccaccaaaattctgtagaatcgtcctcccagcagggcgtgtccccgagtctcctttgtggctcccttcgccatgtggtggaagggcatctacatgtctttgccaggaagggtcttctgggctccagtgagctagggcagcctggaagggccctgcagtgcccgggatggcctctgtgtggagttgtgattctgactgtttgttttctggcctctcatggctggaaaggctcgtcccaggacagcgggctcaacccttcctcactgcccacagaggtactaagaggaaacactcttttgcgtgaaatggctgtgggatcctggcattcacgttctccttctgggctggtggggtgggtgatgctacacagcatggccttccgcactctctcatgtgaccctcatgatgatggtgggagggaggtgggctgggttgctttcccctcctcaaagatgcaggaacagtgacctagagaggtgaagtaacttcaaagcccaggcctcagtctccagccaccttcctggcccagcagagaggaagaaagtctcagaatagctgatgagcggtttaagtgggggccccagcctcacagcctggcctccatccctggggttcttaaccctgtctgcacatcagaagcaccaggggagcctcaggtgtggaaagaagaatcccaagctccaccccagaccgagtaaatcagcactctggggtgggcccattggtctgtattttcaagtgctcctggtgctactgtgcagccagggttgagaacctttgcctttcagcctctactcatgcaggctctgctctgttatctgcagagatgggcgcccaggctcagtggaggaaaccaaggcaatccaggccaagtacctcagcgctcaggccggcaagaccctggagacaagactgtcatcccctttacactgggcacaggctcagggccaggactggaactcttcttcagttagcccctgacgtaaggactggctccttttcctcctgcatttcccactcgacctgcactcagctgagggccacaagtacagcaaacacctgcttagttgtgggtgtggatgtgtgtgacgaactgggaaggagcaccaactctgtgtcaggcactttgcatagattattctatttatctttgaaacaactgagtgagatgggtgagatggttattccagttttacagacaaggaagtcaaagccacagagaggttatgcaactttcttgagtttgcatagtccgtggctcagccaggattgaaacccagaggcacctgactccaaagcgtgattccctggtgccccctggcacccgctggctctggggtgcccttggaggaagttggtgaactccttactgcttcctttctcctttcggatcaagggggtctgagaacctgccagtctccgctgggcccgttcatgcctggttaaaactgttagaggtgagcctctttaaggggaagcaggaaatgagatgtggactgtgaggaccaggagctgaggcggctaaaacatacctccccagtgccaccaggaacagaggccatagacacgctcagctcaggaccaaactcaagtcccacgtcaggcagggaatggtgtccggccaggcaggggcgctcccagctcagcccacagggcctcagcagcacctcctggagcacacagggtgaggccagcttgggagcccagctgctcggccccagccctctgcatccttggccttgggcagtctgaccccagcatcagggagaatttctgcccctttcttggatgattccttggaaggttgtgttaatcagcagtatgaagggatcacagggcccctaaagaggcagcagacctgctggaatttgtggccacaatgaaagacatgggaagcaccaagtagcatttctttttctttttttttaattttttttttttttgagacagagtctcgctctgttgcccaggctggagtgcagtggcgcaatctcagctcactccaagctctgcctcccaggttcacaccattctcctgcctcagcctcccaagtagctgggactacaggcgcctggctaattttttctatttttttttagtagagacggggtttcaccgtgttagtcaggatggtctcgatctcccgacctcgtgatccgtccacctcggcctcccaaagtgctgggattacaggcgtgaaccaccgcacccggctttcttttttttattatttttgtttttgagacagggtcttgctctctcacccaggttagagtgcagtggtgtgatattgacctactgcagcctcaacttcccaggcttaagcgattctcccacttgtcagcctcctgagtagctgggactacaggtgtgtaccacctgtatctttttgtatcttttgtagagacagggtttcatcatgttgcccagactagtctcgaactcctgggctcaaatagtccacctgtcttggcctcccaaagggctgggattataggcatgagccaccgcacctggccccaaggaccatttcaaacctttattaggtttctcctgtctttttttctttttctttcttcccatccctttctgactctgactctttttcctcttcctctttttctggttctgatctctttccctctgcctgtatccctagctggacccttggtatgagctactggataggggtttctggccaggcctgggatccttcctcttactgccctcattcctctttgtgaatcaccattatgtatgttagttactacctaggtaggtacttgttgtattgcagatgctgataatgagcaggtgtttggaggatccagagtgggtagcattgatgatttagtcttgaaaagtttactcatttgctaggtccaagcgcaacataggccaattaccatgtcccgcctgccacttggctgtgacaagaaagttcttaagaccaaaaacaatctgaatctggaagtcctcgctggtgctaagggagggatgaaacccaggaggtggagttggggctggtggatctgcaccacgctcctgttgcttccaccctccgttggctttgtctctggtgacgtgatctaagggaccctgctgatgggattgatactgggatcgcagaaaggtggtttcactgggggctccaggagtcccaggtgccagggttgctccatgagtggcctgtctcagcaacatgagagccttgaggactggaatctatctcagtcaactctgtgtcctccaacaccagcacggggcttgctgtgggcaggggctcaataggtttgctaagtgaatgaattaaggatgaatcaaaaacagtaaaagaagtacaagagaaaggctctggaacccacatggaggtgtggagaaccctagccccttagctgcttatctgcagtcgcctgggcgatggatactccccaggcctccctccagagaggcgccaaccttcctgtgttggcagcagttcgcaggtattccgtctacacagaatggcagaggatcgcacaatgcctgtgtggaggcccagcccagggtggggccagcttgcaagcccagtcagaccttcttgggaagaaggaaggaaggaagggttgcaactgagaagaaactgtggctttgaaagttttcctccagggtttttttgtttgcaaggaaaggagatgcttagggaggcgttatatactggacaaaagagtgcggccgggtcagtggtgaaatcagagtgcatgtctttcccacagcaggtcagcagggatagctttgtctgcgaatgcccacgtgctgggaagacgttgcagcctctgatacaacagctctgtgttccttagatttttttttttttttttgagaaaagtacatgtgcttcatattacctgtgtccacagcacagatgtaagtgagtaaaatttaaacaaggatccagatagctgggacgaagagtctcttgacctgttctttccgactgtgcaggtttgagagaaagaccagggatctggcagtgttggccagatattcctgcaggtcagttggaatccagttggggatttgctgatgtgaaacactcatgaacagtcacaaaaccaaacatatggggccagaaagcaagaccgacttgaccttaaacaaaatcctcctttgcttctgagctacacgccaggcaagacaaatttagggaaataggaatatggatttctatttgttaagaaagatacagttgtttctcatcaggcttttccagttctagcacataggattgcagtgacctcatttttgatcaatggccaatgcattcaactgtctggtggaataatctattaactgggcacctgccaattgtctagaataggaactagcttaggcatatgttttaaaaaatgataacattgttatgagccctgccgagacaagaggatgggaagcccaagcaggtcagcactggctctgaagtcagtttgggatgatagactgtgtttttcagtagactcactgccctgtgactgacctccctctctccctgcattaattacatggtatttaaaggcaaaccaacaaaccacttaagagtcccggaacccgggcatgtggaatctggatgagtgaccttcgctgggtcacacatagccactgttggaacccagttctcccagctccccagccagtgctctggctgtgccctgtgcccccgtgcagctccctccgagtcccatgtgaccacctgtgtttatgatgagtcctcactcacatctgtgtatcgattctcttgcaaagaggccccttatggcactggctggtggaggaggcagctatgctgtttgacagcccaccagcaggctaagtttgccacttttagggatccatgtcttaatcctgagtgtgaaaagacttaaggtgttataagcgtcacccgcttcatctaaactcgcatttgcaaccagtggctgattgagagatggcaaaggctgtggacaccaggaagccatgaggagaaggaccccctcagcaagggtcaggacttgtggacctttggatggaaagaacttcacttgcagatagttatcatgtgtagtcagatgctgcttatctgtaatagtgaggacagtggtagctaacctttattgagcattactatatgccgggcactgattttttgtactttatatgtattaattcatttaactcttacaaaagaagtagatactattattcccattttacagtggggaaacagaggtggtgagaggtgagtacctcacctaccataggtagatttgagaaccaagtcgcactgggtgcggtggctcacccctgtaatcccagcactttgggaggctgaggtaggaggatcacttgagcccaggagttcgagaccagcctaggcaatacagtgagacttcatctctagaaaacattttaaaaattagctggacatggtggtgcacacctgttgtctcaggtactcagaaggctgaggcaggaggaatcacttgagcccaagagttcgaggtcacagtgagcactccagcctgggcgacagagcgagaaccctgaccctaaaaaagaaagaaagaatattaccagtaccattgcttctttccagttgcatctccacagcagtcactcttagacttttggttatttatgtacctactttctgttcatagagtcaaatctgagtcccagaaaagggcatgtgtctgggcagctggaggggccgtcataggcctggggttctagatgaccagagggagtgcttgggagagcgagctgctctgtatttttcctctaagctcctcattgcctacctctaggtctcaggagtgggtcaaaccagaacactgcctgggggctggtggctcacgcctgtaatcccagcactttgggaggccaaggcctccatctctcacacccatgtccagaaatacctggtgctgccagctcctgagacctctgagcatttggagggctaaatcagattggttctcagattttctctctgctgacttgacattccattttcttgggactgatatctgtaccactggactatctactttttaacttctgaaattttgttgctgtgttctactgttttccccattcttatggatttatatccttttaaaaatctctttaatgggtgcggtggctcttgcctctaatcccagcactttgggagaccaaggggggaggattgcttgagtccaggggtttgagactagcctgggcaacatagtgagaccccacctctaaaaaaaaaagttctttgatatatattagcaggatgtggggagggaacgaaattaggtacatgtattcagtctgccatcttaactgataagtctggtattaatatttttcaatgacaaactaaccatacttaaaaaatttttaattagagaattttattatttcctctccaaaaagtatcatttttcatttagaaaggtgtattcgtatatctctttgtgagagatcattgtctgtcttgctctggcaaactttacagtcctagattcaggactgtgatcactgtgaattctacccctgattctagggaccatttgtggaaatctgaatagtgctttgtaaacagatttctgagtctttttgaagccatttgggatggtatcatggaagagatatgaagaaggtattttctcttggtgggttgctgcaatatgatttctgacttagtgtcatcataaatatttgagactacttgttatcttcagtaggtgttaccttatgggctgatacttaatcacagcagtcagaaactgtgaatttgcatggtgacacccttccaaagtgactgtaagagccttcctccctgacttttgaggatttgcaaacagcagagaagcaagtttttaggtatcactccagggaaaatagtgatttcatgcttgaaatatgtgggaacaatatctaaagaaaaagcttaagttgtctaaagaggatcttataatagttggatacacttataattagaaaagcccactgggggcccaggcactgtggctcacacctataatcccagcactttgggaggccgaggtgggcagatcacttgaggtcaggagttggagaccatcctgggcaacatggtgaaaccccgtctctactaaaaatacaaaaattagctgggcgtggtggcacatgcctgtaattccagctactcgggaggctgaggcaggagaattgcttgaacctgggaggcaggagctgtaatgagccaagatcgcgccactgcactgcagcctgggtgacagagcgagactctgtctcaaaaaagaaaaaaaaaaaggaaaagctaatttgacattggggcttactaggaacaaatataagcagagaaatggcctacttagaaatgaaaccttagattgaaacaagaaaatgtatttattcctgaaaagattttccacagtgagttgtcaagttgtgtcttgctaacattcggtccctgattccttcatttccgccatccttccttggctcatgtgcctcttcatctctgtatttctttgtctcctccccacctagatctccctctctcctccactctaatcagttcactgaaaaacttttcctgagtcccactatgtgcagaaccaaagctagaaattgaggatacacacaagaataaggcacaggctctcccctaaccaaacaatcaccatttcctgggtcagtattttaaaggaaaatatgcaagttgcaggtggaggagagtggaagaaccttgaccttggggtttctgagatgtcttcaaggagagggtgatgcgagtgtaccccagaggtcacacaagtgttcacctggtagtaaactggggatggtgatcccaaggaacaggaacagcatatgtgaagactcagcgcgcatggaagagttcagaaagtgcaggaaggtaggtgtgctggagctgagtgtgctgggacagggtttggggacagagggccagaagggtacagagccttttcaggttcaagagagagttcttcccagttccctgaggtgatggtgcttcaaagcgaggaggcagagggaagctcagggaactttcagcttctagggcttccaggattggcttgtatcacaggtcttggtgaaaagcagaacagtagcttgtctctgttcagatcacagccgttatttttcacttatgacaggtttatcggaacatggccccactgaaagtcaaggagcatctgtatttataattagtgtatttccttccagtattcttgccttgcatatttgtattcatatatgtgagtagatagtacctactaaattataattttaacttatttttattaagaactatacatatttaatttaaaaatatatctaaaagctatttccttatagcctttttttcatcctttttcgttttaaagcataattgagctcacatagtatataatatttttgaagttaaaactaatgtagcaacattcagaagtcccagatggaatgtactataaacagaggcttgatgacatatcttgagaattttcttagtctctctagttagaaaagcaagcaaacaaacaaacaaaataaccagaaataagtttaaaattcaacatgcgttttaaagatacggaaatcataaaagctgagcaaaaggtcaataggcttttctttgaagcagggaaggggttgaatcagatttgctctttggagccctgcctggagttagggtaggcacaaatggggagggactgaggctggggcccttcaaacgtggttgcaattgtccagtctagagaagacacagcctggactgatgcagtcgaggtggggtagagatgaagaccagatgcagtttgggagacagtttcgtgatctcattttcttgatttgtttgtacatgcctcttaattgtttccattcccgcccttctcatcccacctctcatcccatctttggtccaccaccgccatcgggaacatccacatacttgttaaacacaaacaaaattattttaaccaatgagaactttgattgattttttgtctcgttagtttataatccaaaacaatgatgaaaacatttaaaagggtccaagatcctgccataagtatttacttttctcgcgccactggctacatgagtgggtgcacacatagacccatgcatgatcacacacactgatggcctggccctgagatactggagacgaagcagccggcaccatgtctggcacatgaactcaaacacttcacttcctctggtgaaccttggccagccccatccatgattcagtgacgaaatgccttctcactctgaactaaattcatttgcacggtttctagcgtgctttgtatttttagtccttttccacacatggcctctcccattggatggcacactccctcatcacagcactacagctcagccacatgccccgtgagagcatgatgaggcagccggctggggtctctgcctggcccggggcctggattatctctgtatgtggccaccatttgcatgtgaaaatcacgtctggctcacaagtctgtgacccaaacaatagtctctttcaccctgagcatacggtctagggatgtgaagggaaatttcccttgcttctctgagaatatgtgccacttttctgaaaaattaaaaataattggagttacgaagttgggttttttttttttttttggcaagagtaagcaataatgattaagaaaagtggttcatcaactgttaccctgctcttagtcctttcaaacttccttctttttttttttttttttttgagacagagtctcgctgtgtcacccaggctggagtgcagtggcgtgatcttggctcactgcaagctccgcctcccaggttcatgccatcctcctgtctcagcctcccgagtagctgggactacagctacttttttgtatttttagtagagacagggtttcaccgtgttagccaggatggtctcgatctcctgaccttgtgatccacccgcctcagccttccaaagtgctgggattacaggcgtgagccaccgcgcccggctcaaacttatttctaataagccatcagaaaattatgtcagatgtctacatcaattcctgcatcagaatctcacagtgtccttatcagacattctttaccaaacagcctcgccgaaattaatactttttgaaacactgagtatatttctgcttgtaagcagagaagaaagtaaggtggaataatttattaagatgagaaaaaagtcctgggtcaattcacattgctgtacatttcttgaatttaagatttgaaggtggtgcggtgagcaagggaagtaacacagtagcttccaccccgccacccacggtttcactttccatggtttccatttcccgtagtcaaccacagtccgaaaatactaaatggaaaataccagaaacaaacagttcatacgttttaaattgcccgccattctgagtagcatgatgaaatcttgcaccgtctcacccgggacatgaaccctgctttgtccagtgtggccacaccgtacacaccgcctgccatcagtcacttagtacctggcttggttatcaggtcaactgtcaagtagcagagggcttgagctcgaggccaataatagccaagtgctatgtcacgatgcctgcatcatccgcctcacttctcgtcacgtaggcgttttatcatcttacatcatcacaagaagaagggtgcatacagcatggtaagctattttgagagagagacgttcacataacttttattatagtatattgttagagttgttctattttattattaattattgtggttgatatcttcttgtgcctaatttataaattaaactttaccataggtatgcatatataggaaaaaacgtggtgtatatagggttaggtactatccttggtttcaggcatcccctgggggtcatgggatgtacccctaatggataagggaggggggatactgtaatagctaatgtttattgagcattctgtttgtgccaggtgctatactaagcattatacatctcactatatcctatctatggagtccctgtgtgttattgtccccatgataaagatgagataactgatgttcagagaggttagattgcccagcagttatccagctggtaagcaatggagccagaatttgagccctggcttctgacctcagggtccatgtccttaaccatcaagctcacattgtttccagctgctggggccgcctgctcttcactgactgaattagaaaacaagcaggacacataagtcccatgtagggcatggcattgaaaatgcagtttgcgaagctgctgactagtgaagtgaaaggggacggtagttaaagtattttgcactgggagacttgaagccagcattctctctaccactgtctgtgggaccctaggccagcaccccaatatctgtgggtcttcagtttccccataataaaacttgattttaaaattcatcatctggccgggcatggtgactcatgcctgcagtcccagcactttgggaggccaaggtgggtgggtcacctgaggtcaggagttcgagaccagcctggccaacatggtaaaaccctgtctctactaaaaatacaaaaattagctgggtgtggtgtcacgcgcctgtaaccccagctagtccagagctcaaggccaataatagccaagtgctatgtcacgatgcctgcgtcatccgccccacattgtctcgtcacataggcattttatcatcttacagcatcacaagattctcctggtgaggcaggagaatcgcttgaacctgggaggtggaggttgcagtgagccaaggtcacaccactgcactccagcctggatgagacagtgagactccatctcaaaaaatatataaataaataaataaatacataaatttcattatctcttagaagtcagtgggctgcccagccaggggcagaacttagtgcgacacttgcccaactcctcgtatttgtcttgtacttcccagcatgggagatgtgtcctaaatgaagaagcacaagaacatgctattgagaagagtccctcaattgcggccatcctttggtgtttctgaaagtaacaaaacaaggcatcagatatagcagaaagaagcactggtggtagctgagagagtttgataggcagctacagaaaatccccataccttggatgttgatggcacgcggtgctgagtaggaaatgcagaggtcattgtttttcaggctgtaaaaacctcaagcacaggaatcccatattattgccgttttatcctggcatcttggaaagtaccgggcacatggttggctctcggttgcactttgctgagtgactgactgggaaacacaccagagtggatcagcatccagtgaggcagatggatggacacagtcctaggaaacgtaatctgcgcagcttgtgaaagtgtgatgagagttgcaggagaatggagttgatggaacagattgtcagagcactgtctccaaagaagaggagtggcagggtggacggagcgcctggctgcacacacacctgttccgcctccctttctttcttcctcccatcctcccaccctataggtagtcatcaaagcctacggggtgccaggaggtaggctttgggatacagcggagaataggatagcgatggtccctgccctcatgaaacagggaatccatgtcagcaatatatgcttttctgattaatgctatcagaacacatgcttcttgttagccgtgtggctgtgggcaagtcaccgaaaccctttgagtttgtccatctgtctaatggaaagaaataccctcctggaagagtgttttttaaaggattagaaataatatgtccaaagtagttattttttctttgagtttggggggaggggtggttccttctctctctccccctgccaactgttttctagaaaatcagcacttactggatattgtagagaataattttggggttttattattttgaagacggtttcttctgttaaacttcttcctgcatcctcttgaactggcagaaataaaaatgctagacttttaaagatatgacactctagaatcctgattgctaaaaatgaaaagcattctaaagtaaataaaataacaaattcaaacagtaaatctgtaatgaccgaatgagcaccattttaaactcacacgtaccagaggtgatcgtggtatgaggaatgagcatggtacattctgaagctcctgaagtaatcaagggacttctgttatggcctaaagcaaacaaacagccaccatacaaacctatatacatttctatttcttttccctcaaatttctacttgaagcaaaaggaaagtcacttcttgctttctctgccccagtaactgtgggtggcagccagtttttggagcagttctggagcaattactctgcaatcccaaattcctagtgtatgaacaaatctgctcagacattatcagggaagaaatactggaacctggattttagtcctggctctgccactttctcaatccttgaccttggggaaatcacctaagcgtcagtttcctcctctagaaaatagagaataataatatctgcctcacagattatttagagattaaatgatgtaataaaacgtatttcctcaattccaagtcaccatcaattttaattcacaccaaattttcaggtggaaaaaagccttacattaagtcctcatgttgcttgtaagacatccaaatttcagaaaatcaaaatgtttttaaaaagttatactcaaaatgagcaactactataaatacgattgccttggcaaaggaagattctaaataaacgtaagacagtcttgttatcgtggtcatcctccctgggcggaggatctgcaatctgtgcctgggtttccctgtcgccaccactctgctaagcagccggaagcagggctgccccttcagcatttctcttgagacctaccgcaccccctcacaatcccagatcagatgccaaagccagtggggactggacaacatgatgagcccaaaccaatccacgctgagcttggcatctgatttgggattctccaccttgcagagaatcggaaagtatctccacaatttcttttggaccgagctgttcttccctttccatgagtttcttttacacctgacctagagcctctcaaccatttttatgtcactgcacagccagaaaatgataatatttgtacagcactccagggaaaagggaggaacagttgggccaagaggccaatgacttcaccatctggaacccattcagggcattccagcgtggcccaccttctccaattagcctcctcaatgaaaaagaaagagggggaggaagaggaagagaaaagaagaagaaaaccctggtaatgttcactgttttttgctttagaattataagggcactttagtttttcgaagcgtctttatgataatggtctggtatagtgatcaaaatacccttgggcttgaagtgccataaacaaacaagttgtgatacttgcgtgtgtatcagaatccctgaggaaacttggtgtgtgtgtgtgagcgcgtttcctaatagcctgaggcccgggaatctggattgtaagaagtgctccaggtagttttttatcatgatttttaagtcagctctgggaactactgtcttcgaggcccttggaaggtttctcctggcactctacctttcatgttctgcattgctcattctattttcccctgtaaaggtagcctttttgatgcagtagtccaaacctcgtcttgcggtgcccttgtatatgtgctcagtcctaccccctagtgtacaagaatcgcactgcaaggagtagataatcagctgacctgtgggaccagaagctcagcctctcaggcttgcaatgttctctgagaacagtgtgtctcagcgtttggtttggagatttcctgtatcggaattatctagaaactcattagaaaaacagtctgatccatactctcaaattttggactagtaatctacattttaggtaagcatactggaaattcttatgtacattcagatttggaaactactacgtatatgggatttactaatcctattgatctgtaaagggttaatttgactcacacattgttacctgtctttgacaggccccttactgcgaaataaccatccatgtacacaatggaccccttggagtaaccagccttgcttccaatatgactgttggggtagtaaccaggagaaggtgcttaggccctaaattctgtcactgaagccaatggtatgattaaagctcaatgtgaagacttgaatacaacacatcccaccctcattttagtttcatctggcaattgaggtgtttttgctttggccattatgggtctcccaatcagagtggagcttctagaataagtatttttaacatagagtccttgagcccctgaagttgcatgcaaaattgtatgtaaataagtgtatttttctaggacagggttcagaactactgccagattctcaaaggcattcttgacctgaagggggaaagattaaggattagaacagaggtacttttcagggttagaacagtgaagaattataaacaaaggctcatgtccaggtaaggatttctgagcctctgcagaccaagcctgaccaattgtccagcattccccaaaatccacctgctctccctcctcttttctttgtgcctcatcctttcttcctttatgcttttctctctctgttttttctccccaatccttttgtctctctttttcccctctgcccccactttgccatctccccatccctcctcaccttccatttcttctctttctctcccttcctggcctgaataggaagcaaagcatgttctttgacttgttctacctgttgaatattttcaatattccacttattttatgttggtggttcttgtttgtaaaattatgtgagttgcacatttaatatttctctggctagatgagaaactaatgctttaggcatccttgttccttgattgtttggatccagcccttgttagaaggctttctgtgggcagtggtccccatcacccctggccagcagcaggcatgccttaggcctccctcttgttctgagattgattctgatgaagaaaaactgactgaccagaatcccagacccctggctctgagcccctaccctgatcccaaaacccagctgtctctactggattattctcatttgctggctttggcttggggatcagagaaaggagccatgggctgaagaggccgtgggacctggtcaagtttgcagaaggaagtgcgagcgagcgctgcccagcttcgacccccgagtctgctcccactctgtgactctgtgagcaggagggatgggctggcccgactccctggctgggcgttccgggtatggatgcctgccacatgcagtcaccagctggggagggcccttccacacttctgagcctcgcccgcctcagccctgagcagctgggagttccgaggaagcgatgggtgaccgctgaggggtgggccgacacatcctgcctgtgcccccccgctgctggtttgtgttcctctcactgcacgtggcaggtgtcccctggctgtggggaatttgcagattactctccatgtgactgtagaagcgtccctgaaggcacttctggcttcaccattttgggggtacctcctggggtaggaggcaggatggtgggtctgtataaagcacaaagtgggatatgtgccctcaagtcactcacatttgggtggggagcaaggcagccagctacagacccagagaacaaggcaggaagtcctgggctgacagtgggcatgcagagagtgggctctgtggtgcgagcagcctgtgagtgctggccgagggttgggggtgggagtgaacccagaggtggagctggcaggagagtgccgcctcctgaggctggcaggagatgatgccccaaattgcaaatttgaaagttaaataatatacaaaggacccacgtgggccccccaccccactcttctccccactaccctcactccagggcccagacaaggccagtgctagagcttccaggcctgctcgcaatccaacttacatgtccctcttgcctggatcttcatgctccctggggactgaggcatgcaccttcatcttcagggacgtgttttgaagaaatattgaggcctctgccacagggttgacctaaccccaacacataggtgcccacaccccaggccagcactaggcaatggggcagcctctagacatctccctggggattgcatttgcctttaaatctctgggccccatagcgagttggcaagtggctgtccttgttggcctaatgtgaaagattgcatcacatatactacagttgtcagagacatggctttggagtcagacctccaggttcaagctccagctcagctataatttgctgcatagaattggtcaaggtagttaacctctctgacctgctctctttgtttctgaaaagcaggtaataacgcctgcctcgctaggttgccaaagcataaaataagataatgtttataagaggcctagtgtcatgcctggcacaaagtaggtgctcaataaataatcattgtcattatcattgcttgtcctggaagagtaggtccctggaggccctgggttatactctaaggcagtgcttcaggatctggggatcttgttaaaatgaaggttccaatgccgcaggttggggaccatactttgcatagcaaggtagtttcctggggcacctcaatcacgttcagtcaggagcagcagcatcctttctcctcctcttgctctcccctcgtgctctctgggttgatcagtcatcaaaacacttcccaggctgtccaggcaggatgtagggcaggatgtatggtcactggactcatccagcaccccagtgactgcagccacctgcggatgaggaggggatccggagggaggagggaacttgtctctgaccttgaggattcctaatctgacggggagatggtacaaacacacctcactctccataagcgcctgcagaaaaggcacacaacggcttgcaaaggaacacacagaggcacaggaaggggccacttctggttttctcctctcagagctagaaggctgagagcagagtgcccctgccagccccacaaagggaagcggagtgcagcctgaagctgcaaggtcaggtgatatggcagtagcccagggcagcccgggttaaaggcacactcactcaaggccggctctcatttagtggcaccgcaggttaaatgctgctcccaggccttgggtcccagtgaccaggaaagttttgaaaatgagaacatgtgttgaccctaggactaggacaacagcgcccttgattttgcggaagtcttccctggaagttgggcgtgcttgatattgagacgctgcactttgtgtttcttgacggctttgctgcaaattctcacacaccttgcccttgagtaaaaccccaaggattccagacgtcggcaaactcccgagcacaacggtcctttccacctaaacccctgagcacacagtgatttctgcctacattggtgactggtggtcagatggcttgctgggcagcttccccgccctgcttctcgtggaggaagggcctccctgtggtgggaagaggtgttccctgtggcaacaaacagagaccttgtctctacaaaaaatgtacaaacttagctgggcatggtggcgtcagcctgtagtcccagctagtcgggaggctgaagtgggaggatcacttgagccatgggaggtggaggctgcagtgagccgtgatcatgccgctgcactccgagggaggccacaactagtaggcagggcctgtggctctgtcctcaccttccaccatccttggccaggaagccccctttgtcctctattcccacatctgtacggcagggaggagcccaggccttaagcaaggatgcagggtgccatctctgaggatccctggggagggtgctgtggaaagaaatggcttgaggttttgtttgattgtttgtttgtttgttttgttttgttttttattgtggtaaaatatccatagcacacactttgccattttaaccgtttttaactgtacaattcggtggcattagttacattcacactgttgtgcaattatcctaaccatttgcgtccaaaactttgtcatcaccccaaacagaaactccgcccccactaacttctgttctatgatactttctgcctctctgaatttgcctattctagatatttcataggcagtagttccccttatctacagttttgttttctgcagttgcagctatccacggtcaacagtggtccaaaaatagataaaaatagtatagtacaataaggtattttgggccaggcgcagtggctcatgcctataatctcagcactttgggaggctgaggtgggagaattgcttctgctcaggggcttgagaccagcctgggcaacaaagtgagaccctgtctctacaaaaaatataaaaaattagctgagcatggtggcgccagcctgttgtctcagctagtcaggaggctgaagtgggaggatcacttgagccgtgggaggtggaggctgcagtgagccgtgatcgtgccactgcactccagatggggtgacagagcaagacccagtctcaaaaaagaaagaaagaaaagaataaaaaagatattttgagatgagggagagagaccacattcataaaacttttattataatataattgtattttattatgtcattgttgctagtctcttactgagcctaatttataagttaaacttgatcacaggtatgtatatataggaaaaaacatagtatatatagggtttggtattatctgccatttcaggcctccactgagggttttggaaaggatgccctgtggataaaggggagctactgtaaggggaattatacaacatttgtccttttgcatctggcttctttcacttagcatgaggtcttcaaagttcatctgtgttgtagcatgtatcagaaattcattcctttttatggtggaataacattccattgtatcgatataccacattttgtttatccattcatctgtggatggacatttgggttgtttccattgtttgttattattaatgttttatattttttgcatgtcccctggggctaggtgccagagacaccccagaaaataagagagcgtggtgcctgcccccacctggctcatagtctagtggaaaaaacaggcaagtagccagccagtaacagcagagagatggggacccataggacatattggacaagggcttggccacactgtgttctggtctcccctgagcagctgctaactttgtgacgtgggcatctcctttctcaggcctcagctttcccatctgtaaaatggatttgaggctaaagactgctgtgatgctaactttctacagttctatgatactgaatctttagccatggcattctgagggaggccctgctttgtttcttgggtaggacttggggtgggggagagctgcccatggcctcagaacttggtggggaaggggtctgagcatgtgaatattttcagcctggtgcttggcaggaggggggctctgcttacatatcggtgtgttgatactgactgccccttccctgcaggggtcacttgacctcccaccccgtctcagctgcctgcctggcgaggatatccaagcaacagtggggcagggaagacttcttgaccagcttggagctgtgcaggggcagctgatttgagggggccatgagttgagttaggattattttgggggtgtcaggggtcaggagttgaagcatgggaagtgggatgccagaggcagagacagccagaaggaataagtggtggctgggaggaacccacagccagggtggagacttcccgttaaaacagcccgttatcctggcaggagggagagtgcattcctttcccccaggagataaggaggccagattttcctttctcagggctcctttctagggtaggctagtgggggctctgtgggctgggctggggccaggtccctctggacccctctgcagggtcccagctggagcagctggagctcctggcactcatccaagactccctgcagccttggacaagcactgctgcagcagtggcagcacaacgtttgaatcccagttgcctctctgtgcctcagtttccttccctgaaaaaaatccatctacctcatagggtagttgtgaggcttcaatgagttaatacggtaaagcacttggaatgagtggtatgcagcggaagtagacagcactgttctcaccccaagatgcctcttgtttcctggggcccaggtgagaacctagtgtctcctcaagtcagattcttttcacattcttgggcatttgacagctctttccgctgtaggcctctctaggcaaaaatctcatctcagcttactgaccccaaggccattatgagaaaaggttcattaagcatttaaaatagagcccgtgttagcagatggaacaatttcttggttattagaaaccattcttcatgaagaaaaggcttatctttcctttcacaaatgaggaatccttagctcagaaagagccccgggactgccctcctagaccgcagggcatggcaggagctgctcttgttatgggacactttcagccccttccctcccaggccagggaggctgccctgacatcccccagtctggcctttcatcccctgggttgcccagccctgggggtccttcccactgtttcacaacagccagtcctcccacagggtggaggctctccccatggccaggcagggctctaggctgctcctttctaggcaggctgggcgggactcccctggccctctgggcaggtcaagccccacttcagatttcccttctggccactgttggaatgcccagccctccctctgtgtattttctctctgggtggggtcttaggctggaaaccctgtgcacatcctctctccaccctctctttgcaggaccaaagtcaatagggctgaagccagagaggagactgtggtccgaggaagactccaggctcacgcccaggactctttgggggcctcttcgaaacctatcattatttcctcttccaaatctccaggcagtgatcaatacaaagcaatacagcccgattcagtttaatttcaaaacagtccaacgcaatacagccgattcagttctatttcaaaacacttttattgaacaccaatagttgtaccaggattgttatgacccagttcaatgggagagcccaacagattgggacttgatactatctggactccaaactgtactctcaattagggttactgttccccttttgactctgcgtgtcttttgaacagttggcttcagctctgcacttcagtttcctcagttgttaaaacaggccaatgaattagaccatgaaggtttcctcatctctctgcccttccatgtaatctctcattatcggccagtaaggttttattaacatatggaactgtggtagtgagcttgtttcacggttctggagcacatcctgtatcaacaatcacagagtcagggaagggaggagggcatgttatggaagctggtttgggattttacctctgccattggaaaccaactgtgtatttggacagtgtgtcctgagaggcctgagagtgggcttctggctgggaagacttcagaattagaagggttctgaaaaatcatctcgtactgtgctactgagagttcgatctgcaggcaggagcgtggcatctccggggagctcattaggaaggctgggtctctggcccatgccggtctcgctgactcaaaatttgcgtttcaaagctccgagggaaaagggcttgtttacagtcccacagtgagtcctcgcataaccagggcccgaaccctggttcctgattcctgattttgccactgttcttgccttcctccacccagagatcttcagggtccttgtgcctggaagggggccctgtgcttcacgccgagggaggataagcatggcagggacttctcccaaatctatcctccttgagttcagttttgactgggctcctccctgataacctgtaactgcttcaccctttgcagctcccagaagaaaaaccccatccccagcccagggaggccaggcctgctgtgtttaattgcccatctctgtgcctcttagcccatctggggctgggcagtatctgagtgagtgtccgggcgaggatggggctgcttgggaaggaactcttgtgggtgacaagtggcaggatggggcccgtggacactccccttcctcccctttccgcggaccccctgggtcaggcagtttcggattggctgcagatccccgtctccgtgaggccgcgtctggcgaggtacaggtgctgagaggcgctgggctgtccagaggcggcgcgcgaggccgggtgcgaggtcttgcgtgcgcgccgcgcccacttcctttgctgaggagcctcgcgcagtctccggggcctaccacttcccccgacgcccttcgggcgtcgtcgtgcgggtcccttcccagaagcggcctctcctttccctttcctcgcagagccgctcttcctgcgccctccgagccccaccctcctagctccgtccggagcccttcctccgcgctggctattctcggttgcgccagcctctcccattgtccattcgcaggaaagggctgtctggctggtcgtcggtcgctggtccaggggtgggggacccagaagagagcgccgccggaagcccccgccgcggcagcagcccgcagcccgcagcccgcagcccgcagcctgcagccccagcatcatttttagaaatctcgctttctaagttagtcaacagtgcaacccgacgcccacagggaggggtatgacttcccgactccctcttctaatttcagcagcccccagcggcgtagggggaggggatgtcgggggcaccgcaggtgccacccagagcccctagcagccgcctacccagggcaagggtcccatgcccggctgctgggcaccccaagcagccctgctggagcagttctcagtcccactagtgacccccgctgcctgcctttggctaaggggaggagggtaggctcccacgagcaccccttgggagcagatggtgggccctgaagagccacagcccactggccgcatcacaagaagcctgaattacccgaattccgggtggaaagatcaagcctttctgcagacagagcttcaaggactttccctctgcctgttcctgcctgggtcttgttgtcatttgttctctgtcttacccgcaccccaccccacccccctttttgtttttgttcttcctaaaagcatacagctcaaactggaccaaagtatttttattccgtggatagagaaacagatgttcaggtcaaacccagatccattcacacgcagcagctgcaggccccatgcatcccaggccttcgagagttgaaagatgtcagatgacaggaccccagaccacaagactcagtttcaccagcagaggaattgaaagcccaacagagaggcaaagagactcttctgaggtcaaaaaacaagtgttggaaatccctggggaggctagacgtggtggctcacgcctgtaatcccagtgctttgggaggccaaggtgggagggttgctcgaggctgggagtttgaggttgcagtgagctacgatagtgccactgcactccagcctcggtgatagagcgagaccctgcctctttaagaaaaaaaaggaaagaaagaaaagaaaaaaaaaaaggaaattcctggggaatgactttgggatggattacagagggtcagtgtggtagatggaggcctgaattcactcagatgtggggtccaggacaggctgtgtcctcccagctgtgtaagctccagccagttgcataccggtaggcacatggtgttccacaggataggactcctgtctgccctacacaaatggggccgggggagatgccatgatctctgtgggcatgtttcctggggctgaaaggcaacctgtgctgtaagggggtgcagtgccagggcctgggaacccacctcctggagagaggcctggcttctgccaccgggagaggcagtgggtgaaatacaggcagatctggctatgtaaccctcggacaagctttttcacgttccggagcctcagtgtcctcagttagtcatcgtacaagtatgacattgtaaggtcttgttgttcagtggctggcacgtaggaagggttcagtcactggtcgctcagcattattttcagaagtgaggttgccctgtggtgtccttggagtgacctgcacaatctctgtgcacacagtcttggccattgcttggcaaggactgtggcatgaagacattattggctatgtcactctcagggctgctgtccactctgaggcagggcatggtggcagtcaggccttgggaagttgtaggtgcctcctggcgggacaatctcacgtgcagatgtagctgctagagtagaggtctcgaaccttaaggtccatgctctccagagaggcttcagaaatctgcccttccccaaaatggtatgcaaaatgtggtgtctatggggacagggaccatggtattcatcagactctcaaatgggggcaactaaaagaattaggaacctttgttctgggcatcagcaagtcaggcattaagagccactgtcggagggcatggcaggcggcatggacctcagccctaccctgggtgtgacccactgacctcacaccatgcttagctagccagtaccggccagtcagagacatgagtgcctcccctgggcacccactctgcataagcccaacagagagtcaaccatgcctgaggtctgggtgggccaccaggttcagggtgtgggaaagagacccaggccccagcaggcaggatggggaccagtgagcaagactctttggggactggctcaggacaggggaccgtgaggtggggtggtgataggtgaggggtgcaagtcatgagggcctgggaaaataggggcagaggaaatgaggcagggtccactgtgccagctttgggggctccttgttgtccactggaaagtggcccatgtgagggatgggccaccagatccaatgccctgcctcagtgcgcttggtcaaagagttagaaaattctctctgaataaggcctcagactgtgggtcatggaggtacgactgggggtgttctcaccctctctctcttttgctcagtttctttctttctttggtccttattttatttttcctgtcttgtttatgtttttctcataagccactcaagtcattttgggaaacagagtacaaacggaaagaaagaaaagctcttcatacatagaaaagctgacgagaaagtgggctttcaattgtgggatgttttgtttgttttcctaaaagatattttttgatgacaagtagattatgttcatttaaaaaaattattttgtcacccaaactggagtgcagtagcatagtcacagctgactgcagccttgaccttctgggctcaagtgattcttccaccccagcctcttgagtagctagtaccatgccctgctaagtgtgtgtgtgtgtgtgtgtgtgtgtgtgtgtgtgtgtgtgtgttttgtagaaggggtctttctgtgttgcccaggctggtctaaaacacctgggctcaagcaatcctcccacctcagcctcccaaagtgctgggattgcagacatgagccactgcactcagccctttaacttaaatgtggatgttttgtagaaataaaaaaagaaagtacaagaattgcctgtaattgcattatacaaacaaccacagttagtatttcggtgtgttttcttctagctgtttcttacatgtatagattaatacacctttttttgtatttatactatggcatccagttttctgaattagcatatagtatatataacatggacagttttctcttatactaaaaactctttataagcatttaaaatgtctcagttccacataaacatttagaacctcctctgattttttcattttttatttatttttaaattttaaaaaattgagatggagtcttgctctgttgcccaggctggactgcagtggtgcaatcttggctcactgcaacctctgcctcctgggttcaagcaatcctctcgcctcagcctccagagtagcggggactacaggcacaccccatcacggccggctaatttttgtatttttagtagagatggggtttcaccttttggccaggctggtttcaaactcctaatctcaagtgatccacctgcctcggcctcccaaagtgctgggattacaggcgtgagccactgcacccgacccctcccccgattttacattattgtaaacaaagcattgacacatatttttgtccatagcgttctttgcaaagttaagactatttcctagagcaagattcagaactgagcttggcttcagcccagagcaggctgggccagcagtagtgtgagtgtgagcgtgtgagtgtgagcgtgagtgtgagcgtgagcgtgtgagcgtgagcgtgtgtcagcgtgagtgtgcactttgtgaatgtggcagggctgcatttctcattggccctgcaagagatggcaactgaggcaggcccacgagggagccaagtgactcattatctcagcctgtgggtcttgctgaagggatgggcagagaaaaggcttcccagtgactcatctattgggcctgaaatccctctgaaccttcaggctggccagggcaaagcccttcaggcccagtgaccaaatattcccctgtgtcagggccgcccttgggcccttggagatgaatatgcctgatgaagtgttttctgtcctgcgaggcgggcctgccgggcacacacagccctccgctcagatgtgctttccgacctgcacattagtccagcttggctgagctcggttccaaggcaggctgggctggttttctcctccttaagactcatcagtgaggtcagccagcggataagctaaagttaacttagctattattgcttttttgttaatgaggggagggccagctacaaaaacgccaaaccattcagaaaagttgtacagcacttgggattgaatatgccagaacaaattctgtgttcaggcaaaataaagcaattgacaatgatttaagtcctgactggactcccaagggtcccttgtgcttccctgagatttcgtttcattattttttaaaaaaaatatttttcttatgaagttatgaatcttggaagctgtgtgaagtgcgggcgacctcattggactcatcagagtggcaggagccttcttttgtggatggaagcttgggctgtaattaagctccgagcgggtggaggatgaggcttggggaaattctgtccctgaaaccctagggttggctatggagtgacagctgaatacccatcctacgggactacaggggttgagggaaaaggagcagggattggcttctcttggacgacagttaataggaacaaaccaactccttctcagagacaagattcagaagcagaggctgaatatcctgggtgttcctgaaaccaacaacacttgacttgtgtcttaaaattccacagcccactagcatgttcacagatgctgttcaaagtgacctcctttgacaaagaagcaacgtgcctgcagggttgaaaccacttgaaaaaagtttgttaaagtcgatgtacaaaaatgtttaaaatgctttgaggaaatgagatctgagatgttcctgctatgaagtaggctgtgaacaagtcaaattgaaagtgtggaagcgagatgtgtccataggctgagagatctaagagaaaggttcttttcagcgtgacccatatttgcaacctacctactgtgcaccagtgcagtgcttggctctgggggatagagatctgcagacctggatttcatgcctcaaggagtttagttggggaaagtcctactgtggccagacctagcgtcaacagcagtgaggggggaggaatagattctgattagggagtgcttataaagcccaaaggagcaccatttgggctgagcttgaagagttggcccactacgatgcttagagatgtgggagaagagtctggaaggccaggagactgcctaacgaaggcaggggggtgggtgtgggtggccttcctcagggtgtggctgctggggaggagaaaaagcaagggatgagtagggagcggtggctgttgccaggttgtggaggctttgataggagtttggacttgattctgtagctattagggacccgtggaaggttttcgagtacggaagtaacttgcaaatatcgattaattttttaaatggaaaacaaacatataaatacatgctcattgaaagatatttcagctatattaaagtctatgaagcaaaagatgaaaatgctccccttcccagaagtaaccactgcttcctttcatgttatgtcatccatctgtgtctatgggatcagcacacaaaagtcaaccctagaagtgggaaggtagatggttctgcagacccgctctgtcgctgtgtgtcacatacatgcccctacctttccaatatttaaagcgatatatgaaatagtaccataatctagggaaatgtgtcctgtgtcttctcactgggcttacgttgctctccattgctttatttcagaacatggtttcattggatattcacccgaactgctacagaacaacacgctgcccgattacagcccgggggaatcttttttcactgtctttggggttttcttcccagcggctacaggtattgtaatctgggttcttttttactctcaaattaggggtatacattcttggttccaaaattcagcatcatcattggcctgcaggtactcttggtatgtatatccaactttagatatgggcttagctttgactaaaattttgttattttatctgtttatgtatgtattttgtagagacagggtctcactatgttgcccaggctggtcttgaacccctggcctcaaacataaaaatctattattttaacagagtttactgaaggccttcgatatgatttaatcctcctcactccttatacattgacaccttttgttcatagaaaggatacatatctcatagggctgaacaggacggattcctcagcaggacaagccgctctttccacaggtggaataagtgcatacctggaatcgaaacttcccttccccctacccgtaccagcacatcttctcccagagggcagagaaacactattgtcttttgttttcttgctgtatcaggtgtgagccaaaccagtatcgcgggggtgaggaatgaatctccttaccctcccttccccaagttcctgctctgcagtgactgtagaggagcctcccacagccaaggtccctgtagggctcctgccccatgcttgggtccctggcctggaaggcaataagctaacatgttgaccagatgctccataaaaaataacatttgctagtgactgggcttgtccccagggaacagactcttaatgaagagagaaaagcatttcactcttgatcaagagagtattgatggccagaggatatctgtcttgtctccttgtctctctctcctttccctctgccctcctacatatggccatttccttacttgttgtccccaccccaaatgggatagggacagaaaaagaaggagaagctactagagtgtctaagattgagaagattgtccatacaagtgttagcaaggatgtggagacaccagaaccctcatgcactgctgaagggaatgtaaaatggtgcggtgactttggaaaaaagtttgacagtttcttaaaaattacatccagctattccatgcctagttatctactgcagaggatcaaaagcctgtgttcatatgaagatttgtacatgaacttccaagcagcttaaattttaatagtcccaaactggaaatagcttgaatgttcatcaacaggtgagtgcataaataaactatgatgtagccacacaatagaaaaccactcaataataaaaataaataactggtcaggcgtggtggctcatacctgtaatcctagcactttgggaggccaaggcaggtggatcacctcaggtcaggagttcaagaacagcctggacaacatggtgaaaccccatctctactaaaaatatatataaaaaaaaattagcctggcatggtggtgcatgcctgtagttccagctacttaggaggctgaggcaggagaatcacttgaacctgggaggcagaggttgcagtgagctgagatggcgccactgcactccagcctgggcgacagagcgagactgtgtctctaaacaaagaaaaataactatcgatacacacaacaatataggtgaatctcaaaataattatgctgagtaaaataagtcagaccaaaaaaaaagcaaataaatatgattgtataaatttccatttatatgcagttctagaaaatgcaatctatagtgacagatgcctgggaatgggagtgagaggagcacgaaggagggattactaaagtgcagaaggaaactttggggggatgaaaaatatattcctggcctggcgtggtggcttgtgcctataatcctaacactttgggaggccaagacaggaggatccctcaagctcaggagtttgagaccagcctgggcaacatagtgagaccctgtggtctctacaaaacatgattaaaaagttagctttggccgggcgcagtggctcatgcctacaatctcagaactttgggaggctgaggcagccggatcacctgaggtcaggagtttgagaccagcctggccaacatggtgaaaccccatctctactaaaaatacaaaaattagctgggcgtggtggcatgcacctgtagtcccagcaactcgggaggctgaggcaggagaatcacttgtagtgattctcagctacttaggggtgggaggtgggtgacaggaggactgcttgatcctgggaggtcaaggctacagtgagctttggtcacgccatgatactccagcctgagtgacagagtgagaccctgtatcaaaaaaaaaattgtgtgtgtgtgtgtgcgtgtgtgtgtgtgtgtgtattcctgattatagtgatggttttatgggtatattcatatagcaaagcttttcaagttgttacactttaaacatgtacatcttatagaatgttagttatacctcaataaagctgttaaaatgaaaaagacaataactttaatcatctttaattgattttcctcaatcccacttttccttatagcaatagcctttccctctcctcttcaaagccaaacaacatggctccccatgtccattcttgtatcccctactcaactctcccagtctctcctttgggaattgcaagcctgtctctgcaatgacatggctctttcaccagtgacttccttgttactaaatgcagcgtgcatttttagtctctcactttatttaactctcagcaacaacccacttccccttgcatttctcttgccttccacgatgcaggcttctcagctccctcctactctctgacttgcctttataggtgcatcccctccacctgcctgtccaatgttggggatcttcaagctattcctaggccctcacatctctttctcaactattttccttggagtctcatccatgcttattgttgaataaccaccctcaaaactggtgactccaaaatttacacttccagcccagacttctcttccaagcttcacatcatacattcagttgtccatgtgacatcttctcttgggtatcttggaccgaacaagtttgaaccaaacccatctcacctacccctcaacttgtcctcctcctgtactcctgatgtcagtaaatggcacctccacccagccaaatgcttatgccagtgatcagacctccctctttctttccagtgccctctaagtcttgtcaattttacctcctaagagttgctagattctctctacttctccttatgtctaccacctgaccactctggtcccagcttcatctatcacttgtatcactgtgtcagcttcctgcctgacttttcttaaggctcggccatggaaatgagcctggaactagggcttggaagtggcaggtcgaatcctggtctacaaatccagatttgccagaaatagtgcgtcgctttcatttttataaaacaaaaagagtcagtctccgactctaagccttcattctgccaggatggcttaaaagtaagagcagtaattcagcatgcctccacctgctcctgccatgctctgcaccagctccaggggcttagggttttaaacagtacccagacatgtttggggggctctgcaattccttatctgtaaacagaaccaggccttcccattgtcctgtccatagggcctttcaggtttgtgctgcctctgagccacgttcaaggactggaaatctgagattgggaaccctatgcttagggtctatgtactccccaaacctttccttctgggggtcttaccggctccccaccagtactgccagggagttggcggggtgggggttccaggtcctcatttccccagaacctgggaacagcctctctctctccctgcccccgactccagaaccaatcttctgtcaaatatggggacactcctgtccagggccagctttctgggtgtgtgacctatgcatttacactgtccccaccctgagaagggactcatgcttgttttaaggctttgctgttactaaaattcttgggcccggcctggtggctcacgcctgtaatcccagcactttgggaggatgacgtgggcagatcacttgagcccgggagtttgagaccagcctggccaacatggtgaaaccccatctctactaaaaatacaaaaattagccaggtgtggtagggcatgcctgtaatcccagctactcagggaggctgaggcagaaaaatcacttgaacctgggaggcagagattgcagtgcgctgaaatcgtgccactgcactccagcctgggtgacagagcaagactctgtctcaaaaaataaaaaaaaaatcttaataatttttgattctgcatttgtatttttatgtggccccacaaactgtgtgatagtttttctccttgtcgcctcatgttttccccagcgattctgctgtttcttttctgtttccctccaaaatcttctaaggacctaggcttttgagaaacagaagccaaaacagtgcacaggcaaattctgcttcctctctgcctcttgtctcccacaagacaagagaatataggtcagcttcctcctgaatggacagaaaaggaaaagggaaaaacagagggaattaaacaaagttaacatctgatgatgtttcccagcctctcttcctctttccttccacacacaaattgaaaaccatctgagtgttctctggagcctggcagtgtccccactgagtgaagacccctgggccaagataccaggttagcatttaccctagaggcagggcagaaggcctctttgcctggtcacactgtgcagggaatgtctcgggcgtcctcaggtgcaccaggggtttgtcttggcaatgtggccctgatgtgcccctccactctgctcccacggctggctttcctaagagagaggatgcctggtgtgagtgggggaagggggcggtgagcctcccctccagcttctccctccaggcaggagttagcagcagcctgaggcttgaaggtgccacccagtagcccagagtatgagctggactcacatgtgagatcagctagtccaactcccaagcttttgtctttttaatccgtatttctttttctttttctttttctttttcttttttttaagacagggtctcgctctgtcacccaggctggagtgcagtggtgtgatctcagctcactacaacctctgcctctctggttgaagagattctcgtgcttcagcttcctgagtagctgggattacaacagcatgccactatgcctggctaatttttgtatttttagtagagatggagttttgccatgttgtccagggtggtctcgaactcttgacctcaagtgatccacccgcctcgacctcccacctccaaaagtgctgggattagaggcatgagccaccatgcctggcctatattcacttttgataatgatactaaaagcctcacagacactggacattctggctcagagatggagtgtcgttgtccttccgctgaaaaagctatagctacctaagacgatgagtcaagatttattttctgtgatttaaattatgagtattattttgaaagctttcaaatgtaaaatgataatagcgcatagattgtaactacacaggcctctctgccccacccctcttaggggacctgctttcctgtccctctcactctcattggcccaactgaggtgaagaatcattgatctgatcctttattttaccagctggggaggaggggtgcagaggagcttatgaaggacccgacagaggtcacgaagctgattagtggccagagttgggccgtcaccctgctgtggagagctgccctccgtgtctctgtctctgtttttcagggccccaattgtaaacacaataggcaggacgaatggtttgtatgacttgctgtctcctggcagatgttcggttaagctatgaaaagcatggatgattggcagtttccatggtgatagatttgctaaggattagctccgagtgagtcatggctggggttccctccaacaccatcctcttctggaacaagagaacctccagactgtggcgaggagagagttttgatgaacaaacccttctgtccccagccccccatcctcctgacagagatatgatggttaagttacttcagatattttatcccaagggcaggcagcttcctgggaagagcggctggagattcggtctggtgctcctctggatttaggaagctgtccccctgccccctcactgcactcttctccattacaccctgtgctggtggctgcaggggtggagtggggggagcttggagtggatgctgtacttgctttgcttcttaaagtgcattccttctcaaagtgcattccttctccaagctccactaccaaactttccctgagaagcagacatctcctctccagggtttcacacataccatgtggatgcagccactccagggatccaggaacacgattcacagaggaactaggaaatggaaattcactgaaaagaatatcagtcatgtgaagtcctgtaacccttgttcccagattctaaactcttactggaagggataagggcctctttggccacagccaacacatgggcctgtggttgaccacacccagcacgaaaaaatgtggtaggaaacctacagcctttactgaaatgtccacagtcaccttccttttcaagaacccagctatttctgtgatgccctttgacctccctgggcctgactcctctctcctgctcatgtacacaccctgggaagctctgggaatttgctgggccctccaattggctggctgtctccaggcccctcagcccggctgttagtgctcacccctcctctggcctacttcccccattcccccctcctaggcgtcccctgggtctcctcacaagttatgtgtcttgtgagtgagaggacaagaacctgctggatcagaatggggttcccatgtttaaggactagagagccccaagtagggacagtctgaagatgggggctcactccactcccttcattctgatggacttatgggcagaaacaggagacaagaaggaagctttggctgggtgcagtggctcaagcctgtagtcccagctactcgggaggctgaggcaggaaaattgcttgaacctgggaggcagaggttgcggtgagccaagattgcatcactgcactccagcctgggtgtcagagtgagaccctgtcttaaaaaaaaaaaaaaaaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaataaaaataagcttaggccgggcacggtggctcatgcctgtaatcccagcactttgggaggttggcgggcagatcacgaggtcaagagatcaagaccatcctggccaacatggtgaaaccctgtctctactaaaaatacaaaaattagccaagcatggtacatgcctgtagtcccagctactctggaggctgaggcaggagaatcacttgagcccgggaggtggaggttgcagtgagccaagatcacaccactgcactccaatctggcgacaaagtgatattccgtctcaaaaaaaaaagttttataattattatacatgtctattttttgtaattttatttatggaattaatttataattgttttatcaaaataattatacatatcaacagtttttatcaaaacaattataaatatcgacaatacttattatcattacaataacctattatgtcagccactaagcactttatgtatagttttctgtttaaacttctccacagcctgactggttccatcagacacagggctgccatgaagtggttgaagcctgggcttcaaggtccctcacttgcgtgagctccttccaaagccttgttcctaattttatattcataattttgtactttcaaaaaaatttcaggccgcatggaacctagatcctcccacaggttctattatttacccattttacagatgaggaaacaaagatttagagaggttatttccccaacatctcccagccagtaagcggtaaaccccgttgcttcccataaagagagaacacataatgttggtgccgcccctcatccagaagccaataaatcttgcctgggtcctggagttggaaagttgcattatttgacactgtctgtcccagcagcatctctaaaacattgagagggagggaaactcacaagttttgctccaagaacagagcaagacaggtttagagatttctgcaggaacagctgaacaaaccaaccaacaagccaggtatgggaaaggaatggggtttggaaatcagaaggaaggtaaagagaggcagaccagtctttaggaatctgagggatttctgagtaaggagcagagcccatctctcctgggtgagcatttatttagcacctacaaggtgccagccactgtgctaggtgcttatgaatatctgttccaacttcaccacagtcctgcaaagcaaacagtataatccccatttacaggtgaggaaagcagggctcagagccacattgccaccaaacagtaatagatcccttttttcagttaaaaaaaaaaaggcagcagatgagacttgggcacgttagtgcatgtgtagtctaccttcataagaaagaaaaataaagttatgaacttagaaaacaggcagcagagaaacgattaagctataaatggaaagaaaaagttgaagagtttctgaggacacagatttggattgaaaagtccccaggaggaatcttggaagttccttgagaaagagtaagtagtcctttatgaactaacaggaacctgaaaagcctagaaaaactgttgggattttcttttcctactaatcttcattttcaggaacagaaaagggaattggggtgggaaacgggcttgtggtaattggtgataagtaaggactttgatcaatgtgtgccactgggtgattcagggggcagggaagaaaagagatgacctacccacttgcaaatgttggtaagtggtcattgacatttacactggttattttacccaaggatatatttttgagagctataaggggttgattcattttctggccctctatgtcttctgtgagaccagacactggaagtaggcgctgaccccaagtcccctgttcacctggtgccatccatcgaaactgtaggtgtgatgtcaatgtctaggtggctacggatgccactcgaggtgtagcctcataaacctaagctggtcaagtgatggctgacaccttcagacttgcatatcaaaactgagaccataaatatgtgcctgaaggccccaggactggggtggaagaccaagccagaaggctttccccatattaaggaagctgtttacctaagtcacatggtaacagtgtgcagaccagacagatcatcgttgtgatgcagggagaaaaaatgtttttgggtaaagcaattaactgcttcctggaattggcgtttaaaacccagaaatgccatcaatccagcactgtctagagattaggagctggtgatgcaagtgcctgtggcgaaaccaatgcatcgcgccgattataactgataagctcagccttcttgtgggtatgtaaccccacattaatcatgcaattactatttcagaaggggaaatctacaaagagcaggggtgttaggaagaaatggagaggctatgtgatgtagtggaaacaacactgacttggaatcaggaaacttgagggttagtgctggttctgttagcaattagcttggaacacttgaatcaaatggcttcccttctttgggcctccgttgcctcatctgtgaaataaaaggttggagtagatgatcgctagggtatcacctagatttaagaatcatgattctaaataactgttttattttttatttttattgtttttgagacggagtcttgctctgtcacccaggctgaagtgcagtggcgtgatcttggctcattgcaacctacgcctcccagattcaagcgattttcctgcctcagcctcccaagtagctgggactacaggtgcgtgccaccatgcctggctaattttttgtatttttagtagacgcggggtttcacaatgttggtcaggctggtctccaactcctgacctcaggtgatccacccaccttagcctcccaaagtgctgggattacaggcatgagccactccatccagtcctaaatagccaaatttaaacaatttttggaagcccgccaagaaaagtgtcgagaccaaatagtaattataaaatgggcactgagtgtttcccaaactgtgctctgtggaactttaataatgaagaaagttttcatttctttaaaaaaaaaaaaaagggttcaatgccaaataagttttgcgaaactgtgtgctgtatttctcttcttagagatggacaatgaatattagcatattataggcactacaatagcccagcaccgaaaacctctctaattaaggttttcccaaccttattttcaattgtggaactttttaaaaaatgtaatatttgtaaaacacctgggcactaatgctctgggaaatagtatttgttctattacgccaaccctaaatgtaactctaaccttaatgatagtgttttaaaattgcactggatgcaaaaagaaagcaaactagagaatttctgtgacacttaacacagacaggaaaaaaatactaagtcaaaataatttttctagctctaactagtgaatgagacatttataattcaccgaagctagggaacattgcccaagaattgtgtggtaacacagaggtagaattttggaaatgacagccacagtgtgtgagcccctataacaaatgtgcaggccaggcacggtggctcatgcctgtaatcccagcactttggaggccgaggcagtcagatcacctgatgttaggagttcgagaccagcctggccaacatggtgaaaccccatctctactaaaaatacaaaaattagccagacatggtggaaggtgcctataatcccaactacttgggaggctgaggcaggagaatcacttgaacccaggaggcggaggttgcagtgagccaagatcacactattgcactccagcttgggcgacagagggaaactccatctcaaaaaaaaaatccaaacaaacaaacaaacacaaacaaatgtacactttgctgtgggaaccacccacattgccccagcaggaatcacccgtgagacttcttgtctgcagtccgagttgcctgcatctccttgtttctggctctttgtgtctgtgatataatctactttctggcttctctgttttgtctcaaaagccaagtttctggccatatctgggcctggctcattcctgtgtcacggtcagtcctttctcctcccactgagcagcatcctaatgtactgcacaacaggcagcctacacagaacctgggggaggagtaaagggggtttgttatggagacagtaagtgtttggaagcaggaagcaattaggatgaatcagtcattttcctccacagaagcatatattgctgtggtgttctcaggggtcttcatgggttaacttctgtataaaagatctgaaggaaggtgtacaaaatgacctgacaaactgtaggaggtacaacaatggcgaggaataaagagcactatgtcatgatatggtttggctctgtgtccccactcaaatctcaccttgaattgtaacaattcctatgtgtcgtgggaggaacctggtgggagggaattgaatcatgagggtgagtctctttcccgtgctgttcccatggcagtgaataagtctcacgagatctgatggttttataaataggagttcccctacacaagctctctctcgcctgctgccatgcaagacgtgactttgcttctccttccccttctgccatgatttgtgatgcctcctcagccatgtggaactgtgagtcaattaaagctgccttagcctcctgagtagctgggatgtgtgtaccaccatgcccggataacttttttattttatgaagagatgctgtgtggtccaagctggtctcaaacttgtggcctgaagggatccttcttttttttttttttttttttcctgagatggatctctgtcacccaggctggagtgagtggcatgatatccgctcactgcaacttctacctcctgggctcaagtgatcctcccaccacagcctcccaagtagctgggattataggtgtgcaccaccacacctggctactttttgcatttttagtagagatggagtttcaccatgttagtcaggctggtctcgaactcctgacctcagatgatctgcctgcctcggcctcccaaaatgctgggattaaaggtgtgagccattacacccagcctcaagtgatccttctgccttggcctcccaaagcgctgggattacaggcatgaaccaccacacctggcccttaaatctgttgcatttttaattttaatgatcatatttttaatttccaaaagttctttgttgttcttggattttttttcatagcaccttgttttatagatagaatattcttcttggatgtacctggagctactaattagtgttttcttccaaattctctctgtatcctgatttatgtttcttccagcctgggttgttctgtttctatttatgcgtgtatttgtttatttgttgctggttttcatcacacattgggtgatcttggttgtgggcatggatttccccagctgtcgcatggttaggtctgtctccctgctggggccctaccttgatgagaagtttgtgagtgctgttgattcttgagcagggctttatttggggtgcaaacgtccagccctggttttcctcagtgtattgagatcttgtagagaagcattccgaggctttctttccttctcttttcctcggtattatattctccattttctatgttctatgttccagacattcatgggaacctttcatctacttagggtcctcctcccaacttctctttgcttatgggaatttatctacttttcccctttactatgctcttaataggatcttggagaggagggaatgagaggaaagaaaatgtgcctaacaggccgttaaaaacaaaaacaaaaacaacaacaacaaaaccttaaaagttttcacgtttcaaaatgatcattgtagaaaattgagaaaatataaacagtcaaataaaaatgacctgttcttttatcacccagaaataacattgttaatgttttaaaacatgttccagttcctttttctatatatttttataataatgggatcataccatgtgttctgttttctaatatgcgtcttaaaactaagcaaaagcttctaaacatctttccatgtcacaacatatcccttacaatattctgagacctagtatttattgaaagctatatcatcacttatttaaccaaccctctatttttagacattaggttgtttctaatttccactattctaaacaagcgtttataaacacgctgggctaaatcttccctcatagccttgactacctacgatgggtaaagtcctcatagtggagttgctgggtgacagtatatgcaccccatccgcgggccagcattcagggttctctctgaaatacacccccctactttcactttctggttccaaactgtcacttcactgcacttcgcttggattctgtgaagcattgtagcagaggcattaagagcataattttcagagtcagacagaccagggttgaatcttagctttgctgcttattaaatgtgtgaccttaggctgttttaattaacctctttgaacacttttccataagatgaggaaataattctacctttctgatgaggttgttatgagaattaaacaggataaaaaaatgcatgtaaagcacttgacacaggcccaggcagtttgaaagtgttcacaaatcatggagttagattcattcccatccctaagcccattcaaatccctctttcaaggccacattcaagatacaaccccctccacgggtctttcctgaccagggcagcccatcacactgagttgttatggcacttgtgggctggatcctcatccgatgttcagaacaccctgtcttgttgctttcatatatttgtttgtatgggaagaggcaacatccccacttcaccatgcagcactgtgctgtgggtccctcatggattaattcattttcattagtgttcttgcagaagagaggtgatgatgaaaaggagcttgtgactccatgtcagtggcatcaggattggtttttttggagtttatttcaagccctttggtagctcaggggcttggaggatggtacctgaccccgaggacacaggaagctcccatggaatcagcaggcagcagaggcagggaaagctgctgagcaggaggctgccagacctttgtaatgctgagcctctccagggcattgtcccagctcagcaggcagcgcaggacctctgtgtgccttgcaagccgctttcctcccccctggttgctttgcgctgagcggtaggatgcttttggagctgggagggctttcctcctgagcctcctccaacccacaaaggtgcctttcacgccacagggatgcctccctagttgccaggggagattgaaaagcagcctatgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccccgggctccctggcagctgttggcatctcgtaagttcccctcatggcaatcagtctgagctagagagtgggagagaaaaccccaggcagaagagggattgccccttttgttctgagagtgccccgactgtgaccaatctatttcatattccgatccttcttttaacactcggtgggctggaaaattcacgtctggtgggttcagacactgccctttcatgcgccctgcctgggaatgctgccgaggaggagtgtcgggacccagatcacagatcgaatcctttctttcctttcctcggcctcccgcccccgtccctcccccacccccattttgaacttggggatttttttaaccaccgagtttccaggatcactggagggagcataaagatgaagagttttgcaatcagacgaattggggctgcatctcagctctgccgctgattggctgcatgactctggacaatttactgagttctctgagcctccatttcctttcttgtgaaatggggataatgacactgtatgtgcttcctagattgcggcggggagagaaggcacacagtggaagctcagcacccagctcttcttcttcccccagtgagcctcccctccagctcccccaggccgtcaggcctctggggttttagttcacactgtgccacccacacaagcaggctgggtaaccttgggtctatttctgaccttttagaatattgtttctctctgtaccacaggaagaagcttctctgcccttcattgggtaggtgtgaagaggcaaagagatcagagaccagaaacaatgacttgagaagttaaaagggcctgtgttattctaaccacagtatttagaaaatattaatgtatctgtttcacaaacactgaatttgttcttagcttactgcagtgaaaccattgctatcagcctggcgtacagcatcagggtattttgtgcaataacattgggaagaaaatgaagacaacagagatagagttgagtgttgggaaggaaataaaagaaagaggcttctgaatgaggaccctgtcttgtttctggccccagctgggaggttccaggaggaacccttggcccatcctctgattacccagatgggaatgaggagaccacaggaacctgggtcttgttcaaggttacagggcatcttggggacagagccaggcctctgctctctgccttttgactttagtttccctctttattatctgatccaaagataacagaccagcaggacttagaggcccgaaggatcatcagcttgttcttttgctggaggaggctggggtgtgaggctgcggggcaaccctggcctgaatcctggcaacctagaggcaactgggcctcccacttccctactcggaatgccctttgtatgtttttcttttttaatataagaaagagaaaaaaaactgctcacttcagcagtacatacactaaaattaaaacaatacagagattagcatggcccatgtgcaaggatgacatgcaaattcgtgaagtgttccatatttttatatatatttaaaagtaaaaaaagaaacaaaacaatggtaccccttttttggtaagaaatatgccagaagagaaatagtacaaaaagtgtcctcccaagccagctggggaagcttcatgactggcctttctctcattctgatacaagttccctttggaaacagaaggttgagtgagggaattggatggggctgggtgaggtgagtcgggggcagctctgttctgctcttgggttttgcaggtggtttctgtacatcatcttcgtcttcctcctgggcgccatctgcactcgagaggcccttcgctatgacttcctgatagcggaaaaggtgagtgaggcctgcgctactccaagggctcagtctgccggagtcatttatttgttctcaccaacaaatggccaccttccccttgcagtactgtctgggaatccatatagtctttttaaaatttaattaatttattttttgagacagggtctcactctgttgcctaggctggagtgcagtgttgcaatctcagcccactgtagcctcaaccttccaggctcaagcaattctcctgtctcagaccgccaggtagctgggactacaggggcatgccctcatgctgggctaattttttttttaattttttggtagagatgaggtctcaccatgttgcccaggctggtcttaaactcctggcctcaagtgatcctcccaccttgacctcccaaagtgctgagattacaggcgtgagccaccacgcccagccttcatatagtctctagcccaggactgaagtgttgggttgtggtggggaagagacatgatggaaaaggtacaggccctgcttagggatttctagaaacagataatgatgcccagagggattcacaaatatgaggggctagataatggggacatctcttcctgtcaaaaatcaggacagaaacagaagaatctgctcaccccaaattcccagttaagcaagtgcctcacttttgctaatagcttcaccttccacaatgaatcaaatgtgctgctcagaagtggcaagtggagaaggaggctggacaggcagacgtggagggagcgggcggaagcccagtgccagggtgagggccgaggccctccttgtccctcaggtccttgacccctttggctttcctgagagtctcagacattctgggttgatttggctgcaacatctttgtttctagagtctgcaccctgccaggagaagattaatgaattcctggcattggctggaggtcatctgacatcaaggacatttatttggcatcctagaagccacatgaataagatttccagatatttttctggaaatccccaaaaactcccaccctcctttaagttcttggagaaaaagtagaccctgagattcccatcatttttcagagaaatgtagttggttagggagtttttctgtgaactcctgagtatcactgcttatattttatgtattttaaattttaatattttaattttaactttttaaagacagggtctcactctgtcacccaggctagagtacagtgacgtgaacatggctcattacagcctcaacttccagggctcaggtgattctcccacctcagcctcccaagtagccaggactacagacatgcaccaccacacccagctatttttttttttttttcaattttttgtagagacggggtttcgccatgttgctcaggctggtctcaaactcctggctttgagtgatcctcccacctcagccttccaaagtgctgggattacaggcatgagcccctatattttaggatagactaccattttctcttggtgtgaggctttgcaaagcagccctgctggtcttaatggagggccagtgcctggggcaacctggggcaggaaactctgaattttcttttgagagatatgtttgagcttggttttcacattagcacaggtttctttttaaggcttgtaggcacccatgcaaaggtgattatttgttttcaagggtcttgcccttagtataaaagcagattttttggaaggcagtacagttcagttagtgagagaactgatacccactttccagtacccaaggtcacagacccccaggtggcaaggtttgctctcagggcaggaatctatagccctcatttgtatctacatgcatgcttccgtctgaagtttcactcccaagggcctgttctctagttgtggaatgaaaagcttggctgcattacaggaattgaaggcctcagggagcagactgggtgaggctggtttgaccgagggaaatgcttcctgctcatctgcagcttgccagtggctgaccagctctgcctgcttctaaagttcctttctcatgctttccttcacagaggtccttccaccctttagggactctgatctgattatcccctgggccgcagctctcctccctcctctccttcccctgtttttcaagggaatgatcagagtaggtatatgggagggcaggcagctttgtatctaaggaaggccacaaacagcagtagggtaaaaacagcccagagacagcacatgagagcctttgtgggtggaaatcccacacctaatgataggcacacaaaccgggggagcctcctgtggaatgccacctgtcccgacaatgagcaggtaggcaagcacttagccagctgggggcacctgcttcatcaggcccagcaatgacacttgggaatgtaattatgcacacactgggatgaaatgtggagatttagttttcggagaggacaagagaccattccctggaagagaccattgtaaagcctataaaggaacaaagctactgctcttggttctcagtagaaatgggcaggtgcagcaagtcagtaagcagtgatggaaccgaccctgatgacttcaaaatagcagcacctgggtcttctggttcccactacccaccccctaaaggggaccacacaggagtttcctcccacaccttttctgctttcctgctcactggtgtcgctccttgggactgactccgctgcagtagcaggtaccgtgctcaggcagtagattgggccacagatgtttttactggcagtacctggagaatgggagggtgcaacctacactggttgggaggtgcaagggcggagtttctttactttggtcacttgacacaaccggccaccctgataacctgttcacctcagcttcctgtcttacttgtggcttcagttctgagccggcgcatctctgagctttcctgggcctgaaaaaaggcctcttctgtatgtgtgccccgcgcatcacctctggacactgagacagggtgggtctctgacatactctccttggcgctcgttcacaagcagctcccaaatgcactcctctctctcgggggctttctgccagaacaattatcttcaatggctgcaggctgccctggattcctttctactgatctgcagctggtcagttaatctgtttctttctgggtttcctgcagcttctctgatctatttctaattatttggcttctcaactcacagtttctctaagaagcgtctttttactttttttttttgtttgtttttcttgagatggagttttgctcttgttgcccaagctggagtgcaatggcatgatctcagctcactgcaacctccacctcccaggttcaagtgattctcctgcttcagccccccaagtagctgggattacaggcacatgccaccatgcctggctaattttttgtatttttagtagaaacggggtttcaccatgttagccaggctggtctcgaactcctgacctcaggtgatccacccgcctcagtctcccaaagtgctgggattacagggatgagctactgcgcccggcgacgtctttttactttttatccccactgcagaggaactttctcccagctctcaggtgtatgtgtgttcttaaacatcttgtatacagtggtggctctgagataacccatgaaagcatgtagtaggtgctaattataatacattttacctggcacatagcagatgctaactaaattttaactcccttccacactccttatgggcatacccttacagatcaagacatttattttaggaacacattttctccccacaaatccaccatatttaatagaaaagccagaacagtcaatctcagtattatttagttagaaaaggaattgtataaacagtgttagttggggtgaaattaaatagattaaatgtttcagaataaactcgtatacagtccaggaaacagatgtttattacaaataaaaaaggccaaataccttaggagccctggggcttgctaactagcaaaataagagcaatctaagaaggaaaaatatcccaaaagtattattgttaagactagggaatctgggtggttcatgcctgtaatcccagcactttgggagggcgtggcgggcagatcacttgaggtcaggagttcaagaccagcctggccaacacagtgaaacccccatctccaccaaaaaatacaaaaatatgccaggcgtggtggtgcatgcctgtagttccagctactcgagaggctgaggcaagagaatcgctagaacccaggaggcggaggttgcagtgagccaagatcgtgccactgcactccagcctgggcaacagtgcgaaactctgtctcaaaaatacaaaacccccctaaaactgggtaatcccacagagcaaactctgattcctggatttaatagtcatggtttcacatattcaagagggaccttggaagctcatgacacaagctgtacagggaagatggggatgggacagcgctggtaactggggagtgagcctagtgggccactcagcacctgggagtgggccagcctgagtgtcctctgccctccatcgtggacacagtcctgcctctcaggaagggaagcagactaggtctcattatggaaaatggctctcaagtgagaggtaaaacttgactgaaagttgagatgttgatcaattcatggagcgtggagatgttaggaaactcatgactctagaaatgagatgtgggaggaaaaaaagcgttgttgagactcggccttattaatacacttgggattgtaaaggtttttagggtgcactccccagttatgtcaggggtcaccgcaattagatgagacagaatgagcgccttgcaaatgactttaaatccagtcctttgagagaagagagcagccaatgaatgagcagagtccctcaatgaccgaagctcaagtgggagctgggagaaaatactaagagcagagagatggaagtaattattttcatcagtagttactgaagaaagaaatcagggtagctcacaccccatgtaatattttggaaagagctctgggggtggggggatggctcaaacaggtgtatgccagaaaagaatcactgtttatttaaaaagagctgttgacacacctctgctcaaataaattctcacttccacctccactggcacatttagcaaattttcagtctgatatgaatagagaaaacaattaagttctgtgagggctgggagcagagctacgtgtctataagccttgctctgcctagcaccatgccaggaacataatctgtcgtcaggaaatgcttcctgaatggatggatggatggatggatgacaaatgacagaaagagataggatttaggcaggagagagatggaatgaagtttttataatttatctagatgtggagaccaacatttcatatattactcagaaaatagactgaataatagttttatatttttttaaagtggtaagtgaacagatcattctacacaattgacaaactggacataggttgctatacttggccctgtctgaccccagctcctagggctctggaggaatcccagggtgtgtctgtgggaaggctggccaaagatggaagccaccatatcgtgtactcatggtgccagaggctcaacccagttcctgaggtcagtccaacactaggaggatgccaggctggggcattcccactcattcctgctgtgagtaaataggctttaaatgaaaaagagttgtaaaaattcaaatatacataaccttttaggtaagaagcagtgaaatttctgcaaggagatgccatgcctgactctcccaaagaattttttgaggggagaatgcagtggctacaatgtgttgtgcccaggggttctccacatcggctgcacattagaatcacctggagggctttcttaaactcaaccacgtctgtgtctcactctacactaattaaatcagaatctctgggtgattcttatgtttaggcagagtggagaactattgacttaaattttcaaaaggctctttcttgataaaatttcatcatagaatctggtttttaaaaaccagtcaacataggctgcatttggtagagaagacggaaataaaggttatcgatgaatgatcacatctcagaatggattgaggattgataatggatccagcttatctaacagttttgtaaggcacctagggcacgattacagcaaagtcatgaagctgcatgaattcagctgttgagctctgcttgccagattctgcatgaggtgctgggggaagggggccaggaagcatgatacaattctacctgtgaggtgctcagggtgctggcaggataagccatgagcataactaactatcccacaggatggaaagtaacaaaatgccatcagatcacataaagtgatggaaacactagatgacattgatttcctgtagtaataaaatggtgagtggggtgggcaggacaaacccaagaaatctgcgatattgaaaaaagagacaggtgagattctttggggataagcatgagatgataaagaaaggaatcaacagtgaattaaagacaaggtgggctccgtagtggaccttagtcttgttcatcaagcatctgaccttcctgaccatttgggggttattccaccaatggtcttgaagggagagagtacccccattgtgtgtaatagaaacccaatggaccagacctcttttgcctgtccctttgcagccctggtagggcacatgacctacactaggccattgcgtgctcccattgtaaccaatgaagtaaagataaagagctggtgagaatccatccacagggcagcaggggtgttggcagcatcctggccaagctgttcctggggaagaggctgggtgtgcctccaggcttggtcctgcccttttctgagcctcatcctttagcctcctgatgattctacaaaccaccagtgtcctacaaatatattcttttttaaagaaattttttttttccaatcaactgtcctgactgattcatccatcagtcaaattattccagtgataatttatgagccaggaaagaagtctagccagtggcttgtgttcaatgtagcttggtgacacgaatccggtgctttgctgatgcaaggaagtaaaaaatggggtgaggagagccttcatcaagaagggtgtaagtgacaaagctgaatattaactctaacctatctgtaagcattggacgcatgagtacttggaatgtacagttctggccattgtgcctaaaggaaagtagaatggaaagggcacctcaaataagaaaacaaagatgctttcctgtgggtacagatgagatctggcccaggagggtgaattcatgagtgacagcttgggatctggctgtgcatggcaagcagtcatgcagccacccagccccttagcacttttagccctgagttagctagtaacatcttggaccctgatcttttgcaagttgacaccaagaagaacagctgtgccctcttattctatctgttggtgccttgtgggtcatggatctcattcattcattcgtcatttatatttctgtgttgggcaccaagaattctagggtaaacaagacagaaggcctgcttaaatgaagcctccagattagtggagggggcaccacgataggtgctatcctaacatcatgttggggatgctatggagcactgagaagcaactactgtagtcagggaagaggggatggcctcacagtggaggtgaggttggtgctgagttttgtagcacaattaggagtttaacagacaatgagtagattagggcgtgtgaacagaggcttcctacagacagaaaaatcatgctgatcagactttcagtgtgcagggtgtggagctaaagaggtcacagaccatgaagagccttatatgtcaggacagggggagattttgatatatctgcaacggagacattgtggtcagatttgagtttagagaacagaggcttaggggatgattcagagtgaatcatctgaagatttaaactcatctttaagggtgagcttaaaggcaagaggccaatgagcattgtggttggccagtttgttctcaaagtgtggtctctgggaacgcatgcggaatccagatttctaggccccaccccaagcctactgaaccaggaactctgaggaggggcccagaagtttgtgtttagcaagccctgcagctgagtctggcagacgcttcatttgaggaccactgtgcaatccatatgaaatgtggtggtggattcagctgaaaccatggaatgaatgggggcgaggctggggatgtggaaactgtatcccagggatcagatctagacgactcagtggatgattgcatggggtgcaggtgggtgggtgctgggggggtagaaaggcacaggagcaggttctggcactggcgaatgaaaccgcttctcacacaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaaggggtgagtaatcctctttttttggtttgttttttgaaacatgttttgctgctaacctcactgttggcccatcaattggttaagcttttctgatcagagcctctggtcaatttctttggggtgacacagaaaataatgcagaggtcatttctttcagccctgtcctctggctggcttaggttagggctaagtagatgaagcatcttaaatgtcccagccacccagccccttagcacttttaggactgggttagctaaccagtcctagtaccatcttggaccctgagcagcatgaaaatgcagtgccccatcctttaatgaaaatgaattcaggatcctccaggtttagcatagaagaaagcgtgttttggtcaggaggcgagctggtccttgcagctctaactctgcccttgagtttcaaccgccccttgggggttgctgtttgatgatttcctacacctctggcgtctacacttcctgttaaccatcatgaaccaaaccttaactgatacataaagggcagctcagttgagacatggctggaatgattaaaatagacattcctaaagtccaggggaggaccaaagagacataaacagagaatcccatttcccactaatatggtttgcaagctagagttcatttttgtcttgttggggtaccccagagggcctccccagccgcttccaattttcagcctctctctggtttagggaacacatcgttgcaacttatccttgatttcttcctttatcttcctccaaaaatgcagtttggttttggacatagtccgtttgagatcctattagacgttcactggaaatgttgagtaggcagttggatatgtaaacctgggtttcaggggaatgttttaggctggagattcaaatttggaagttgtcagtataatgccggtattcaaagccgtgagcctagttgagctcaccaagggagggagtacagatagagatctgaggatggagcctggggctgctttaaatgtggagttcagagacgtgaaaagccagccacagaaaccaagaaggagcagccagtgaagagggaggccaatcaggagaagtaaggtgaagaaagtgtttcgaagaggactgagtagccagctgggttaaagaagacagggactgagaagtgactgttgcttttggcccaagaactatgtcagtgactgtgatgaagagctcccaggagaggcagctagcaccttttttccactcctgtccacctgaaggtcaccatacccacctccattaataacaggtgtgtgtaatgtgtgtgtgtgagtatttgcggatactcagtgtcagaattagtgtcagaattcccctcctccagccaccagtgattctgctgtgtcttccgcaatctgcctctccctgggaagaatcaactttgcatttctttgattttctatgctggtattaaaacccaatgaaagacaaaaggaggaaatatttgggaagtcaaagttctataataatgccccatgttcatagttattcctatggctgggcacagtggctcatgcctgtaatcctaacactctggtaggccaaggtgggcagattgcttgaggccaggagtttgtgactggcctgggcaacatagcaaaaccacgtctctacaagaaatacaaaaattagccatgcatggtggtgtgcacctgtagtcccagctattcaggatgctgaggtgggaggatggcttaagcccaagaggcggaggttgcaatgagctgagatcacatcactgcagtccagcctgggcaacagagccagacccggtctcaaaaaaagaaaaaaaaaaaaaagttgctaatgcaactaatatctgtggagcttactgcatgtcagtctgtgtgaagcatttcgcatgcatgaactaatcccatgagtaggatattattatctcaagtttatagatgaataatcacatggggagaagtggctgagtcattatgagttgtgtttctagcctgtaacttctgaaatctctgaagcgttctatctgaaattttatggtcctgcatgttatttttgttcctgcagaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgagtgctctggtatcacactggggcctcttatttggggatgaccactgattatcctacctacccagttattgtgaaccagttataactgggtttaaaatccttgttaattttgtgcaatatttgttttaaaacattatattcaggtatcagctgaattatttgtaattatactctgttatagatagttaattttaaacagaaatttctatctactcctgtatgttagacctgagagccacagctagtaattgggtatcaatctcttttcactcaaaaatgaacagaagtataaagcctcaatgtgagtaaaatcaatctctccttacaagagaagtggaaatgtgttgtgataaactacctgttaaggatgcaatatgttttctttgtggaagatgaacctcccaaaccaggcaagaggggatggacagaaggtggctcaagctttgttttctcaaatctataaacacagagatacacagagacactcacagagaggcttatagagcatgagaaattctgaaaatgagaactcgtattttcaaggacctaccatattctaggtgctttacatctattacttcgtgtaatataacatatattagcattttcccttttacaagtaagaccttgtgtccacatgaggtcacagagaagactctgacctgattctttgcacagctggacatcaccctgcattgtattgtctgtatttgaggcccatgtactttcctctacattatgctctccctggagctatatacagacaggtgtgggcaaagaggaggagatgagggacatagaaggaggtgtctgaaaaatagtgttttggccgggcgcggtggctcacgtctataatcccagcctgaccaacatggtgaaaccttgtctctactaaaaatacaaataattagccaggcatggtggctgctgcctgtaatcccagctactcatgaggctgaggcaggagaattgcttgaacccaggaggcggaggttgcagtggcaggagagttgcttgagcctgggaggcagaggttgcagtgagccaagatcatgacactgcactccagcctgggtgacagagtgagactccatctcaaaacaaaacaacaacaacaacaaaaaaccccaaaaacctagtgttttaagttctcccagaaacctgtttttccttctttgcctctaaatttctgggaaacttttaattaaaaataaaaattattttattttaatcaatgtaataagtgtacaatttaataagccaaataatattaaaagtcacataaccagaaacagtagttcctactcttttataccaccccttttacccttctctatttccagtcccattcccagaaaatcccactttgaaccaaaaatatgcttcttctgttaatctgtcactaaataatgtatttgcattgctacttcttgatatgtcagtttctgacatcatcttttgagttgctgttatggtaaatgaggatttggtgcgatctcagctcactgcaacctccacctcccgggttcaagcggttctcctgcctcagcctcccaagtagctgagattacagggacccaccaccacacccagctaatttttgtatttttagtagagatggggtttcaccatgttggccaggctggtcttgaactcctgacctcaagtgatctacccacctcagcctcccaaagtgctgaaattacaggcgtgagccaccacaccctgcctggatttaactcttatatgccactctgacttctccttatttaatgcccccagagtagttatctcacagttttttattaaattaaaagctagtattcttgttatcatgactaagtaaatattgctcagttctgagccatatgttacactatgattacatttccttttttgctcaacttttgctgtttcctggaattaataattgccttggttttttctttgcttggttttctgtcatcatttttctttaaatgctctggcagatctgtcaaatgcctttttgtgttattttcaaaatgctccaattcttcagaaatgtattcttttcttttttcccctctgtcctatggctccatccttctgttccactctagattgtttgtttgctaggtctgctacaaagctgttgtcttagaattcctcttgttaccacacttctgtgtcagatccaggaaacaagagatttcttaccaaagtcatgcttttacatagtttttctttgataattccccacccccatccctccatcccccctctattatctcgattttgtatcttcttaaatggttctctaatcttctttcttttctctttcctattgttcatttatttgttgtttttttctgggatatttcatggattttctctcccaaggcttctaatgattttttttttaaagtgttggttgttgtatcagtcacgattagttttgactgaggataacaaaattgcaaaataatagtgacttcatctagctcatacacaaggatccagaggtgggcagtccatggctgccatggcagctccatggtcctgagtgacccatgctcctttatcacttagtatattgttctgtgatccaacatgtggttgctggggtcacgccattacatttatattccaggcactagaaaaaggggagggaaaaagggcaaaagggtgagcctctaaactgagtcatttggaggaggcttcctcaaaagtcccattccaacttctcatatttcattggttggaatttagtcatgtgattacaacaaactgcaaagaaggctgataaaattgttttttaactggtcatattactactttacataaaattatgtgttttttctttttttcctaagaaagaaggagagataaggtagcaactatcagtctatgccacaattatccagtttttaatttccaagacctcttggttgtgatctaatttgtccttgtctttttttttttttttttctaatttgaacatcatctatttttgttctatgagtacaatggcttatcttctctctctgatactattattgatcttcctcctttaaaatttttttctgaggctggacatggtggctcatacctgtaatcccagcactttgggaggctggggcaggaggatcacctgaggccaggagttcaagatcagcctgggcaacacagtgagaccccatatctacaaaaattaaaaaggaagttagctgggcatagtggcatatgcctgtagccccggctactccagaggctgaggtggggggatctcttaagcccagaaattcaaagttacaatgagctatgatcactccaccgcactccagcctgggcgacagagcaagaccctgtctctaaaaataaaagtaaaaataattttaaaaagtttttctgttcctttcactgttcctgttttctttaattattttctctttggtttgggctctctctttctctctctttttttttttttttaaatcttggaggcttttactaaaatgtccattgatcttttgacttctttttgtacttaaaagtgaagcactcgctgggcacggtggctcacacctgtaatccagcactttgggaggctgagacaggaggaatgtttgagcccaggagttcaagaccagcctggacatcatagcgagatccggctgctacaaaaaactaaaaaattagtgggggtatagtggcacatgcctgtagtctcagctacttgggaggctgaggtgggaagacaacttgagcctgggaagttgaagctgcagtgagtggtgatcacatcactgcactccagcctaggtaacatattgagaccctgtgtctacaaaaattttttttcaatgagccaagtgtgatgacacatgcctgtagttccagctactcaggaggctgaggtgggaggattgcttgagcctgggaggttgaggctacaatgagccatcatcacgccactgtactccagccttggtgacagggtgagcctctgtctctctttttttttttttttttttttaagtgaagtactaaaaaactgtttagaagagctttgtacattagcagggcttgttaattggggcaccttactgtagaataaggaggagtgggctagactttttactggaggacccccaaatgtgaatatctagaggtttttctcttgggctcttcacgttttcctctggaggagagttctttaatcccttgcccgagggacacacagataggtacgggcattctgggaacaggatgaggtgagtgagttggagaggggtcccactgtttagggtatagatgttcatttaattccctgccttcaaattccatttccacactctttgctgtgcctgctgtgccaagtttaggcactctctggcttgattgtttcaaaggaaagcccccttgaggagggaattgggcaacagaagggttgttacttggcttcataggcagagaaaaggatcttggtatacaacaaatatagacctcccacagccccctataccttaccactgcatgggatgtggtgcttcctggtcctgaagctggtctgccagaatgaactgggctgctccctgccagcaccctctctgggggccctagggttcactctcctctgctctgctcagtctgtcactacggtcacctttccatcttccaggacttgtttttatttttcctctctcattctcttcgtgtttgtgggtttatgtctgtttcattccttttctgtcttctcattggattttcaggagagacgtggacagtctgcaatgtttaatcaaggaagtggtcgctgtccagctgcctagtcttagaaatgtcataggtgttgctgaccattccctctctcccactccctgctgcctttactttggtgcagacgctcatcatcttgtacctggactcttgctaagtctccaagactctcccgcatcccatttctccttcatgctgcccactgaatgatctttctaaaataaaactctcatcatgtctctcttacttaaaaatgcttgctggaatttaaccccttccgtgtaaagtcccagatagggtgtacgatgcaaggttcttcgcaatgcagccctaacctacgttcctggccacacttctcatgacaacccatgcactgtacgttccgctttcacccaaactgatgtcctaaacacaccatgttctttattccttcctgccttcatacaccctgttctgcctcctccgattgcttcacctcccccttctccatctggaaaactctgacatcatttaaaatccatctgacttttaagacccactttcaccccttttggagaaggattctctgatgtcttccactgtgcaaccataacatttgattcatattagtaatataaactattatctcatatttatatcacatcatatttatatcacatttgttcacacatttgtctttaggtttatttgtctatcttaaggaaataaatattaaactcatttctttgccactagattgtcagattcctttgttttcaaactatgtctttttacctctgtactcgtcacaatattcccatacagtacacataatgtagcaaacactcagtaaagcctacttgaattgatgagcaattgagcaaattttggctaaaacattgaagcattgatcaaatagaaagagttaaactattataagaacctaatcgttgacaaaccagatgctataaaataataataatcaaatcacaatggaataaatattcctgaaagcatggattttaaaaattaacttgaggctgtattttataccttatatacacaagaattatttatttacaacagctgtgcaagagagattttttaactacgtagacatcatcaaagacaagatatctgattaaatagaaataaaaaacatttgtacaacacagtgtcacagaaggaaacaattattctgacaaaacacaactgatgaaagcataccttccaaagcgtattatttttaaaaacaggaaggtcaaaatccagattttactgaaaagatgtcaggtgagataaatacaaagttttacatttgaaaaattaatgctcactcattcatgtccattcaacaaatgaattcttattgttaagtattattagtagctaaaaatagccagcacttactgagcacatcctatgtgcctggcactgagattagcatttaatatgagctatttcgctgaagcccagatttaggcattgttctgtctttctacagatgataaaactgaggctcagagaagttaaacacttgctcatgataggagacagtcagaatttgaacccaggtcaatctgactgtcaaacctgtgctcttaaccactacacagtgtgtatgccaacacttgcaatgggtatttgttttgaactaggccatgatattgattaaatgaacacaaattaaatcatcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccacctcggcctcccaaagtgctgggattacaggcgtgagccaccgcgcccggcctaaatcatctttaagatagcattaagctgggcatggtggctcgtgcctgtaatcccagcactttgggaggccaaggcaggtggatcacctgaggtcaggagttcgagaccagcctgaccaacatggagaaacctcatctctactaaaaatacaaaaattagccgggcatggtggcacatgcctgtaatcccagctacttaggaggctgaggcaggagaatcacttgaacctgggaggtggaggttgcggtgagtcgagatcatgccattgcactccagcctgggcaataagagtgagactccatttttaaaaaataataataataaatatatataattgcatatctattaagctataaaaatttaaataaaaatagcagatttgtgataattaggtgtatgtacacattgctagaggcaacatcaattgattcattctttctttcctgttgattaaagtttttcatcaaatttgggaagtttttggctaatatttcttcaaatattttttctgccctttctttttctcctgtccctgtgggacttccattacatatttattgatatacttgacattatcccattaggcctctgagactctctttcctttgcttccacctttccccctctgttcttcactttggatcatttttgtcttgaagttcactgattctttcctctgtcatctgaaatcttctgttgatagcatctagtacatttttcatttctgttactgtgctttctaactgtagagttttcatttggttcttttttatagtttatatttctctctctctcttttttgaaacagagtttcgctcttgttgcccaggctggagtgcaatggtgtgatctcggctcactgcaacctccacctcctgggttcaggcaattctcctgcctcagcctcctgagtagctgggattacagatgcccaccaccatgctcagctaattttttatttttagtagagatggggtttcaccatgttggccaggctggtctcaaactcctgaccttaggggttctgcatgcctcagcctcccaaagtgctgggattacaggcatgagccactgtacctggcctttagtttatatttctctgttggtattctttatttttaaagtcattgtcatccgaatttttttctcattaacattatcgttttctttaattctttaaatatatttttaacagctgctttgaagtttgaagtctttgtctgctaaatacaacacatgaacctactcagttagtttcttttacttgatgtttttctttcctgagcatggatcacagttttctgggttttttgcatgtcttgtaatttttcgttgaaaactagacaatttaaataatgtattgtagcaactctttattctgatatatatttctgagtttttggttttttgtttattttagtaaattgcctggatttcaactgtggcatctgcctcccccgtggtgtgtggctgctgatatcgttagtcagctttttattcttatgtgtttagccttgcttcctaggagttgccccctgtgtctgcatagcccttaaggctctgcatagcccttaaggctctgctctctgccagtggatctgtgtgtcacttgggaagcatagtcaaaactggatccaattagttccccattctcctctgggttttatgttttgccaggttctttcaggcctccccaggcgtgggcgtagttttctagtcatccagggaaatgtggggaggttatctagtctttctatggtgctctcatttccaggatctccccattaaatttctgctggtcttctgctcaccctagctgggtctgcactttcaggctagcaaggattttccccattcatttttctactgtgcttatcatatttagcatataaagccacagccttttgccctggcttcaaatcaactttgcccctctgacagcaaactgctggtttctgaccagcttcatgcttaatgggagcagcttaggcaagaaggctacaggctttcatgtttcttaccctcagctttagaaatttttgaaaaataaatacttctcaatttgttttcttcatctggtaaatttctggagctctgaagtaagtgttttggactattttgtctagttttatacgtgtgtgtgtgtgtgtgtgtgtgtgtgtgtgtgtgtgtgtggagaagattcactgacctcttcatactgccatggctagaagtccctctggttcattgtttgtggagaatgatctttcaagatgtaacaagaaacacaaaactgtttaattgccctgacttagtaagtctatttgagggaactgtttatcaaggaaacaaccccaaatcagccaaacagcaaaccaaaaaatgtgtacaagattgtcatagctgcattgtttgtgctaatgacaaattagaaataagtgctcagcatttggaaagtggttaagcaaattataacatcaacatgataaaataccacgtggactttaaacatgattctgtgtggactaaggcaatatacgttatcagtttatacatgctaattagaactatgtgtttatttattctgataaagatatgaagtgaattttcacagagggtttaatatttaagtaatttctataaaattacttaaatttattatttaaaaattaacataattggggtttcctcctttatgcttaaagtgtttatatctgctgtgaacatagaacttagacatatcactagattttaaaggtcaatttaatattttgccttatatttgttatgtgtagcatttttaacatgcacgatgcatgcttgtttgttttatgagtagaggcttgataaagtaaagttacctgcctagttgtaacttcctagtatttctagcatgagaagctgtcccctgcccctctgacaagtttgtacaacttgctttctccagcaaaatctgagacaagaaaaaaaattcctctagtcactttggaagagttttgaaaccctagctattcagaattatgaataattgtctattttacagtacctattcaaagagtcattgagcatctttgcataaattttcccttacattgctgatatataaaacagcattgtggctgcctagaggacaaacctttcctactacttctgcccaagttcctcagaacacacacacacacacacacacacacacacacacacacacacacacacacaattccctttaggttcagtaaaattgaggttgtgtaagatcaagtgttgtaaaagggtgagctttaacaggtgacagatctcaaagagatgcaaaaatataagttcttaaccaatagtgtttcttcttcttttttttttttgagacagagtcttgctctgttgcccatgctacaatgcagtggtgtgatcttggctcactgcaacctcagcctcctgggtttaagcaattctcttgcctcagcctcccaagtagctgggattacaggtgcgttccaccatgcccagctaattttttgtattttttttagtagagacggggtttcaccatgttggccaggatggtcttgatctcttgaccttgtgatgcacctgccccttggcctcgcaaagtgctgggattacaggtgtgagccactgtgcccggcctagtgttccttcttaataaccaagagggcaactgtattttactaagcctatgtttgccattaattaaattgttaaaattaaacaattttttaaataattatgattgccattaattaaattgttaaaactatacaatttaacatgctgaatagacatagaaggtttttgctgttgtagagcttacattctagtaggggaagacatatgataaataagcaaatacacactgtgatgtcaataagtgataagtacaaaactaaacaaataaccaatttaattaaattgttaaaactatacaatttaattaatggcaatcataacagaattatttattttttgaaaagtaatagagccatccattcagatcaatcttgcagactttattttaatccataattattaaggagacttttactgagcgcttcctatacacaaacttctaaatgcctagagttggcatttagaatataaaagagggtccttatccctgaaggtacagatgtaaaaaaagataagcataatacttggaggcacatgatgaatgcaaatagatgttgagaggatgaagtcttctcaaggtgtagaatgatttattcattcacccacatgtatggaatacctcgtacattccagacactgtcccaagtgctgggggaacatgctgaatagacatagaaggtttttgctgttgtagagcttacattctagtaggggaagacatatgataaacaagcaaataccatactgtgatgtcagtaagtgataagtataatgaataataatagagtaatgggataaagagagaccagggtggggaggaagatgcactgtttcaggtaggtttattagaaaagatctcactgggaagatgatattttaatggagaactgaattgcatgaagcagtgagccatgcagagaagtagaagaagagttccaggtagaggacctggcatgtaaaaaagtccaggtgggaactggactggcaactcatcaagaatggcagaggcccagtagtgactggagagcagtgagccagggaagagagatgagaggggtccagtgaggaaagcgggggcagtgctgtatagggccatgtgggccattgtgagtgtgatggaaggcgctgaaagttctagctacagctacaatgtgaccagagtcagtctttaagaagatcactggcttttagaggtaagagagagagccaaggccaatttggaggtatattaattagggtaggctaaacaaataaccaaaaaatgttatttacttgctttacagtgcaagaagggtgttccaactccgtgggaggctctcttccatgcatccactcagggatccaggctcctgccatttgtatgacttcactatgccctcggacctagtcatgtgaagaatcaagactgagttaccacattcagatttcaggcagaggaaggggaaagtgcacagagaagaggcacacattctcttaaagaccttgggccaggagtggcactcactgcttctgttcacattctgttgctgagaacttagtcacatggttacacctaacagtgagaaatcctgtggactgtactctagctggggtctgtaccacaggagcccgctgcagtaaatggatgaaagatgaaagtgggttggactaggatgggagcaatggaggcagtgaggagtcattgtatccagaatatattctgatagtagaataaacaaggtttatggatggaataagtataggtgtgagagaaagaagggagtcaggatgaatcttacatgtttgtgtaaatggtggtgttatttattcaaatgaagatttgaggtgaatagatttctgtgttagtcatgttaagtttaaggtgcttattagccaactaatgggtgatactgagaagacaatgagctattcaaaacttaagttcaagggagaggtcgaggatgatgtaaacttggagtcatcaatatatcagtagcatttaaagccatgagactagaagaaatctcttaggagtgggtatacatggaaaaaaggagtgctgaagactgaatgttggaatactccaatattttcaggttggaaggaggaggcgagccagcaaagaagactgagagagtgggcagtgacatagaaaaatcaagagagtgaggcatcttagaggataatttttccaagaaggagaaagtgatcacatgtatcagatgctgcctgaaagatcaaatgggatgagggctaggagttgaccacagaatttgaaaagattcaaatcattggcaactttggtaagagtagttttagtggaaaagtagatacaatcataagagtgggttgaggaaataatgggatatagagactgcataggcaattcttttgaggaggtttgctataagggagagacagcaataggacaataactaggggtgagctgtagacatttgtttaggtgggagagaagacagtatatttgtatttgttgggaatgattcagtaggggacagaaaaattgatgatgtgagaacaaagtccttgaacaggccaaaagggatgggatcctggcacaagtggagggatgggccttagttaggatcagaggctgttcatccaccgtgaaaggaaggaaggcagaatagagggtatagatgcaagtgaattggctaattgggtgatgagagaacatgaaaagttctctttggagaagagagcttgtaaatttgttctatcagagagtaggaggatgagttgcctaggtatgaggctgctgagtaattctgaagcatgggagcagatgtgtatgtaggtaagaggttagggaaagcgggaggtaggtgatggaaatcaaaaacatactaaggcaaactatctaaaggtccctctgtagactatgaatggttggaatgaggaacagcagagcaaatgagcttaacgttgcttttaaaggaggttatgggctgagagtagattgctgaaagtcatgatttaggaagtgtaaggttactggtaatgacacaccgcaagtgcagctaagggagttgacagttgggatgagtgaaagaaaagattattagtatgaggatttcaaggaatcgagaaagtagggctttggatgagttgtttttgtagaagtcaccaatgatgacaatggatgctgatagagaaaaagatggtgaaccaggggctgaaatatttaacaagcaagagaagaatgacaagttggtaaaagactgtaatgatgaagggtagggtgtgaaatagtctgatggcatgtgcttcaaaggggctaggtcataaagcaacagtgaccagagaggatgggagacttgggctaggaatacttagtgagttctgctacatgccaagccctaggctcaagatggatgtggaccctgcccccatgaagcatataatccaatgggcatagaaacatgtaaataagtatacaactacaaatgatggtaagtgctgtgaaggaaatgggccataaggaaatattaatggtatgtgggaatatatttagattttcctgtgggggctgatttccctgaggaagtgataactgagctgagggatgcataggagttagataagcagagggctaggggatccatgagacgtggatcccagatagattccaggaaccaacacatcaggagtggttgacatggggaagaacactggtatatgagacaggatttggaccgtagtgaagaaggaagggctgggcagaggagatgacacagtcaagagagtttggctgaagtggaaatttgatattggagaacagagaagggctatgtagggagctttctactatatttcctgagcaacaaactatgaaggttgagaacacctgaagttttagtgttgaaatgaagtataaacatactgcgaagttaattcaacatatcatttatttgaaacattattgtggtgttcatggtgattagaccatattgttaaacaatctagatgcattttcatagttaaattgagcatttctgcagaaatagaaagtcaaatgcctcatgtcttcacttataagtgggagctaaataatgtgtacacattgacatagattgtggagtaatagactttggagactcggaaaggtaggagggtgggattgagagatgagaaattgcctaatggctacagtgtacactatttgggtgaggcttacactaaaagcccaaacttcactactctgacattaaaaaattattattatttttaaattgagcgcttctggagccagctgtaaactgagaatgcagagctgaatagaacatgacatagctctgaaagccctgttgtgcctgaaaggatgaggcaggatcatgcatttgtttattgccaggcccctttcccctcagccatttcaattgccagaggaaggaatcagaggagctattctccctccatctttctccttcatcagtttctggttgatacctgagacaggtctaacacgagctaactttcagagtcagaaggtagcaaagaccatctctcattagacaaaagccaacctgccctagcagtcccggtggtcacacctggaagccaagaataccagatgtctagttctcccactctaacaccttacatctgaaaaagaggggagagctgagcttccagttgccccagatgacatatctggacagttgtgccttgagcatcagaggaccttcctctccactctgtctctctcttctctttctttctcagatccttggctggtgggaggccataaacacttctttcttccttctgcaagagcaagccctgggagatgtcttttaggctaagttacaaaattggggaagaggagctcataggtatattttcctaaaaaacagtagagagttgatagcaatttggcagccaaatctttggctattttttagatttcttcctgaagtccaggctccaagaacaagatgtctggagaagatccacttctttctatacccacatgtgcaacccctgggtctccctgttgggggtgagtaacttcatcttgatctcagttgttcttgggacagagttcaggtggacacatgtgtgatcttgggctgtgggggaggaaagatggagggcctaattagaagcaatgtgatttgcctgttgtattagaatttagatgagactacatatggcaagattacatttaatgactgcttattttaatcaataatttcctttttaaataattgtctatgataacttctgggttactaaattttaaggtacgctaagttatcatactttcatcctaatttgtttcttatagggaggaatgggacaaggagataagatagaatatctagttgatagttttaattaaagagttattttcagaaggtgtctgcccaaatatctgcttaagtgaggttttttgaattcttcataaacttcaattattcagacttttacagtgatcagaagttgatgagagggaatgttgttgctgaagacattagccttgtggcttgcttaccatgtagaaagccattaggtgatttgctcttcctactctgttttcacaggctgttgggtcccttctcatcatgtttgtgatacagtgggtgtataccctggttaacatgggtgttgctgccatcgtgtatttctacattggccgggccagtccagggcttcaccttggtaagcagcagagccattttgccactggttccctcattctctctaccattcattgggaaaaaaaagattttgaatatcaattgaatgccaacactgattcagatgtgaatcccattttcaaataatttatagtctaggaggagaactgtgacaagcacatgaatgattaccaataaaaataataacttaaaaatgaggtttataagatatgtagaagtaaaaatgaataacaatagtccaagagctagcagtgaagtgaaagtatactgttgtaagtttcttatactttgttaaatactataacatcacttgatggcggattgtggtaagtttaaaatgtatactataaaccctaaagcaacctaagataacacaacagttatagttaagccagtaaaggagataaaaagtactcaatcaaaataaggcagaaaaagataataaaggacaaatgagacaaacaaaaaacaaataacaagatggtttatgtatatgtaatcccagccatatcaataatcacactagatatgggtggtctaagcaccctaattgaatgccaaagattgtcagattgaatgaaaaagcatgacccaactatatgctgcctacaagaatccttctttatatgtaaagacacaaacatgttaaaagtaaaaggaaggaaaaagatacatcaggctaacactaatgaaaaacaaagcagggtagctatattaacattaggcaaagtagagtttggagaaaagaatattacagtgataaagagggtgatttcatgaagctgaagggaaaaatacatcaggaagacataacaaagcttaacatttatgcacttaaaaacacagctttgaaatacacaaaccaaaacctgatagaactacaggaagaaatagaaaagttcacaaccatagtcagagatttcaatacctccttcctaataattgataaataagtatacaatcagtaagtctacagaagacttgaataacactatcaacaaacctggcttaattgacagttagagaacattctaccccaaaacagcagaatatatgttcttttcaattatacatgaaacatttaccaggagagactatattctagtacataaaaaatatttcaataaatttaaaagtattcaagtcaattcaagaacagagtatgctctctgaccagagggggaataattagaaataaataacagaaagatatcagaaaatccttgaataagccaggcacagttcgcacacacctgttgtcttagctacttggagggctaaggcaggagaattgcttgaggccaggagtttgaggccagcctgggcaaaataacaagactctgtctcctaaattaaaaattaaaaaaagaaaagaaaatccccaaatatttagaaactaaagaatattacataaccctaattaaaatacagaaaataaataatccatgattcaaagaagaaagcagagtgaaattacaaagtattttgaactgaataaaggtgaaaatggaacagcaaaattgtgggatgtagctaaggaaaatttatagcatcaaatgcttacgttagaaaagaagatcatttgcaaatcagtgatcccaacatccaacttaagaaactagaaaaagaagagcaaattaaacccaaagtaagagcccagtaggcagaggttgcagtgagccgagatcaagccattgcactccagcctgggcaacagagtgagactccgactcacaaaaaaaaaaaaaaaagagaaaaaggttcttcagaattagaatagtctgatgcacttcaaacactttgaaagaaatgcacttcaaacattttaagtcgtgtgtattaaaaataatgatttagaaaacagtaatgttaagaagaggtccttatgttagctgacttcatggatagaatatattttaattaacagtgattacttcagtgattgcttctttatttcttaaaaagtagtttgatcttaagaaatttcaattatttcctagaaatctattcataggaaaacatgaaatcaaatttcaggccaatgtccatctaaaattcaaataatttagaatctaaattatcacacttaagtagggtgagttaataaaatatgtttattttcttccttctgacaatctcaaaatgtattagaaatcttctctttgcaattgcaaatgcagatctaaaatttatcttccctttagccataagggcctaaatgatattgaggaaacaggttatcagctgcatactgttgatatttgtggagattttaacataagcctcttaaaataatgctattttcctgatcatatattgaacattatctaatcaatcaattttcaatcatatgtatgtataatttaggaaagcattttctaaaatcacatttgatttgtttctctaaagttatatataatttactatgtgaatttttttaaacctacaccaaaggaggaatggatttttttcaattgataaaccctattcaaatctgtgtgtttgatgtcaggattatttggctagaatcaacaacaatgtcacttcaaacttcagctctaacatttctacatgtggaactatttgattcacttaacacctgttaaaaaaattcttaagtgccagatcctgtgaggtactgtgatgattataaggatgaaaaagacatgttcccaattctcagtgtatggtctagtagaaaattttatggcgtgtattcaacacttgtcagtatgaatcttaaaaaatttatcaaagttttttaattcttaagactaaagttagcaagtctctgcatttgtctttatagcactttatccagttttttgggagtgattttggagtttggaaataaacttttgaaggattcacatgagtaaaagtccttagtaggctgctgtcatggaagattacaatgaaaattatttgtttagactgaaaaaggaaaacatttgtgttaattctgtgcgtgtgtgtgtattggggtttgcattcaccctattaaaactgagcttctagatgccttatgtagaaccttcaaaaatggttatgtatatgtcttccctgcaggatcagcctccaacttcagctttttccggtggatgaggtctctcttgctcccctcctgcaggtctgtgccaatttggagccagtaccagaatggatgagtgtccagagtcctgggaggtgccaagggtgtcccattcctggctgggcttgggcctggattgtggcatgggaacctaacaactgggcacctccgggagactcagatgttgctcctgcgtgcactccaccacactcggcccccagattcggctcatcagaagcttcctctaggctcatgtcctcttcccttcttatcctcagtcatcaagaacagaggctttatttagaatctggttgctggggtgataagtcactactctcagtgagtttacagtctaagacacattcacatcaatgcataatcacacacaagattaaagcccaagggaaatgtaacgccaggaagcacattcttccatctgagtcagaggtagttgacatgactgggttggggacagtgcagaggccaagtatagaaataaagtggagatcctggaggatttctgtgggacctctatggtcagatatacaggaaaggagaaaaaaaactttcctgagaaatagaagcctcatagagagggtatatttcacatgtgccctaatctcactccttctcctccactcttgcagtatcactgcttcttaccttttaaggccctgggattctggggaattacacccaccctctgtcccctttcaatatcagtgaggagctagagctgcaggctaggaaaatccaggcagaacccaaccgagtgttcatttggttgcattttgttggtttgtttttgagactctagatgtccgggttgtacttgctaatatttccaccctgcatgttcagacattgctagtggatcatgggatcctttcccattgatcccagatgtaacttcataatccttttttctcctcattttaaaaattatggtaaaatagggctgggcgtggtggcttacgcctgtaatctcagcactttgggaggccaaggtgggcagatcacctgaggtcaggagttcaagaccagcctggctaacatagtgaaaccccatctctactaaaactacaaaaattagttgggcatggtggcgtgcctgtaattccaacttctagggaggctgaggcaggagaatcgcttgaacccgagaggcagaggttactgtgagccgggatcgtgccactgaactccagtctagttgacaaagtgagactccatctcaaaaaaaaaaaaaaaaaaagtgaaatacatgtaacgtgagatgtaccatcttagccatgtttacgtgcagtgtgcagttcagtggcattaaggacattcacgttgctgtgctatcatcaccatgcccattaaacactctgcattcccaagaatcctatttaagacaactcttcacaaataattgccaatctattcaagatggcacaagaaataaagccttcgtgctggagcttgggatgacaagaagcagcagcaagggctacagacaccagcagggacagggcccagggatggaggctggggtgcatggggagcaccctgtcatctgcttacttgggccagctggtctcaatgtctcatgtggagctgcagagagggtgagtgatctttctgcctcttgtcctgtccgatgcacaaggttgggtgagccaggtcacaacatttcttcactgatctcttctcccctacaacccagtcctgagaaagagtagagtttaaatggaaatagattctgtgtaaaagctgcctacagattctggagctgcaagtggtgtgtgggtgagactatttttttgccttgcctgatttacaggaatatttttagtcatttctggttttaaagcctaaaaatgccataggaggtcaccagtccttatgttgtactctgaattcctaggatttcaccttggaggtcacagcagtgctatgtagaaagaagaatgtactagggggagattattcttagaaaaggacagtactttggttggagtagaatcagtccacaccattcataacacaaacaccaggctctgtgggctgtgaggtggggagcagaggcctcagctaagtcaacatcaaacttattggccttaccatggctgctgggcgatattttgggatggttattcaggaggttgaaagaaccaagaaaggctgggcgcagtggctcacacatgtaaccccaggactttgagaggctgaggcgggtagatcacctgaggtcaggatttcaagaccagcctggtcaacatggcaaaaccctgtcaccaggcatgtggcaggtgcctatagtcccaggtactgaggaggctgaggcaggagaatcacttgaacccgggaggcggaggtttcagtaagctgagatcgcaccattgcgctccagtctgagcaatagagtgagaccttgtctcaaaaaaaaaaagaaaaaaaaatggtgatttattttaaaatagagattggtcagatgcactggctcatacctgtaatcccagcactttgggaggctgaggcaggccgatcacttaggccaggagtttgagaccagcctcggcaacatggcaaaacaccatctctactaaaaatacaaaagttagccgggtgtggtggtgcacacctgtaatcccagctacttgggaggctgaggcatgagaattgcttgaacctgggaggcagaggttgcagtaagctgagatcaaccactgcactccagcctgggcaatagaatgagactctgtctcaaataattaaaataagataaaaaataaaaatagagattggtagctgtgtttctgctttgtagttttgagttcccctcccagtccccaactataacccccaaaatgctcttcaaaacctaagaagaagaagaatgtagggtgtgttttggcagaagaatttggctaggttacttcctctgttatgcctacaattcccatgaactatgtgaagttgagcctgtcattgagaaggctttctttcttgaagcactagcaactgtccaaatgaggatttgaaagtcattctagactagagagtgaagtattttacttctccagactcagaagaatgtaatggtttcacctaaaaaatcaaaacaaaagcattagcaaaaacacttacatgttgactggtgtgacatttttgtcacctcctaaactttttggagattcagcctttatagaagttaattcagttctcaagaaccctcagagacctatatgatttatacatgttctcaacaactggctgtaatgccatagtcatgtgatctgaacttctatagcaggacatttggccagagtccgttgaaactttctgtttaagttccacagatcaataacattagatttctaccttttcgcaactctcaaatgtattccatattcaaacaattgaaacttattactcataaagtagatgattcttttagagtaaaaattttaagaggaaatccatgtctaaggtatgacttacagacctaacacagactataggaactggaagagacccgggaagatgagaaaatagagacacaagaaggtaaagaggcttctggaggccacctagctgattagggatggagctgtgactgggtctgccttccgtagcagctgcctggacagccagcctgagctttcctcactcctttcttcctcttagcactttccctatgcatccctaacatttttctttcccagtttattccaaccgaaactgtatgcagagactccagtgacagtgggatccatatgggacttgctcttcacctgaggccaccttggtgtcaaaagcctttgcagtccctcttagctgcttgctgtgtgagccttagctcttgaaatcactccttattcaactttcttttcaatagacctacgagaattttctctttctgctcttctcaattttccagcctctccattccattatttttgacaaaaaaaaaggcaaagaaaagctacagagccccaacatgataccatttggagggcaaaacctctctttgttggttatttcctatcaggtaggtacagctttatacttttctacttagggagggtaaatatcactctctctgtctctttttattttatttgatactttgtatttctcatgctttgagttcatatatacctgtacatatacctttcaagaattatgttttaaacatttaaatacatgtgtgtttacagataatttctttatgcccagtagactcacctctactgttcagtctctgttctgtccttctcaccatcctctgtgtctctctcactgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcct

SEQ ID NO: 38576 - DNA, 367231 bp, Homo sapiens
agttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaaggtacctctgcctgcgtcccgggggtgcagcgcctgcgtctccattgccagtggctttgcagtttagcctaggtggagggattgcagaaagaaaagtttctgggagggaatgtgataaaggtgggaaatcactgtcttttgttgggaggaaaacaagcggacaatttgggaaacttctgcgctggcaagaaatgggcttgtttactactcctaattagctgcgctcaggtctgtctaaataggtctggtctcaggctagggtgtctgcagggctggggtggagattcgggtgtgctgggtgaaagaagttggatcccagggtgtgctgtttcctggtgcacccatcatggataggctggttccgagagaaacgtgattggttgtttgtgttttccgctatagggtctgtccccttcgtattaccttgatctgccttccccaaactattgtgaccttcaactggagtccttcctcaaacttctgcctccttcctgcctgtctcagttcattttatttggtggaaggagacattccccggggtgggtgggtgaggatggtctattctgtttgacctggtgggcacctacgtgacaacttggtgacacgccagcaaaacagttctcagaggagaggaaatcacataattaattagctcccgaaaactctggaagactttccaggcttggggtatcctgaaaaaaaaaaaaaaagaaaaagccaaaaaacgggatagagagttcggtttggtaccatgtgaagcttacacccttgtccccagaaggggtgcctggcccggagcatccccgcagctctgggaggtggaggctggtggagggggtggctccgtgtaggtgcgcaggttgttttggtgcacaggtgcatttgtggcagaggtggtgctgaagtcaccatccacactgcttctgctaactgctcttgaagtaaaacagctcaccccggcaggcagctggttcagcccagaagcacccttgagcattctaaatcgcgagacctcaggggcctctcttgctctgagacccttgggaaactcctttctccccctgcctcctccgcctttggcttctgctaaagggagatattaggtaggtgagtcactaggaagcagggacccatggggaagcaggcgatgtgcttggtctcgaactttcttcctcttctgcgaaggcagcttctgcttgtgtgcccaccgcacttcaccagttgcgctgcctacctgcgggatactctgaagctgatagtctgggggtgatcttccaagtcctaggggcattgaagagtttagatgattttcatccctctgatttccgttaaacccgcagctggggagttcgattcccagtcctgacaagactgcatgttctgggagggattctccagtgacacctcttcctcagggcacccttccacggagatgcagatgacagtcttgattctccagctccacaaatcccttccactttttaattcttattttctttaaccaccacaacagattctcctccacctcctgtaggcagctattttgggtgggaactgtgattattgaaactctattcacaatggttaaaaaaatgcctgcccactttttttttggggggggtgtcaaaataccatcagcgttctcttctgtacttcctatctgacagtaaacaaaacaattttgcagccctgccaattataatctttttgtgtttggggggcctggagcggaagctgaacttttcccagccggtgggcatggttagtcatggacgtcgtcctctgtggcctctccagggcacgtgacccccagggagcccaggaggggcagcccccagcacgtgggggatcttgcatgagagcaccttggttttcatgaaggcagtaaggaaaccagaaaatgcttttgagtttgaggattgcaaaactgggggttccctttaattgatgccaatctgttggatttctatcgtgataggaaacattaaaagtaaggcatttgaaacagctcctgaagggtgagtcatgcacagagggaagaggcagtgtggggggagggggcggagggggccttggaaagtacaagtgggacacgctggagcgctcgctttccttccctctgcctcctcctcaatcctctttcttgtatttccccattcggaacagagatcattaaaataacaactttagaccaaaaaaggatcctaggagctgaaaaataattgacaaagtgcaaaacaccctcattacagcttcaccttggatggggtgaggtgtgaaacccaggacccagcgcctctgctgcgatccagtttggagaatctaattgctggtgttaggctaattaactccttgtgaagctgcgtgcctgtttgtgtatgcaaggaccgatgaatgcctaggaaattaaatgtgttacttgtcatttcatcaaacatgatggctttggccaggaccctggataagcactatccacagacccagcgttttctcctcttcccaattggccaaactggatctctctctcttttaaccactatggtgggaaggggttgtgtctttctgcttttccaagccctgcgtgagttacctggcaaataaaagtcctctccttacccctctgtccctccatccctgtcatccttctgttatcccttttcatcataaacatatcagtaagtaatcttttgccaacctactttgatcttgtcattttgtgctgatttttctgttaaagaaaattgtcccctgaaataagactgaaaacatattaaaatttttatcagagaagagcctttttgccttctgctttaaaatttaattttgtgcttttggggaaatctaataagcacgcctattgtgttcgctgttttggtaaacgcttttacaatgtcttgttttttttttctgtggatgtgtgaattcccttcctgtcctaggggaaggtgtgtctggagatttgaaacactctggaacacctcagaaagttgaagaggttggagcacgctatttccatgtattcaaggtggggtgaaggctgttttgaaacctagaccctgaaatgtattcaccacactctgctattttccctcttcatctttcatttaggaaaatttcatagcccaaattatgactaaatcattcatcctactcactctccttcccatgctcgtgccccttcctcccttcctccattcaccctacatgtagggttacctctctttcctggttactttttgtttcttccttcctgtcatttcagggggccccagggtggagatctaattgtagatgttttgtgcacctcactcctgaaacagttaaccaggggacatcaggaattgtggaatgtgataggagcctaccctaggggagcaatgaggtaatcctgtccccaagttcagttctatgcagacctcaccagagcacctggagtggtgcagctgacctgcatgaggcagacagggcagatgcttcgaagcacagtcctgtctgacacctggagagtcccaccagccgcaagccctcactgtgccactgtcctgaggcctgcgcctgctgcagccccatgcgcagagctgaccttggaaacattagcatgcagggaaatttgcctgctgtgctctcagtttctttgctctttgttctcacccctaaatctgttaatagttggaaaggatcaaatctactcattcatactaaggtgtgaacagttaatagtgttgctacttacagaggtatttacattcttaaaggaaatcaaagatgtgtgtatgttctcacttataagtgggagctaagcattgagtacacatggacatgaagaggggaacaataggggcctacctgagggtggagggtgggacgagggtaagaatcaaaaacctgcctatcaggtactatgcttactacctgggtgatgaaataatctatctgtacaccaaacccctgccacgtgtaatttatccattataacaaacctgcacatgtacccccggacgtaaaattaaaaagttggaaagaaaacaaaagatgtgcacagtcaaattccaggcacctgctagtgggattgggcagaggcagactgagtttggatggggagcagagtgggaaacggcggccttcgctttttagctctggctggtcctgctctgacccatgctgaaaacatgctgcagtgtcccagggctttgtgatcttactatctgggctctggcacttgagctagatccctcagatttgaacttgggcatgtgcttatgtgccttttctgacttttagtccccttagatatagagccagaggtcaggactacgttctcacaggctcctttccgctccaaccttctctcttgattttgccacagagccctacatcccactgcagatgctacagctctggaagctctcggagcctgcagagcatcctctcgtgcgggccatggtgatcagcgatgctttcagagctggaatccatgagggcagctcggaagatgttgtaacagaagaagcacaggatgagggctgatgtaataactgattttggtttaggaggggatgttatatggaggatggcgaccagctgttctccatctccagcaaggattgaactagagaaaatagacagaaattgcagcagatggacttagattaggtatgaggaagaattttccatcagcaagagatgttaaaaagggaaggttgttgagcctctgtgatgatctttaggaaacggataagcaggggcttttagctgaggcaggagccacagatctgtgaggagggaaaggcaagggccatggagtgcaggcatctgtgccctctgctgatgagaacccttacctatttccctgagcctagagacccttcccctgccctgcaccagctgccacctggactggcagattctgtctattgcatgggaatcattcatcaagtctaatctttcacttccagatgtggcagatgatgcccagagaggtaacaggccttggcgttgtcacacagcgagctgatagcagagggaggaccagaatccaggtcctccatgtcccaagtcagtgttatttgctttgtagttcattttcttcttgtttccaaattgaatagaccatttgctttctctaggctcctaatttctctgtaatcaaatggcaaagacaggaacacctgtggttaagcaatatttattgagtgcctgttactaacaccatgcactccactccagcttccctgtttatgccgatgactctttagttctggctgagtggctgggaggggctgctgacccatccctgggggggctcctgagtgtggctgtgaggccagggtggcgggaatgtgttctagaaaccagagctgagaggaggggatgggtagaccagaagaggatgagaagagagacatgggagcaatgagatacttaatctgaatcttatgaagggaagaaagactttagatatctctgcaaacttctccctggataaatgaaataagatgggcccatagcatgggatcactctgggtaagacacatcacctgttaccttacggaacgggatgaaacataccatgtgagggcgttcagggagggtggagtggtggcccagtggagagtgcacaccgccacacacgtggtggcctagctccggacccaaaggcaggctgtcagtgaagttgggaagtctcacagttttgagaatgaggccgtgaccagctgtggagggttttgctttgtgttggtttgagccaagtaggaagcaagataaattggtgaactgagcaccacaaaataaaaccattctgtgtgtagccctgagaagaaagaagaaagcaccccagttagtgatgagctaggcatcaagaggacagctcagggtcggcagtgagtgtggggaggcgcgacccttccatgcccctggctggccagggtgtccctgtgctaacaaaggcatcctgggcctttgtgcccagcacggaggtaggcactaggggatctaccagaaggaagaggggttttttctcctgcaggaactggcccagcgagaccatcagcccctcaggcagcagggcagggtgcccttccagggattggctgagacaaggcgtggagaagcctcaggggcagagggcccagggaacgccaggggctggtgggccaggcagggagcccagggtgtgagacaggctcaagcttgggaaggtgcagatgcgggaagagcggtgcgtcagcccagaaagggaggaaacccagggaccacagtgcccatctgcagagggcagagcagcccacatggcccatggagagaacccaagggatacaccaggcagggtggccaacgtggtgaccaccatgtgtccttaccactcacaatgatgttcactgagatcaccacactgtcttcaatttccccttccccctcccccctcccccttcccccttgctctcctctcaagtcttctcctctcctctcctctcctctcctctcctctcctctccccactctgttgcccaggctggagtgcaatggtgcaattatggtttactgtagcctcgaactcctggcctcaagcaatcctcccaccttagctcccaaagctctgggattacaagcacacactgccgcatccagcccccgccctcgattttgatgccgcagacattactggaatatagtcaggtgtattaggtggatagagtgcatctgggtgtagggtacaccatgattctccttatttggggtgggcagaggagccgctgggagtgaggaacacctgaatgggacctgaggcttgaataggtaccatcaggtggatgggaggagggtaagaaagagggagccacggtagcaaaactccatccagcgcatgattggcacaatgtgtcagtgagatgtggatgttgctgaatctgcccatacgaggcatgttttgggggcaaggggaggtagggttgtgggtgcccaccaggtagggagggaggggccactgccacatgaaggagcagaaaactgtcaggcaggaaatgacatgctcacatttgcatctaggaaaaatggtccagcagttgtgaaatgaagagtggaggtgaggtttgagaggggcgcaaaggggagaggccagttcagaagtaatttgctgctgtccaggtgagaaatggcgagggcccgcaggaagacagtggcaatggggagggggaggagggcagcatcagaagccgatactttgacttcataagttacactagatcagggaaaaatgaagaggaattattcatccccgggaggagaagctgacaggtgacaaagaaaggtcatagtgttaggtgaaagagagagcagtgttccctctgaagatgggatgggaggaaatgggtttaaactataggagaaggatccacactggacatttaaattaatgcttcagtggaggtgttcgtgagacgtggggaatgggatctttcaaggggtttgtggattcattctctttttcaaaaagtgtttttaaaaatcagcctttccctgatagagaagtgagcaaagaatgggaatagacagttcacataacaaaagaagtaagaaaaatatgtaaaagaaaagtgtctctcctcactaataacaaaaatgtgaaattaaaacaagttatcgttatccatttaacagattagcagaaattaaaaatgataatgtaatatccagtgttgctgggaaatggacatttttagacttagctggtggatatgtgaaatgagataatttggaaacataggagatgtgtctcaaaaaaatatactctttgaaccagtcagcaattcctcttctaggaatttatcctaaggaaatagttagagatgtgcaaaatagttctaattaagaatattcctttcagcattattcattacagcaaacattgcatggaggcattaattaaatatattatggttcctccataaaatggaaatcaagaaaactattaaaattacattgaataatacataagaatatgggaaaatgctaataatatatattaagcaagtaaagacttaaaagtaaatagagtataattgcaattaaaacaaaaggtgtatgtagtcctgagaactagagcagaatattatattatcaaaattttcatggtggttatcactgcattttgggaaacatatgacttttgatttctttaaacttttttgtgctatccaaatttcctccagtaaacatgttattttacaaattagacaacatgctttctaaatcagtcattccaaccacaaatgttcaagcagtgactatccatgtagcaaagctgggtgcgatgctgttcactaagatgtgaaatgcctgcatcctgagtccatttggtgggagaagataaacgctcacgtgaaatgcggcaagtgccgcctgctttgtcagtaagggctggacctctgctgcagccaggtgtgaagtgtgcaagatccctgtgcagggaatatccttgttccttcctcttcgctgcattcccacctccgggccctgtcacctgcagtggtcaggcctgtcttagcatttcaaggggtgcatcacatatatctgctcatttcacaagcagagaagttgaggctccgagcaaaaggctgtcttggtcagggtcacaaagtcagtgagtggttttgttaggtatgaaaacaagaaactttactgccccacaccatgctcttttcagagtgggctactctgggggttccatgtgctctagaagtgagtggtagatttctgcaagaaggtgtgaagccacccttccttcctgtcatccttccttcccagaagccatgcctttggcttaatccacttattaattaagaccaaatgcatgtgtggcagctattccatttacagcagggactttgggtactgcgggcccccccgaggtggccctctgggtctcctcctgatggagtgtcgcatttgttaatgcttttccagaatgtgtttgctccctgctgtggtttcctttgttgcataaactctgggcagcctgagacagtctccacggggtgaaagtcacagttggctggctctgtgatgggtgccagggccacctgggggctctggggcaccttctctaagcagtgcaggtgacggctctgatgggcatgcctttggaccgttcacaggctaattgggaaaagtggacaggcctgcctgaaggtagggcatgacaaagaggagtggtgtaggctgcatggctgtttgctgctctgtttattttaataataactcattgtgtggtgttttgtatttacaagcctcagaggtgggtggggaaggtgctggcatccccattttgcagagggggaaatcgatacttggaaaggcaaagccactctccttagtttgtaagggcagcaggcataatagccaggcatggaatgagctagattttctgtctgcaaatacagccctacctgtcatggagaagggcttcctgctggcctacctgatgtttctggagaaggaggggtgtggagtagcactctgttcggccctggcctatgctgaaggagttaagagtaagagatgactttgggtccaagggtgtattcagctgaggtagagtgtaggtgctgagaaaagtggatagtgctgagggtgaacacggactcacaggattcatggaggcagagggtcccaagccctgagcattgaaggatgagggcctcatgggaggcaggaggggtgtgctggggacaagtggagatctggagctgagacctggcgtgaactttgtgtggctcctcaggggcagattggctccacaaggggatgggaggggacaatggccagaggtgccccagcattccaggatctgtctcagaagtctctcctgtttattacacctgcaataacatggctgtgagaggaccgaagggagggggagccgagaggcaggggaagtgggttgaggggtctcatacctgttctttcccctctgccgtgtctctgggttttgttcctgttgagaatgcaattgctctgcggggttgcaggaagagagaaaggaagactgggagggttgctcgcctgccagttcttaccatgctttgggaaacacatgacttctgatttctttaaactttttttttgtattttccaaatttcctataccaaaccactattttacaaatcagaaaacatactttttttttttttttctgagatgaagtctcgctatgtcgctcaggctggagtgcagtggtacaatctcagctcactgcaacctctgcctcctgggttcaagcaattctcttgtctcagcctcccgagtagctgggattacaggtgcccaccatgatgcctggctaatttttgtatttttagtagagatggggtttcaccatgttggccaggctggtcttgaactcccaacctcaggtgatccaccctcctcaggctcccaaagtgttgggattacaggattacaggcgtgagccaccgtgcctggccaaaaccggctttttttttttttttttttgagacggagtcttgctctgtcacccaggctggagtgcagtggcatgatctccactcactgcaagctccgcctcctgggttcacgccattctcccacctcagcctcccaagtagctgggactacaggcgcccgccaccacgccaggttaattttttgtatttttagtagagacggggtttcaccatgttagccaggttggtctcgatctcctgacctcgtgttctgcccgccttggcctcccaaagtgctgggattataggcgtgagccactgcgccctacctcaaaactgggctttttaaatcagtcattccaatcacaagtgttcaagcagttaccattcatgtagcaaggttaggataggaggattttcggaatgtgggaagagaaaggagaagttatgagacatcaagaaaaataaaaaggaaaaaaaagggagcagagtggggagttgttggagaacccaggagggatgttcagaaattcgggagcagctcatggcacagcaacaagcctgtgcgtaatctcttttaaagttagaggtagacttttggtgtgataagacacaaaccagaaagaaagaaatagaacctaaggctgcctgcccactgttttcagatgtttaagcatttggtcatcaccctggttttacagatgagaaaaccaagactcaccaaggtgacacttgtcctgagtgggcgactccaagcctgtgcgccgtctgctgtgctgcaccgtccactcacccttcctgggctgcagccaggactccaagctgcgtgactctggaggcctggaggagcgagggaaggaagcatttggggcattgctctgtctgcctccagagaagctgcttctgcatttgccccttctgatccccaggggcctgaagaaggatgccagcagggcattccctgatctgtcccctttgtctctggggactgtttggcttcagtctctttagcaagggacaccctggctctggggctgtgtgagctctgagccatggctctgttctttgatttctccatgaggcaaacaatgtgcttctctttcccatccttcagtttccttaataggagatatgagcttttgacatgttatgtgttcttttattcagtgctcagaatgttgggaattggtaggtacacttctaaacttagaggattcagaatggacaaaactgacccagttcccagcctctcagagcttagattcaagtgggggagatggacggcaaacacataagcaaacctgtggaagggccaatgagtgcaagggagaaacgtgaagccccacaaggggaacagggagtgagagggtctcacttatacatgccacttaggcagagacctgaaggcagcgagggatggtccccgtgggtatttgggggacgagcagtccagcccaagaagaccctgaagctggagacacttggggtgccaggaatagcagcgaggacagggtgtgcttccttgaaccactgggatttttgagctgaggagtaacacagtccatgatttaaaacgattgctcaggaggatcacttgaggccaggagttcgaggctgcagtgagctatgactgtgccactgcactccagcctgggtgacagagcaagactcgtcttaaaataaatacatgaataaataaaaatgtaaaaaatgaataaataggttactctggttgctatgttgacagtacagtggagtggggctctgtggaggcagaggcgccctcggaggcactggtcctggcaagaagggagatggctcgggtcggatggtaacagcggggagggagagggagagggcagatcctggatgtactttgaagggagagctggcaggatttgctgatgggttgaaggtggggtttgagagactagagggttcgaggatgattccaaggcttttggcctgagatggtgggaaagactgtagaaggagcaaattagaaattgtgaggagtagagagggaggaaacgagtttgttttgggggttgctggagctctagtgaaatgcccactagatagttgtgttttggtctggagttcagagacgagctctaagctagacaaccctgggagtgatcagagtttcatggtgtctgtgagatcacctagggagtgagtgtagacagacaggacgtagaaaggcggatcctgagaatggcagtatttatagatctaggatggggtttgcaaactctttcttaaagagccagatagtagatattttaggctttgcagactgcacagtgtttactgcagctactcagcattgctgctgcagcacggaagcagccatagaggacatataaatgaaggagcatggctgtattccaataaaactttatttacaaagccggaaacccacccataggccataggtttgctgaccttggatccagaacactggagaggaaccagcaatggggactgaagcaggagcagcctggagattggggtggaccaggagaggaggttgcttcagaaactaagcaaagcatttttgcagaagaaagtagtgatctgctgggtcaaatcctgctggcataagaagtaagatgaggactgaaaattgcacgtgagcagtgtagaggccgtggatgagctgatgaaagcactttggttgaggatgaggtgagaggctctttggagtgagttcaaggagaggcattggagatagtgcatgcaaacagcttcatggaggagtggagctgtaaagctgtgcaaaaaaaaaaaatgaaatgtcaactctagggatacatggggtgaaagctagtgttggttatttaaaaatgggaaaagtagcgggatgtttgtattggatggaaatgggccagtgggcagggtacaaagatgatgggtgggggcggaggtgagaatggccttgagtgggtgagggagtgaggcctggcctcttggacagctctcaggggaagaggagtccgtagccagaggccatgtgatggggtgggtgaggcggggtgggggaccctcttggatgccttcatttttctcagagagtagcatggtggatcacaagcttcgagacaggacagcgaggacctcagtccagcgggtggtggagacaaatgctccctgcacacagagcgagagggatgccagacaatgacagagagttgtgctgcgtctctaaatcaaaattaaaaggtttctgccgatgctatcacttgagcttttcactgcgaaaggggctctgtgagctctggagagttatgactgaattaataaggccaggatgagggcatggatcgagatcctcaaaaacagtctcatagattcctacaggcctggagctgctgcggaggtagctctcgtaggattgaattgaaaagaaacaagagttgttgcccagagtgagtaataaccctcctcagaagtcagacaggtggcaataaagagtccattggcctgggctcagggggagttaggggagatcagggcacttttttctctcctcctaaagctttttgctttcgagatctcttgctttgtttttaaaagtatcttcctatgagggaggaggcagtgagaggaaggccaccttctctaacttttaccttaagaaactgtcttggagagagaagggacttacctacggttgtgtgatttgaatgggagggtggatctcagaaggtgggagctgaatcctttgctgtcttcctctcagacatccaggagggagaaggggaggcaaggagaggaagagacttcctggagaggggttcgacattccaggtagtccgggaagagggaaatgctggtgtgaaccatgacgaaatggaacacctaatggttctatttccatgtctacaggaaaagaaataggaaaacagactagggaacatgtgacttgtcaggaaggaaactgccttggggttttggaaaagagaaccgtccaaggtcacatacctggagaatgactttttgtggagactgctctgcccaggactgagggtgggaactgaggctgaagggacacacagcatttgctcagggagcctcagcaagggtgccaagggacctgtttatgtcagtgcaccatcagcacagcccggaatggctttggcctcatgatgtgcaattggccctgggtctgtcaatttctctgagagggaactcttcctgttgcaaagggtccagcacactgggttcacttagacggcaaggttgagtgccagagtgataacggcaataaggagtttgtggctcaggattaagcagggaagagaactcacacatcttttcttcacatctgactcccggtggtctttttgggatgaaatagagaacgtgggagcacagagctatagcgaaccgaagttgatctaatccaaggtaactccacagatttctctcaaatagtccaggaggctgctcaaagtcccactgtccccagctctgaaacacctggtacctgtctcatggggggggattagatggagtgcaggtgccaagcgtctagcgtattgcctgtaacatacaaagtgttccaggatttatggcaagtgataaaagccgctgctggtggtggtggtggcagcaggcatgtaggggttctctctcccggtgtgccaggccagggggctggggtggccaggtcatgggtaacctgtgctgctgcttgctgcagagcttctgggttggtaagtaagaaagctacaatacctgtgtccgactttcacagctccagcacttccttccaaatattgccggccagggtttttgcgttctttggaagaaagacaccggagaggaacaaggtagcgttgccagggtagcaccttcagaaaaataaatcctggaaaggaaactctgaaagcttctagaaccataatattgagacagatttaaagggaacccaaaattcctgcaatgcttggaagagcagaaacatagatttctcatactaatcaagtgatttgtgggaaaaccctatcgatctctctaacctgagctgaatcaagtgaacgatcagctgtgagttgcagaatgagctccgaggcggccacaaggctggtttatgattctgcagaacttttctgaggcatgaactcctggacaagcaggtgatttcaaaggaaagaaatgccctccctcctcacctttccttcagctgttggtgcagggattgatgttgggtgaaagggtgtcctctaattaggccctgggcaggctttctggggctctcatccttccaggtgattctgcgcgctacatgggggaggtggtggcatgtgtcctcaggcttctgaggagtggcggtgatggagagtggctggcctgactgtgcacttaaacactacattgtcttgggaactgttgggccgagctattcccatctctgtatggaaaaaatacaatcaacttcgcgctgcacctcctacaaggaaaagaatgggtgttctgataccatgggctttggggagagctgttttttcaagctgatccatgttatcagtccccatacagttgctcctaagtattgctgctttgacaaggaactgatattattctttctttctctctctcttttcttttcttttctttctttctttctttctttctttctttctttctttctttctttctttctttctttctttctttctttctgtctctctctctccccttccttccttcctctttctttctttctttctttctttctttctttctttctttctttctttctttctttctttctttctctctttcttctttttcttcctttctttctctctctctttctttcttttgacagagtcttgctctgttgcccaggctggagtgcagtggtgtctcacagctcactgaaacctctacctcctgggctcaggtgattctcctgcctcagcctcctcagtagccaggaccacaggtgtgcaccaccatgcgtggctaatatttttttgtttctacaaatttttgtagagatggggactcgctatgttactcaggctgatcttgaactcctggcctcaaacgatcctcccagttcggcctctcaaagcactgagattacagtgcatcagcaaccatgcccagccagtgaactggtatttttcaatcaaggcttacataaattccagaacattctaagtagtctcaagagaggttagacgaaaccagtttaaatgtttcttaacctacagggaagacgctgtgtcatacttaatggtgtggggagttgggcggttgtttgggttgggctgagctgaggaggagttagggggtgatgtgtgaatctcggcacaagcgtagagtgtgaaaacattcaacattctggggggtgttttccacacagaaaataaatttactatagttcagagaaagagaaatataacagctaaaaatacatggaaggatgtttaactccctgagtaattagcatagtatcatagtcaggtgggtagctttggagccaagcgtggagtcccggctctgaagttagaggtttggccttctgcaagttacttggttgtacctcgtttcttcctctcagaatgaggacaacatggcctacctcataggcattttgtggtgaagggagatgattcaaggcaagcacttatcaccaataagaattccaacaataacaataataaaaatgttaattagaatggaaatgagttgccattttccagctataaaattattgaaggttaaagatgacattgctcagtgtcacagagatacagtaaggaactttaattggtgccctctttctggaaagcgtgattttttaggatttctgtactttttttttttttttgagatggagtttcgctcttgttgcccaagctggagtgcaatgtcatgatctcagttcactgcaacctctgcctcccaggttcgagtgattctcctgcctcagcctcccgagtagctgggattacaggcatgtgccacgacgctcggctaattttttgtatttttagtagaaatggggtttcaccatgtgggccaggctggtcttgaactcctgacctcaggtaatccacccgtcttggccttccaaagtgctgggattataggtgtgggccaccatgcctggccggatttctgcaccttttgatttagttctaggatcctatcctagggaaataatcagaaatgtggggaaatatgcgtgcacaaaatcattcactgcagtactatctatcttcctgaaaaactggaatcaacctccccagcagtggagaactagttaagtaaactagttcggtacgtccatacaatggagtattaggctaccatatacaattatttgaagcaggttaatgatgtgagacaatgctcataaagctgaaagtgaaatatcttcaaactggctaatggaatatgtctatgtgcataaatgtaaataaaatacgccaaaatgctaatagagattctctctggatggtaagatgattgatgatttttgttttcttctttatatatttttttgcggttttcaaatattttacagtgagtctttattcatttttataacacaaataataaaaattacagaaagaaaatgagacccagttgcctctgagtcgttcccctttttaggaagtgagtgttttactatggatccgtcctggcatggatttcctagaagcccatcagaaggctttgtgtggaaccgttttttactcctccctgattcacatggaaataacaaatgttttggggatggaaacaaacgtttatttcatttttattttttaagagacagggtctcactttgttgcccaggctggagtgcagtggtgtgatcacagctcactgcagactggaagtcctgggttcaagggctccctctgcctcagcctcctgagtagctgggactacaggtgagagccaccatgcctggctaattttttaaattttttgtagagctcgggtctggccacgttgctcaggatggtcttgaactcctagggtcaggtgatcctcctgtcttggcctcccaaagtgttgggattgtaggtacgcaccaccatactcggctgaaacaaatattttggaacaaagaggtagacatgggtgtgctgtggagacagcatcaggcacagtgcattgcctgtcctcgtttgcatgctgccctgaacttcattagcttccaggaagccacagacagggtagactccccaagtgctagtcagtagcaaagccacagccagaatggaaatcagctgccctctcttctttagaattgtcattggaaagccaggaagcagtttcttaaaacaaaaaagcagccctgcccactcaatgctaatagaacatggggctggagatgcctgggatgctggaaaaacactcagcagagacgatgggcccagaggagggggcatctcccaggaaacaggcctccgaggccagagctgcatctctggtttctctcacctgccgcaccttgcgtggcgagaacggtgccatgggaaggaaatgtttgtaaattctgtggtacattgagtgcaccaggggaacgggctacttaacagagataattttcttatacaacaaatatattttgaggatatgtagcatgtcaggtcttgggctatgtgctagacattccctgctgagtataaaatagaggccttggcctgtgtggagtgaacccatttttctaagttggacaacttacttctgatatatctggtttcaaatcagaatttttaaatgtattggttttactgaaaataggacacacttgctttagatctgtgaaatattgtagaaatagtgttttttttcttttagtgcagatgtccccagtgttctataagtttaaatatttttgtttaattcattcttaacaccatcatctgtgagatggggcaaggagggggagccacctgacttcaagtgaggactggggggacaggttttggccctaactttgccccttctgaaatgtttcaggccacccctcgacttccgttcaatgatactggctttcatgattgacggttgaccactggccacttggaggccctttgctgaggagccgctatatgttttctgccattggaagccattcattcattcattgtagagcttttttaaggcttgaaaattcagtggctattgtgttattctttcattactctgggtgccagaatgagctccctaaaatcctcggaggctccaggtttggtttagcaaatgtaaattatgacttctgtatggatgcagctttccactgttcagtgtgtcgggacttgggttccctctccctgcttttggaatgcgcccaggtgttttgcttcttttaaagatctgacatgaccgtggccagctctataaatagttccaaacagcagctataatgctggtgtgatgctgatttttttctctgccacccactgaaagtcttgggagaaaactctctccgtctttctctgtctccctactccgtctctctctgtctctgtttccctctacacacacacacacgcatatgtttatagttccatgtctaaacagaagtaaaaattttgaatgtgttcaaacacatctgtggttttgtttctttcatttttttagcatttaaataaaaaaggagttaaaaagcttttcaacagtggagaacaaaatgacttgcctaagtacgtactatgtccaggcatggtgctgaattaaattagctcctgtcttcagagggcagagttcagcaagagggcacctttttcagcagccaatcgttccagccttcctggggatgaaacataagaagatacctttcatgtattcctggggacttcacagccacacagaggatcgttaactattgtattagttactagtgcagtcgtaatgaagtaccgcataccagggtgtttcaacaacagaaatttattgtctccagttctgaaggctggaagttcaaggtcaaggtgcctgcagggctgggttcttctgagggctgtgagggaaggatctgcccctgaccactgttcttggcttgtagacggccatctcctccctgtgggtcttcatcgcatcttccctctatgcgtgtctgtcactgtgtccagatttccatttttataagaacatgagtcattttagattacagcccaccctaatggtctcgttttaatttgacacctgggtcaagaccttctttctaaataaagttgcattctgaaggagtggaggctaggatattaacatgtgaattcagagaggatacaattcaccctgtaacaagagtcttttaggtaatgcttctccctctgggaataactttccttaaaccatcccaggctgccagattcgtaatacagtccatctgtgaacaatgaaggggttaagggtgccaaccccttgcacagtcgaaaatacatgaataaattttgacttcccagaaacttaactactaatagcctactactgatcagaagccttaccaataacatcaacagtcaaatcacacatattttgtatgttctgtgtattatatactgttttcttattataaagtaagctagagaaaagaaaatactatgaagaagatcataagcaggccgggtgcagtggctcatgcctataaccccagcactttggaggctgaggtggtaggatttcttgagcccaggagctcgagaccagtctgagcaacacagcgagacctcatctctacaaaaatgttttaaaaaagtatccaggcatggtggcgcctgcctatagttgcatctactggggaagctgaggtaggaggatcacttgagcccaggaggctatggagctatgatcatgccacaaagcattccagcctgggccacagagtgaaaccctgtctcaaaaacaaacaaaagatcataagaaaaagaaaatgtatatactatttatatttactattcattaagtgaagggattatcataaaggtcttcatcttcattgtcttcgtgttgaggaggcataggaggggttggtcttgctgtctcaggaggggcagggacagaagaaaataagaaaataagcgggtcattgcagttcaaacctgttcaaaggtcaactgtatttctttccccctgctttcactaaggagtgagttccacaattcacattattttcagatttaattctacaagcccaatccctttactatagctaagcccatttcctcttctgtggtgctggtggagaacagcctgtcgccacccttggtctagtgggttaatagccattttcaaggccatgacatatccgtcgtctttcccattcccacatcacttgttggcctccccttggtacagagctcttctaattcaacacaatcgtggacacctacaaggaaagtctcaggggggttgggtcctgggccagatggatgcacagaagggcggaccaatgacctcctccatcgtcttactgcctgaccggcccgggcactgtgggcagaacttgtacttcctgggggagtagcatgacctcagttgcatttcagcttccatcctgggcttggcggtgccctggggctgaagcgctgactctgtcagttcacacacccaccacccccatggcccatgaagataccacaccccacacacactctagcctgctttcccactgttctttccaatttggaaatcctgtaggcaataactggtatttttgttgccaagatggtaggggggtggctgcaagcaccaatatgctgtattgactgtcagttccttttgcacccatgcttattaactctttcttttcaaccaattcccctgtaacaacaacaagcttatcagctcgtctgttgtctccccctcaacatgcgcttgtcttaaacctgcagtcaccacacctggggggttggtcctgggtaaaggcaagatgcagtccagtggtacatttgatttgagcacacacatctggacaagagtttgtatgtgtactatgggaggggacacgtgggcagggactcaaggggtcaattatgtttgcccaggaggaagccagagatccaccagggagagctagaactctgaaggccaggaatagacagagaggcaagcatctagctttgtccctggatgtctgaatgccttctccagatgttgcaggggttatattggacagttcctgggtgaggtaccaacaaatacagcccgtggaggactggccagcatatgtgcattttgggggggctttcacctgcccttccctgacattctggagtgcgccatgtgctacagactggaaatcagtaggaaaattggaagagggagaggcatttttcttccattgaattctgaatccagccatcactgccttctttgatgttgtttactaaaataagccatgtccgaaaccacgcctgctgcagtccaatcagctcagaccaagagttataattaggaaagggcttgggccactgttcagataaaactactaaaataaattccaatagccagaaaccatccaggtgcaaaagtgtaaccatcaataaattgtgcttaaattgggtatgcttacctgccctgagagggctacagagaaacacattctaagtataaagcagaattttcataattttcacctgtgggtgagagagaaggggaagcaagggaaagatgcatgtgtgtagtttagggactgctcttctctgggtgtgccagagacccaactgtgagattcgaggcaggtggatcattccattggggaagtaggaaagggttaaggtgaatgctgacatttactcccagtatacattatatccatttgttaaccaaaacaaacactttcttcagaacccactaaatagccaccacccaccatcttcaggtgagccccaaagttaactcttgccaggaggttcttctctgcaaaagaatgcccagtgctgatctccacagctggacgtgacgggtgtggccagtgtgggtgcaatactgggtggcaccagttctgcctctggaggagcactgggcacagcaggcattcactggggtgctgagtgctcagaacttaagccatgaaagaggctgacaacaggtctgagtgttttatagggagtagtgtctggggcggaagttacagaaaagaagcagcaagatgagtgtgtgcttgagtgtgtgttcctggcggaaaggacctctgataggagaaaatgcagctcaaatcccacagagtcactcatcatcttcccttttccctaatctcaaatgggagcagtaggattgtggtgagagttgaacaggatcacgcacgctgggcttactctgttaatgttaattaaggtcctcaccccctctcaccagcatcccagggtggaaagctcaggttgtctgaatggaatttacatcatcaaaaacaatagaagttaaaaatagtgaggaggacggacgttctccaaaaggtcacatgtcctaaccgctgatgaagtgaaaccattttaagatcctctgggactactttgtggggtgaccttgtttgaccagatcctgtgaatctagatcttccatgggcagagcatggcaggcaggtgtgggggctcctttgttgctggatgacctagctttgtcatcagagatgggtagactgaggaatcaacctcttgaaggagaagccatcttgcctagtaaggtcacagagactcctctgtaaaacaagggacccatgcaccattttggggtctttcactccccaaagccagggtgagggatgagcattccacggccaagtcaaggaatccctgcactgagtggggccatcacagaaggctgtcgttgatttggaaacatctgccctgccacaggaaaggtcatggcaacagctttcggtgactcatttgcattttgtataatgttttaaaatagctttatttctgagagccattaaatcctgataagtgggcatttttgtagccagaaaaacaaataggaagcaacattagcattatcttttctgtgcacatgtggcagtgcatccaaggaatgctgatttgggacttgggttgccaatcaggtgacacagggggcttctcagatgggctgaaggcaacacatccctcaaagctgcagttgccccctttgttcctcccaaggattcttcatctaaatctctctgtcaccttgcatggataatttttttttaacctcttggggcttcagagactgaggcttattggtactgacaagccctgattatttagaatcctggaggccatggtttctgctgtgctggtccacagagggttgagctgactgaaccctgctgacggctctagtggtctgtgttttgttaagggctgtgtggaatagcacttctttccctttaaattccaaaacagctgacaaaaactaaaaacaaaaactaaagacaagcaaaatctcctttgggcccctccaccccctaccccaattggcatcaaccatccccccgagttcaaatccagtgttgtctttttgataattgtcttataattctaagcacccagaatgttgcagacagcttacttcgggcattatctgagggggtgtggagtgagggactgctggaaggagtactctgctgtcaccagcacctttgatccactgtgccacccttggcaatccccctggccccctaaggcccaccccttacccccaacagctcactaaggcagagaggacaggtgcctgcctgcccaggacaggagctttgagagcacactggtggcatttcccagcttgtttactctccttctccagggttggggggggtactggggcccccgaggcctacagggagggggagtcactgttacttagcaacagccacatcctgtgacatgacttgtgtctgaaggaaggatgtttccgctggcacctggagggctgggcagcttttggtggtgctctgtgggatgcccccttcagacttcttccttgtgggatactgtttctgcctggagcagaggcttgcctgctcagtgtgtgcgtgtgtgcatgcacatgtgtgtgactatgtacacttgtgaatacggtggatgtgatgggagtggagaagctgcttgagcagctcctcagtcagtgcaacctcagaggtcctggaaggtgctccccacttccaagcagaaactccctcccctgtggctgatggctgcagctgccagaacttctgaatttgtcagttggccctgatttcagatatcctcttctactttgaaatcaagtcccctgtttttccctgaaagtctaaaatttgagatgaatttctttcacattaagctttaatctgagctgaaaaaccagtatatttaggagtggaaactcattttaactcatcaggaggtagtttgtcaaatcctttcctgagagcgcatttttatagaggagaaaagagcatgagggaatgagccacgtggtggaagagacagacttccctgcagaggaagtgctgaaagggaaattgtgcatgctgtcaatgaaggatgagtccacacctcagtgctgtcctgggctagctagcgggtgggttgtcttattcctcttgggaagaccaaactcactattggcaatggtacccttcattgctccatgtcctggttgggaatctcttttttccctgccttttcccactactcccttgcctcccttctgccccagccttctctgcagctcagtggagattttgagaattccttgtatattgcaactttatgcttttggtatttctggatatgaagttagagaaacatggctgtctttttttctggtgcctgaagttcagccttattgtgtctattttctccacatccctttggacttgagagtgggtagggatggagtagggaggaaagagaaaagaaagatttagctttatagggagaggaggggaaggtgaaatgaaaagtggaaaggagtctttggacattgtgcactcatagaattgtactaatcttctcttcttgggcctctttatttgctctgtagcatatttaagcaaatgttgtagcaactcttgtaaaagagaaactagtgcctgatgtctctgtggggcaggaaggcacaagctctgtctttacctgaatgagtgggcagtggagtcatgtatcttcccatagagtagccctttcctttggggatggagaatgtctcaagtgaatggtctcattcgtcaagcaacttcccttgaaggtcactgaagaggttatggggcttgctttacaaataagggagctggtaaagagagagaagagtgatgtacatgcactcataccactgtgcaaaatgggcaagtgacccaggacacaacagctgctgacattgtggctccagcatcctcttctttagcctggtaagggaatctctgctttatttgcaaaatctcaatgcagacccatttctgccttgaattgttaaggtccacagttataaaatggctttattgagtcaattgcctctttttattcagttactcagcaattatgtttttcagcctctatcatgtgcctggtgtttgaaggacatgttggtgccagaaatattcttgggctctatgaatccattctcagtcttgtacgaggacataggacacgtaaggaaagaaacatactgagggctttagcaacacaagaaagatgcaactggaataaataattcacttctagggaaggataatcttctcttctagaattaatcagacttcttaatttttaagctgtgtgtataggggagggaaaaatggcttctctctgccctcccaggttctttagttgggctacaaattaaactgacgtaagacagattaacaggagaaaaaacattttaattacatgcatacacatgggagtcccaccaaatatgagacttgaggaagggtcagatgattgaagctgatacagagtcctgggctacagaaaggaagaggggccagagcctccaggggaggccacaaccagccactggagggcgaggggaggaaatgcatgatgaacaaaggctgtcttgctgtgcaggtaaaaagtctcttagggaataaaagttgtctggagcagcccttttcctggtacagatacattcactcatcagatttcctttataggtgtacatttattttacaaaaggacatcttttcagagctactcctgtgtctgcagtttcctagaataaccagcccaaaatatgctatagaagtgtattttggggtggcatattctggtctcctgctatcatattttggggtggtgtgtcctgagccccaacatgtggaaaattggaaacatgcctaaggatggtaaagaaaagatcaggggacaagcacagtaagaaagaacccagaagtccatgctgtctcagccaggaggagagaaggcggatcggtgccctgctaatggtgctcaggtgtgtggaactcttcactgagtggtcatgcatcgttcttcagttgcctaagaataagacgtcaggaatagctgctttttgaggatataacactgggtattgttcgaggaattgtatgcacatgattcactcacattttctcgtgattgtgaaggactaagtgtcagttactgtcctgggcactcaggtggacgtggtaaaatccctgccctaatagagcttcaagattatctccttttctccttttgttcttctaataatcttgtgatgtagatattcttattcttcttttctagataatgcagttgagactgagagaaattacatgtgttagccaaatccagccatagtgcctggcaggctggaggttttagtctagatctgtccgacaccaaagcccagcattatgttcctttcttgtgggcaaaaaacaaaaacaaaacaaaacaaaaatccccttagatatcagtgtaagggaaatagacaccagccaattggtaaatgttcactggggatctcaactaatattctataagacagtggtgttatgcagactcgaggtggtgtaaagtttcataagataagtagagtttcttgatgaagatgaaggttgtctggatcttctagaagcatggctcatatttatatgtctaaagggtgggctttccaggtaaagggagtaatacaaacataagtgaatagaagagaaaacaagcccagacatgggaaatgtgagggaatgaagaacagcgtctaaaccagtgggctcaggttgggggattcatagcaaacagggttggacaggtagagaaaatgcagcccatccctgcaggactgtgagatcaggaaggggcactgcagtttggtataatgggcaatactgccgattttaaaatagggacaccacatgcagtgatggtgtttaaagattgtgaatcttctggcgggggtgtgcagtatgaactagacaagtggagttgaagtcagggaggctggctggtgtgcctgcttttggtggcagccaggcagtggagaggcacgggcaggcacttctcaaaagcctgttaaggcaagaatgcagcattagagatcacccagtcagctttaggaacaggggggatttgtgataatctttgcttgaagatgggagaagagagtagacaggtcaggtgaccttggaccctcttctgccttaataattccaacccactcattttctttcctattgttttcttgtattggctgccactgagccctccttggtgcccaagtgcagtctgtggtgggtggactttcttgaccctggtcctagggtagtgagatgttgtatcctgagaaactgctgggataagccctcagacagtgcagacataggtggggtgccaggtttacttcctcccctgtggttctgtagcagggcttagctgctcctgcaggcagagtcctggagctgcaaggagctgcaggcacagaggagaatggcttgttttccttatataatgtaggtttccaagctgctgtggcccgcacagcactctgtctcctgatatcctgtggtcctcttgattttgtctaattttattattttgaatacaggagatttataaatggaaacctaaatggctttttttccatgtaaatacacttgcaaaccagagcaaaacatttgttcattctgcactcaacaaatatattatggatatgtgttatttatatatcatatatatgtccataatgtatttgttaatatatttgtgctaatatattcttgcctctggggtacagttaaggacagaaatccttgccatcatggaacttacagtctgctaagtggagacaaccagaaaaataattaggcaaatcctttaattttttttttttatattttattttaggttctgggatacatgtgcaggccatgcaggtttgttacataagcaaatgtgtgccatggtggtttactgcattctatagtattttataagataataaatgcagagtgggaaaataacagagtaagaagagggattgggaagtctggggaaaggtttgcagaagaggaatggaatcctacagatggtggttaggtggcaactgaacaaagactcaaaggaagtgaaagagattgagctgtgtgaacatctgagaaggagacttccagggacaggaaatgccaaatccagtggcctcaaggcagactgtgctgctgtatgtgagaggcagcaaggaggctggtatggctggagtggaggaatgaggacagagagttaatggtttggacgaagaggcagagggtggagggtgcagatcatgcaggaccctgcagctactccaaggattttggcttttactctgagaaaactgagaagccactggggaggcctgagcaaaggaatcataatctgacttatgttcaccaggatcactttgaaaacagacgctacggcaagcttgtccaacctgcaacccaccagctgcacgtggcccagatggcttagaatgtggcccaacacaaatgcttaaactttcttagaatattatgatatatatatatttcttttagctcatcagctaccattagtgttagtgtattttttgtgtgccccaagacaattcttccaatgtggcccaagaaagccaaaagattgcacacccctgcctaaggggtaagatgcaggtgcagaaggtctagggggaaatccattgcaataacatcggctagaggcgatgttgccttccaatggtggaggctgtagagatggtgaaaagagatggatacattttgaagttagagaagaagaaagagaagagttaaggatgacttagttagagcatctataccagtctagctcttgcagatcttagtcattctgtggctagccattgagctcactgtgccctccgagtgctgtctaaatgtagattagggggatttgtatgccatatgtatgtgtataaatatgttcacatgttgcatgcatgcatgcatatgcatgtgtgtgtatgcatgtttatatgtgtatcctgttggatatccacatacacagcactgaatttcttactcgaggactccccgggtgcttgccagctatttacacaccagagagaagcaaaaactccctcttgcatttggttgcacattttgcaggtgttgccctcctcttaattattcatcaacttcctttcctaaccctcttcttttaggaacttagggggaaaaaaagataaaacagccagatgtgagcccagtctcatcagtaatctataaaacaccaagcacaccccactcatctttcatgctttatgaaaagttaaaattaaatcagggcagcgttattaagctaagtgatttttgcttggtttggatgaattcctatgtgtgccacattgtttgttggaaacgtgcctggggtgccagtgggctcagaacgcacattcaccagctattagcggaaatgtttctgctcacaatgtggcatttggggcgtcccagtgccagccctggggcaccagcattgtgtgcagaacccttgtgcccatagccctaagtcctcttgtgcccaccaattcttaaaaccagaaagacaagatatagaactaaagcaaaggagtgcagctgcagccatcatccctggtttagtgatagatacaaattcaagtgaaagaactttaaggaatcactttctttctaggggcccttgaaggtcagggttggtgatagtgtattttcggaatgccttgttctaggaaggctgttaaacagaattgttgatccctgctttcagccaggagacattcagaagcactaagcttgtttggcacttggcacacagagggcactcctggggccgaggctttgtcgaatccagtcgcttgcatcgtagctctcttttcttttgagcagctggaaagttagttggtttggccttctaaaatctaaaaattggttgggacgatcagattgctgtttagcaaatggcggggggaagaaagaatgtcccttagggcccaaacttctccacattctgcgtagtacagtgaaaacagcagaagacggagtctaaaagtccgggttcgagtcccagctttagaaactgaggctgtgtgattgcaggtaaccaacattctaaattccagttttcttctgagtgccagtagaatataaaaggcataatccctcccaccacggttgctggggagagcagaccgtgtatttcaatcccccagctggctgtgcagcatggcacagatggcagatggatgttgatggtcattgtccatcctctgagggttctggagcagagaggcctgggctcactcatagggtttcccagaggctgaagccacatcctgcctggaagatccctctgccattggtcatttccaactcctctccatggcccagatctgcacggcctagcacaggctgcagtggtgatgcaggccgaattcggggaagatttcttttttctggaaggtgacattttcagagggatatcagtcgtggcttgtatttgcaccttgtattttgctttcatgtcttcctttttgtcttggactttgtaaggcaaaacattgtgtgatactccgaagcgagagaataagtggcatttgtcactcttgctacaagccgttgagaatgtgtgaatgcagcaaaaggttgattctttcagccctcacttttgctgagatatgtccgtgcaaaaagcgtacgtttaaagggaatcttgcatcaaaatttgccagtaagatttaatttcacatttttgcttgaccttgcacagaattcattgagtaaaattctgggctgtgtgcaatgtcacccttttatttaaaaagctgacttcctaaatagaggaagaatttcagtaagcatttcaataaaagctttctgaattttatatttttaggaacttcgtacctcataaatattggaattttatatccaaatcagcttcagtacattttcaatttttgaaatgttatgacatatagttcaggttttgggaaatataatttgctagactttttacagccatctcctcacatgctagaggctctctctatgtttttgctgaacttaaagttataccatcacagtgcataaaaataccagtcactggggtaggtcacaacccaactgtcatcactgagacaaagaatttaaaatggagacactgtggcacctttatgacctggggtcatgatgtcatcaccagctcatcactgccacaactggggtgagtacccaggccacacagggtatgtgtgatgcctcacttttttgtccctgctaccacattgcattagctgccagaatcatcttttcccacctacatagggaggacctgaggtgtgccatcctggtcacctgtcatcctcagaccatcttgcgtgacaccccagcattagagacccacttttctcaacttctctccaactgcttttaaaataaaaatgctttcatttatgcaaagttctagtgacatattaatatcagatctgagggtgtacatccagcatagtaagaggagaacaggaaactctcaaggaaagaggaatcccaggcgaggtcatttcctgctgattttcgtggctcaggcagattggcaaatgcctttctttctgctccaagatgaaatgggccagatttcctgaacccgggaacacccacctctggtttacgtccatccaagcacaggtcaggtgcattcattaattgggaaaagaattaagaaagttatttaatccgggaatcagattccatgcagtgcacatggtgactgagtaccttccctatgttggacaccatgtgaggcacaggagatacagagataaatatggacaaaagtacattcccattttctaggactttatgatctaattgaaataatgtgtgataattattttgatataggtaagtgttgtaataaacttgtgtgtgtaaaatatgaatagtagagcatgagtagtggtgatagatggctttactttggtttctgacataatgattttcacaaggtcttccataattggtatctcatgaaagttaactattctaattaattttgagggtaattttgtgtattcccctcatcaatgactgtcctcatatggatttttaaaactctctaccccttgtctagatcttgctatgagctgctttgctgtggtccaagcaattagtactggacatttctactggaagctgcataggaactttcaacttagctggttgtgaactgaacccatcatctacagctcttctcacagcctccacttccacctcctcttgtgttcttctctgccccagtgaaaggcaccaccgttcacaccacgtgccagagggtagttcttgattctccttctccctttagctacctcatcaaaggatgcctaagacatgcagattccacttcatactgatttcctttgtacctccacttctccaaattctcctccatttctggaacagccctccataatccttcacatggtttaatctacatgcttttaccagttttttttttctcctttctgagcattttccacattgtagcaacagtaatacaaatcagatcacctcactcccctacttaaagctcttctgaggtccgcgccatccttgggatcacacccagaccctttcaacaaggcttccatggtgctgcgtggcttgctcactgcttgctattccagcctccggtcttgccactctcctcaccctcagatgacctctgcttcaccagaatggatttttctttgcactggctgcatcacctgcttccaaccattagtcctttgcacaggctgttctttctttctttctttcttttttttttaaattatattttaagttctagggtacatgtgcacaatgtgcaggtttgttacatatgtatacatgtgccatgacagtgtgctgcacccattaactcatcatttacattaggtatatctcctaatgctagccctccccctccccccaccgcatgacaggccccagtgtgtgatgttccccttcctgtgtccaagtgttctcattgttcaattcccacctatgagtgagaacatgcggtgtttggttttttgtccttgcaataatttgctgagaatgatggtttccagcttcatccatgtccctacaaaggacatgaactcatccttttttatggctgcatagtattccatggtgtatatgtgccaaattttcttttttttttttttttaattttttttttttattatactctaagttttagggtacatgtgcacattgtgcaggttagttacatatgtatacatgtgccatgctggtgtgctgcacccactaacgtgtcgtctagcattaggtatatctcccaatgctatccctcccccctcccccgaccccaccacagtccccagagtgtgatattccccttcctgtgtccaagtgatctcattgttcagttcccacctatgagtgagaatatgcggtgtttggttttttgtccttgcgataatttgctgagaatgatggtttccagcttcatccatgtccctacaaaggacatgaactcatccttttttatggctgcatagtattccatggtgtatatgtgccaaattttcttaatccagtctatcattgatggacatttgggttggttccaagtctttgctattgtgtatagtgccgcaataaacatacgtgtgcgtgtgtctttatagcagcatgatttataatcctttgggtatatacccagtaatgggatggctgggtcttacggtatttctagttctagatcctggaggaattgccagactgtcttccacaatggttgaactagtttacagtcccaccaacagtataaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgctttttggctgcataaatgtcttcttctgagaagtgtctgttcatatcctttgcccacttgttgatggggttgtttgtttttttcttgtaaatttgtttgagtcctttgtagattctggatattagctctttgtcagatgagtagattgcaaaaactttctcccattctgtaggctgcctgttcactctgatggtagtttcttttgctgtgcagaagctctttaattggatgccatttgtcaattttggcttttgttgccattgcttttggtgttttagacacgaagtccttgcccatgcctatgtcctgaatggtactgcctaggttttcttctagggtttttatggttttaggtctaacatttaagtctttaatccatcttgaattaatttttgtataaggtgtaaggaagggatccagtttcagctttctacatatggctagccagttttcccagcaccatttattgaacagggaatctttccccattgcttgtttttgtcaggtttgtcaaagatcagatggttgtagctgtgcacaggctgttctttcaggagagttttctcagtcatgattcatctaattcatacctaccgagcacttagcatgtgccaggtactggaccaagtgctgctaaacaaaagagacagggtcccccctggccctagcagagtttcagactaatcgaggaggaagcatgaactattaatatgtaaataccaataatgatcagtaagagaaagaacagggactgtaagagagtgtcagaagctctgaatttagattaggaggggtggtcagcacaggcttccttgaggaagtgacaatgaccttgagatctgctccttttttgggtctgtctcccaccacttctcctgggaagcttttcttggccttcccgatggtgggtgcaacagcctcctaagggctcacatagggccaggtgcttcccctggtcagtcattggtccgattgcactgcatgtagctctccacctccagactgcagactccaggacgaccaggcagagccatgcttgctgcttctcccatttcaaacagacaaggggtcgctcatgaacatctgtggaccattttgggtaaagccagaagctcttcccagtcaagtgagagacatgtagtatgtggtctgtgttctctgccaaaattctccatagactgaaaagatttgggagctattatcctaaggtccaaggtggcaaacgcacagatctatggctgggtgctattctcaccctgtggctcttcacagagcttcatgtgtgggcctggaagctcataggaaggaatattgctgttgtccaatgtaacaatatcatggtgaaaaggaatattatattctctgaaggacctaagatgatattggataaatgaagtgaaaaattgtctgttttaatcaatatgttaattatgcctgtaaatcctgcggacagagtgtggcaatgaccttgataaatactggatcctatctgggtccagcctgacctctgctcatctcatggtcccagcttggcctctgctcatctcgtggtcccaacctcccctcaggctgtaaaagccatgagaaccatcatcattttctttttaattgggagatatctacaaaacagccttttgtggcaggtgtcattactgaacgctgactctatataagcaaatattattctccatattttcagatgtggaaactgaggctgaaaagatctatgtcttgctccaggcacagctctcagagctgggattagtccttaatgggtctggccacacggaatccttttctagaccatattacatacaaatttgttacttttcattcaatagagttaacaatctcttccttcagcctaacctcgacatctttctctctattttaaagttgcttgggtagtaagactggaaagtagatccaggaggtgctgcagaaattgctcttctgatctcattacaccaaaacaggaacttctgtgacctctcctgccttttttttttccactcacccctcatgacctaacttggctgctcatagtcatcaagggctcttttagaagcttggttatactgcagggtaatttacattctccaccgcccattggcaattagtgcatctctcacgtgcacacacagcatttgctttgacatttgatgggacatgtatagacttgtagaggagaaactgcctcttacctggagcttctgtccttaattggggttgtcttgcttatgttaaaagcccactgaaggcaatagctgggcctgtaattccccttgtccgataattaactcagaatccttaaggggtgtgtgtgtgtgtgcatgtgtgtgtgtgtgtgcgttgctagacacttctactgccaccggcagggattttgagggattgaagatttgggtttccatacatgcactcctgtcaggggaggaggatggaaaaagggcagaagcaaaggaaggagcattgcctttcattttgtgaatttgtgtcacctgagcagcctcgtcaccagctgacaagggtggggacagcattcctgcaagggagagctacctgggatggctcctctgcagcttctgaggcagggggaatcacggcaccttgaaggcacaggacttcactgggtattttgcataaatctaatttcccaggaacacacaatccttctgaagttgctgaggtcaggaccggaaaggcaggcgccagcagccctggtccagctggggaagaaacagcatttacatagtgtttatttgctcctcaagggtgatggcagaggctttccttgggtttctggagtctcctcagtttagttaggtgcaaacaaagtgcatcctaatgttgagaggatgacaggacatgcttcaccatggatcgtaaacatggctgttctgcagggtccccttttgtctcccagggaatggcaaagacccgtgtacaaatgagcatggacagatttcctgtatttgatcatgttgatatggaggaccaggggcaggaagatgagcacggtggagaagaggagaggagtagggagaagaaatctctaatgagaggaccttgctagtaccttgaagactgaggtgggctcttcattggcggaatgagccctgtgaaccgaggggtatgggaaccttttttcaccctagctctgtgactgatcttccgtggagcctaaaatttttccagttagtcattcctctgggtcaaggcattgaatctctctaagacccaaagaaatgaagccatcttctcagccagtgtagcactttagcctgacattattcattaatgcatccatatacttgcttattaaacctgtcaatcttaggatccagaaggaagaggaaaattaccaccagatctcaattccaagccagcttccagttactgaggatctgttttgcacatggccttgtactaaggggacttcagggagcttgtggtctaataggaggcaaaagacaaaaacaatgttgcaaaatataaagagtgtttcataaaaggtgaaaatgagcaccgcctcacccccattgatttccctgtttcattagtggcaaatctcttcttccggtctgtctgttggagctcttgagtcactttgacattcccgttttcatgtcttctcgtgtgaaaaaagtattgaggtctattttaaagcatacgataaaacgcatagatcttaagtgtagagctcagtgagctttgacaaatgtttaccttgtattccctccacccaaataaaatatacaacctttccatcacccctttctggtcaataactcccattccccagaggcaatcattgttcttatttctctcctatagggtggtctcgtctgcccttcaacttcatataaatggatcatacagtatgcacattgtaatgtctggcttcttttgcttcaataataatgttttttgagattgtcccttatatttgtagttcattccttgtgttgctgattttttaattgttccagtgtatacatataccaaagtgtggttattcatgttctgttgatgtgcatatgggatatttccagtttttttgcaaagtttcaatgtatattcttatatgagcctttttggggacatatgtttttatttctcttggataaacttctagaagtgaaatccttgagtgatagggtagatatatatttcatattagcaaaaagtttctaaacagttttccaaagtggatgaaacattttttcctttcacctacagtgcatgagagttcaagggactctgcctcctccccagcactatgtattgtcagcctttttaattgcaatcattctaacaaatgtgtagtggaattccattgtggtccttcatgtaaaattaaccatcaagtcccagagaatcatttcttgacattgtctcttagacccatcttttctgtttgtttttgtttttttttttaagagacagggtcttgctatgttgcctgggctggagtgcagcggctattctcaggcatgaccatagctcactgcagccttcacctcctgactcaaacgatccttctgcctcagcctcctgagtagctgggactatagatccatgtttttctttcctttttttggcctacagttgtaacccagtcttatatacttttttgtaacccagtctttatcaacttgtctgaactaggcagtggtctcttcacttgcctccctccctccaggtaaccaggctcctggtattgcccaggtagcttcctgatcatctcgatcttttgctgctgaaaatctgtaataactaacaccaatagcaggattttcaaacctttaattatttatgactttagtggagaacactttcttcacagcagagcttgcctggttaaaaaatggatgaggccagcttctcccccatccccatttgcaatccctttccagtggcagactctggggttcatccacggggctcctgtgctctttggagtctatgctggaaaccacctactgaccagatctccctgacctggtgccagccatgtgtagagcatcccacatctccttcaccttcccttccagcccctgaatgcaaaatgctcttccctgtccctggaaaggggatgcccacccatctcccaatgtcacctggggaaatatgacatcctttatgacaacatgctccaggattcatccttcaagaggtcttcagggttgatgtctcctggctttatgctaccacctgcctgtagtcataatcacctttgattctgcagtgcccagatgtctgacattcaatttcctttatattatggcctcaagctacttttctcacattagctccatttacctccatgctttaacctgtactcctgccaagtggtacacagaccatcctgtgcaaatttctctgtccacatctttgcccatgctgtcctcccttacctggagttctctcttccttttgctttctttttccaaccctttccatctttgcgctgacccctgaattccacttcctccatgaaaccttctcaggacaccaaatctagcagtgcactctttctcctctacttagtatctctaaattcctttggcgctcacatctttcctaatggttccccattagaaaagctcgccatctgtttagagagttaagacaaacacaaatgcagagatcagtagccgcatgatttaaacttcattgtacatcccctctgcctgtcctgtgggcctgtgtgaaccaagatttactggggcccatgtactattccctaccggggggagggtcttgtggcagggataactaaattggatcccactttaaaaagttgtggtggtggctgggtgtagttgctcatgccggtaatcccagcactttgggaggtcgaggtgggtggatcgcttgagctcaggagttggagaccagcctgggcaacatagcgagaccccatctctacaaaaaaaataaaaaaataaaaaataaaaagtagctagggatggttgcatgcacctgtagtcccagctactcaggaggctgaagtgagaagattgcttgagcccaggaagttgaggctgcagtgagccatgatcacactactgtactccagcctgggtaacagagcaaccctgtctcaaaaaaaaaaaaaaaagttttggtgaacagaatgacaacaccaaatgctggtggaacagagctacctgtaggtcttgtgtaggactgaaggacaaattttactgtcaccaagatttgtcactggtcaattctgcttgggaaaatgccccagtttccatgagacctggtttggattcgatccaggggcattggctacctagtggaacactttggttctctactcctacagaacctgtggagttttgtggagagagacagtttttatctctgttaaagatgtcttgggccctctgcttggaatcatctgagcctagcaacagagagccagaggggttttgagtcatttggcactagggccaaaagcaggcagcagaaaagcccataaccacctctgatgggctccagtgggctccgttaggatgcaggatgttctagctctgcagggtaaaaccacagcttgtcagaaaaataatacaggctcaaatggctcctggtctggacacaccgtttacaaagagcctaagttaagtgggcaggtggccaatttttgaagtctagtgtcatttgaaatgaacacaaacagcgggggattgcaaaaacccgtgaatgccactgtgttcaaattagctgtgggagtttcagatattgttggtgtacagtatgcatttggcataaacttcatctcaaaaatgccctacctgtccttggattttgatctttcattaaatcaatttttgttgtttttctgcgtgtgtgtgtgtgtgtgaaaacaataattagccctttaaaaaattgagtcctttaaaaaataattagtccttttgtaattagccctttagggtatctcgcagtatttctcctcctttcttttccaaatgcagaaattgaccactaccagtacccaggcaggggcttttgcctttcccttccgtactgttttaactgccaggagctgtgtgcacctgtcctccctgccatccttttgccttatccatgccagctccacctgcaggctgtgggctgagaccttggtctttgggatcctcttaggtcaggggaccattctcaggagtgaggtggaagaagaaacccacaagcctgagctaactctgccgaaagactggactcctggaatcccttctgcctgatgcattggactccctgaggtccacagtctgcatgctttcagtacttagaattcttaccacaacctccattttgtcatcactgaggttctcttatattcctcggagctgttttaccaatctgctatttgcataactatattttaaagggaagtattttggtcttcatttcctttgagctgtcctagcttcactctctataggaatttcaaattgtgtctacataaagtcagtgctcaatacatgttttcattttggagtatctcactggaaagtcatccagaatggtggttcagaacataaggtccgtagaccactcaggtttcctaagactctgatatagtttactatgcgtcccttccaaatctggtgttgaaatatgatctctggtattggaggtggcgcctggtgggaagtgtttgggtcatgggggcactctcttcatggtaatgagttaacatgaaatctgtttgttaaaaagagactggctcctcctcctctctgtcttgctccttctctggtcacgtgactcactgctcccccttcaccttcttccatgagtaaaagtgtcctgaagcctcactagaagcagatgctggcaccatgcttcctgtacagcctgcagaaacatgagccaaatcaacctcttttctttataaattacccagccacaggtattcctttatagcatcatacagacaaatacagacactttcacaggttctctcgggtcaaaactacttgcttaacgatgttaaaacattatttgcctttttcactgtgttgaagcttagactgatgaggtaaaagcaaaatgggtgaaactgggtgccttcatccaaatcaagacaatggcaccaaatcactgaaaatcagtgcaactgcctcacacccacagtaaaaagaaaccaaaaacaaacaaagactgccagttttacttaggaatgtccttgctgaagtggtagaaattatttattttatttatttatttttttgagacggagtcttgcactgtcactcgggctggagtgcagtggcaaaatattggctcactgcaacctcttcctcctgggttcaagagattctcctgccataacctcctgagcagctggtattacaggtgcctgccaccacacccagctaagttttttgtatttttagtagagatggggtttcacatgttggccaggctggtctcgaactcctgacctcatggttcacctggctcggcctcccaaagtgctgggattacaggcgtgagccactgcgcccagcccacaaattattaattgtattaaatgtcaaccttgaaaacacatctttttaatattctgagttgcaaaatgagaagcatacataaaggacttctgcctcctaccaaagtacaaagattgtcttggggaaaacacttaatgcaattgtttgagttgtgaaatgacctagagccattttcatgggatgtcatttttacctgaaaaaaaatgactggtagacaaaccatggctattcagacttaaatatttgggaggcgttttcttaaaatggcatgaaatgagcctgccatttcaaggaacataactgaccacatttttttttgcccgtgataaaattcaatcactcaagcaaaaattagaattgtgttaaagtttggaaaattccatcatgatgaacttgacagcttcccaaatcttaaaggcttttctgatgaaatggttgatattaatgagtgttctttttgggtattatataatgaaatgtatcaacatttggaagatctacataactctgaacagttttaccaatgcatgatgttacaaaatcatgggtgggtaaaggatctctctgaagtgcaagatacaccaaaagaagttttacaatggagtacaaaaagttcattggtatggtttcatattgcctattgcaagtaacctttaaggagctatcccttgtcaagttttggtgaaaaaacaaacaaaaaacattcataactacctgataaggctattaaagcttcccttttccaactatatatctgtgtgaagctggattctcttcacatacttcaactaagacagtatatcacaacagattgaatagagatgcagatgagaaaatccagctatcgtttaataaggcagacatacaagggatttgcaaaaatgtaaaaaccatgtccctcttctcataatttttctaaaaatacagctttttaaaatgaaccttttattttaaaataattttatatttaaagtaaagttgcaggaagctcaacaaaagttaatatcatagaaatataaagtagaacagagggtactagaggctgggaggggcagtggggctgggggatagggagagatttgttaaaggacacaaaattatagctaggcctgtaatcccagcattttgggaggccaaggcaagtggatcacttgaggtcaggagttcaagactagcctggccaacatgatgaaaccccgtctctaccaaaaaacacaaaaattagtcaggcgcctgtagtcccagctacttgggaggctgaggcatgaaaatcacttgaaccctggaggcggaggctgcagtgagccgagattttgccactccactccagcctgggcaacagagtgagaccccatctcaaaaaataaaataaaataaataaaaaattgcagctagataggaggaacaaattctggtgttctatagggtgttctataggaagttctgttgatttaacatcctacaactataggaagactatagttagcaataatatattgtatagcttcaaacagctataagggaggacattaaatgttcccaacacaaagaaatgataaatgtttgagatatgtatgtatggtaattaccctgatctggtcactgtacattgtatgtatcacagtgtcactaggtactccatacatatgtgcaattattatgtgtcaattaaaaattaaaaataaaatgttgcaagcatagttcaaagagtatttataaacccttcactcggttttccccagtgttaacatcttacctgactatggtacacttgtgaaaactaggaaattaacattagtacacaactattaactagacagtagattttatttgaattagtttttctattatatatcctttatgtgttccaggattcaacctaggatactacattgcatttaaaatatagttaagtttttttttgtttgtttgtttccttttattgagatgtaatttcgctcttatcactcaggctggagagcaatggtgcaatcttggctcactgcaatctccgcctcctgggttcaagcgattctccagccttagcctccctagtagctgggattacgggcaatgtgccaccacacccagctaagttttatatttttagcagagacagggtttcaccatgttggccaggctggtctcgaaatcctgacctcacgtgatctgcctaccgcggtctcccaaagtgctgggattacagatgtaagccaccatgtctggccaaaatatagttaacttatagacatatattacatatattaacatgtaatggtttatttttattttaaaatgagttaataaagattttaaacatttctcagttttaactttgaacacagtaaataatgatagatatgccgcacatagacaaaagcccttttgaaatctcaatgatttttaagtgcataaaagcgttctgagaataaaaaacttgagaagtgctgacctagaatattctgtatgaggagaatgtttacatgtgtaactgccggactgtaaggagaggcataaggtgagggtttacgtaatgtctctggggagtttaatcccaccccacgtgatctgtaaatgcacgagtgtgagaaactaaatttagtgagaaagaactcagggactggagacagctctagataaagcacttcatttagccagcccacaaatgttttccaagtgcctattgtgtgcctgtcagtggggatacagctatccataagatagaagagatctctaccccacaaagcttacattttggggggcggaagttagacaaaaacacataaacagagactttccatgactgtctgcagtgatccgccctgtgaagcagagaaaggagagtagaatgatgttggcaggggagtcctgggccgtgcagatgggggctcgctgtagggacattcctcatctgtgcttgctccacagtcgatgaggggaaggctagtgtggaaggagggcagtgagtggcgggggaggctagcagggtgcagattgggtggggctcacaggccagcggagggccttggagtttattttcattgcctaggtagcatttccaggcttgaagcaagggagggccgggttctgattgaccgcatgaagaatggattgtgagatgtctggatgaaggcaggaagggcaggtgtcctccaggtgagagacagtggcagcttaggacttgggtgtgctgcctgaggacggtaacatactgtcagattcagcatggactgcagaggtcgaagcgacatgtcctgctcatagatcagatgggtgggaagaaaagggagtggatgaggagcgatcccaggtttccattctgagcagcggggtgaatggttgtgccaggtactaggtggggaagcctccggggcagcacacttgctgatggcatttggttgaactctttgggctcaagtgaggtttgagcccctttagatatccaggcacataaactgctatgtaattgagcagatagtggtcacatatctactctgtgccaaccactgatctagacacggaaggagatcctcatgaatgagacacacacacgcacataataaaagatcatgttgatccctctctcccgtcttggtgctgtggacatggagagaacagagtgagtgatgccatctgggtaagttgtcttctctccccacccttttcttggggatatgttgtgggtgacggaggaacaagagaacatctgagaatccaggcaggtgtgtgttcttcaggggacaggtggcatccctgggaaatcattttgcaagtttttgggacccaagagatttaaatagaacatcttttatctctttctcttgggaggcttctagcattttaagttactctttcttcctggatctgtgggagagaggtgggtggggaaatgtcattacttataaatatgttacgagtaaataatgaaaggactcagaaaggcagaagggaagcctgtttttctgtggagtgcctggctgtgtttgtttggttagaagatgatgaaaacagggcaattgtgtgttgagagtggcctgaggccagtgcagagccagggaagaggctaacaggctttgtcaattcctcccacgccccttggcccccagctttgttcctagatttgcaggctaggttcctggctgtctctaggcagctgtgcaggcctgacccgggaacttctgatgccagcatgggatgggatggcatgggatgggacggcacctccagcctgacagcagcttgtcctcccgcatggctcgccatctgtcaggacacagagcggtgacctgcaggggaccttggagagctccttgctgctgagtctggagtcatttccaaagcaggtcatttgggggtggctggaatgatgtaggtgccgactttgtttttgtggaaccaggaaccacaatggacggatttttgaattaaagaaggaaatgaataaagaattatacaaccacccccaattcctgagtaacagtactggtattaccaagagtaatagtactggtagtaataaatataatagtagcgaccatttatttaattcctactatgcaccaagaaccattgggtactttttatatttttttctccttgtaacagtgtgatgatgtggttattattatccctgttttacagatgagtcaactgaggcttggagattaaatgatttccccaaagttatatgactagtgaatggtgaagtcagcattcacagcttgctgcctgtgtccccagagcctgtgctttttcctcctcaatcatgtacagctgcctgactcatgcccaggccacctcccacttttctccaagaggttcagattcttccaaacaacagaagaaaatcactatgttttttcagtgatggtgttggtagaatccttaattcaaacattttattgtgttcctgagaatcatcacactaaaaatcagatgtgatggacaacgggtggagtcctacagtggaaagtctgacttccacatcgagggcagatgtgtcacccataggcttgtgttctttcttatgggctggtgttgctttgggacaatcatttctcttcaacagttattactttccaccattggaagccctctccttttgtttctctaggctgttgggtttcgttttcctttgtttgggttattaacatctttttcccaggacagtggatgacacaaggagcaggtagacagaaggggagacaaaatctagtgttccagcagataaaccgctcctcatttacaacattgcccactgccagaaggcagcctggtccctgtgggtctgagaaacagcctggaacttaaaattagaggacacatcatgtgtgctttcaaaatgatttcacgtaatctgtgggtaggttagcactctctggaggcaaagaaaggctgacctcagggttttctgttggagccctgcagacatcggtttgattaagcagggctggcttgcactggtggacggacttcagctgccacagagaggggatgccagggaagactcctgggacagaagtcacctctgcaggtgccttcatttccctcacagcccaattatagggaacgtgaaatttaggggggaaggagttccttgggaaagcagtctgtgatctgcaagctctgctggctgcctcaagcctaagggccatgataatgaggtctcagagcatacctgacatgctgcagaggaagaagcggaaatttcccaggaacgcccattgccttcccacgtcctccccttccctgttcttcctcagcgcacctggctgaaactagggaggcttaagttgctttgggaaacagccaagctctctgcttctccactcttgagttgcaaggaggcaagaacaatgccagcaacttcctgacatcatgtagacattgtggtttgaggagcgctttcctgggtaacacgttgtttaattctcattaacatcttagtgtaatcaacggcaaatatgactctacgcattttttagagggagaggctgaaacttacagaggctattttctccaaggtgactggatttcccccagttttttttttttgtttgtttgtttttttagatggaatctttctctattgcccaggctggagtgcagtggcacaatcttgactcactgcaacctgtgcctccctggttcaagcgattctcctgcctagcctcctgagtagctgggattacaggcacatgccaccatactgctagtttttctatttatagtagagatgggatttcaccatgttggctaggctggtctcgaactcctgacctcaaatgatctgcccgccttggcctcccaaagtgctaggattacaggcatgagccactgtgcctggcattccccactccttttttataagggattgggaagggtgtgtgtgtttaaaagccatacagaacagcctgaattatgcttttagtgttccctataaaatgatgacctacctgaactcctcctgccgttaaacattggaacggacggtagcagctctctctgagaggtgagcctcatacacgtttgcagcagctgtgcgggtctgccctgccaagtccccactctttggcaatgcccagccctgctcctgcagttcctgagtcagtctcaacctggaaagatgcaggatgctcctggaaacggggacgccaagggggagtgaggtggaacgacgctgccgtggctcgttagcagttttcaccatttatcaaaggaaatgaaaaacaaacagcgcaatgattttaattactctgcatcgaggaggtgatcaaacacccagtgactttaattatggaatccagagccaggcagctccgcggcagcttcagccttgcccaggacaccctctccctctgcggaccagagctctgctgtcccagccctgagctctgcgcctttgctctccctgtgtgtcccagaagaatttatggaaatgggagaatctggcttccttgtgggctggggattgggttgagtgggatgataggggccatggtggaatggatcatggatcagggagagagagagatgtaaaaggttatatataagaaaagaaacaccgccaagtatatttatttatttattttggtagggaggggggtggtgcgtttggaagaaggtgtacaaatagttgctatctcccggtctcagctggggctggctggtttgcagactgtttagtgaaagtttgacagatccagctgctgtctctcctaataccttgggaaggctgtggtagagatgctctctctggagtttgaaagaggctgaagtccaaaccttcgaattccaggattcacagattaggagaagtcctgcttcctctctgctggagggccatctgtcagttggctggttctcctcttgacatcttgttgtcttttggggccgctcctaattgatgcttggctctatcattgttaagtacatttttcaccctccctgccccctccacccttagtctctctctctttttttttttttttttttttaactactaagtgtattgaactagtgaggttgaaacatttcatagcaggcttctaaaaatttttttttttttgcaattccttgggacagcaaacacaggttttcactgtgtcttcccagtggtctcttggggttctcactgtgtcaggactatcttgcctgaacataagcccctgtcttgcctgtagttagattacaggacactgttattttttttttcagaaggctgctataatctgcctattgatagaccattttaccaacttcagcaaaagccgcattatttttcagaagcagaaaaattgtcaactggcacacggtgtctgggagagaccagaatctgagggcagcgtgtttttaattgcctggagatacccattaataacttctaactttttgtcctcttctgtgggcaatcaacagactgtcaaatcttgaaataagagtgttttctctagagaagcaaggcttttgaaaataataatgaagatgcctaaattttttttctttttggagctgtttggccatattgatctgggaacagacccagggcatccacacacttcattcaggaggagatccaagttgcatgaaagtggaggaactgagctcactgaaaggtgaagttgtaagagctgtagatgcgatatttattggtgattgatattctacccagagactcgctcggcacctgcagtcatgttaacgggaactgaatctttggtggaccagggaattcagtatcttgcttttgtctttctggtgcatgagtatgtgcagtttatggtcgtgaggtcacccagtggaccatccttgctggaagaatcttattatttgagctcacaccaatgcaatcaataggtgcctgagttcttaccctgattctgtcacagtccatgtgacattatgcaagtcacttaatttcttgaggcctcagtttcttcatctgccagatgtaagaaagacacttttactaccccaggtgagtttaaaatatgatgaatgtgggatcactttggaatgctggaaagtttattgctaatgcaaggtgtattagccagggatctccagaaaaacagaacacacacacacacacacacacacacacacacacacacacagaatgagagagagcatgcagagagagaggagagagagaggagagagaaagagtatatatacatatatgagatttatttcaggaatcagctcacatgataatggaggccaagggaaggcctgcattctgacatttgcaagctggagaaccaggaaagctagtcatgtaattcagcttgaatctgaaggactgacaatctggagcacccatatcccaggggccagagaagatggatgtctcagctcaaggagagaaagagcaaactcacccttctctgcctttttgtcccattctagccctcaacaattgggtgatgcccatcctcattggtggaggtgatctctgctcagtctacgcaattcaaacactaatctcttctgggaacgccatcattgacatacccagaaatactgttttaccagctctctgggcatcccttagcccagtcaagttgacacataaaattacctatcacatgtggtaaattattattttatttacctcctttctttagaaaaaaacaatattctcttctcctgtcactcttcagcggttaggtcggctggtggaatcattgggcactttccagagtgctccaggctgggctaaagaagaagcccagggtctatcagttggacttttgctgaattgttccatttccagttatgtgagtctccgttttctaggtgcactgtgtacatagcctataaaattgaggggaaagatagaagggactgatcttaaaaatgtgtgcactttcttgctggatttattttccagtcatgccccaattgcccaatcagccaaaactcaaggctggcatcaaacccactcaactgattttcatttctctgatagcttctgccatctcatgccaccaggatgtagtgatgacttgcatgcacacattctgcagagagtggacaaggagcagtctcaggtgtgattcttgagtctccttgagatcctagagctagcagctgttgagtcaatattgcacttctgtggagtaaccactgtgagtattgaaggctggaaaagtgctaagaacctggagataaaagcccaaaatattagggcttgctgctgctgctttagaaagaccagagaagagattttagtccagtgggaagaggaagtgtccactctcctgggaagcattctgtcccctgtaaaagcaggatcttatgggtctcttcctcagctccattccagttctgacccatcttgcaacatacaaacgccacctaggagtgagctggacacagggccccatgagctcctgctgggtctctgatccagccagctcttggtcagttgtacatctggggcctttgtcatggggctgtggggtcgagcagtgactggagaggttgcccaaatgaaatgtgttagaatgaaggacttgattcatatttataaacaaggtcctagcaatgagagactttgatacagttttgctccatttagaagagatgggtagaaggaaaccaaaattgcttcttggccttgcctctctgtcaggggcttgcatttcagagctacagatgctttggagaagtcatttaaaaaatgtgttttaggccggggacagtggcttatgcctgtaatcccagcactttgggaggctgaggtgggtagatcacctgaggtctggagttcgagaccagcctagccaacatggcgaaaccccatctctactaaaaatacaaaaaattagccaggcatggtggtgggcacctgtaatcccagctactccggaggctgaggcaggagaattgcttgaacctcgggggcggagattgcagtaagcagagatcgcgccattgcactccagccttggcaacaagagtgaaactccatcttaaaaactaaatgtattttataatatcctgtaggactctggttgactaaagaccagacaaggaccagccatgtcacagctccatcattattaccttcttcttgcagaaattcaaagtggaattaagtgatgagaagtgcctagttgttcatggactttctatgtcactggcaggtgaggatgacttgtaaatcactgctttctcttgacccccaaatcaagtggaagagtgcaggcaggcactgtgcaaggctgggtggactgcagcctgcaatcggctttgacttttctgactgtgaaatccggaattctgtcagagccacaaattatttctcctttcagcaattgaaaagaaagaaagataactggaagataactggagtgctttaataaggattacaagacccttgaaggaaatgctaagccaacaatttgatttaaaagctctggaaagacccccggatttggagtccggaaacgtgggcttgaatcgctgccctgtttctgcaagttcactgtggtctgaatagtggatgaggccatgggagggtatagctcagaacagaggtgcacttggtgggcagagggacagttgatgcacttgcttagtcccttgggggaccaccattgctgcccccaggagccacacttgcttctttttcttagcatcacctacaggttcaggtgcctcacctataggagggccttgtggggcttgggggagggaagacctaatactttctacccagacctgtttctgatcacagaggcatcattttctaatcagaaagtggagctcctcccttggctctagacactggaatgtctacacctgtgggcacgtgctgccaggctcttcctggagactgttctgccccaggagagtgcagaagcgcatcctgcaggtgatctctttaggaccaccctctggactcttcttaacaatgttcagggtaagacccaaaatagaaacagggagttctactgggaagcaatagattacactagtgcattttacttttattactccattcccagtgcattttatcttgttattttatcagtttattattatcgggctaaagtgcttagaatggtgctgggtgctgagtacagagaagagagatactttttgcctctaagggctcacagtctagaggaagagcaggcagccaagcacagcattgcaggggtgtacgacacctgtcgggcgtgcacacctatgggggtgcacagggagcctgggagcctggggagggggcactgacccagcttgggtaagaggagtagggggatgtctcagagaggcaatgcttagcacatgacagatgcagaggagagaacacagtctagcatttaacaagacgtggaagggacagggagcaggcacatttgttggtggcaggggggcggcctctggagtggctgggattggttggtcgtgcagctgagctggaggccttgcctggtcccagatgcatttacatccagtaggagttagcagttactcaggtttcaaactggctcttatcagaaactgaggggtaggctgaggtcctggggagagtgcaaccgccactggggccagctcctcatttggagagttcaccgcaaaacactttagactctactacgtttcaccctggagtcatgctgcagatcgaatgacgttgccaaggaccgttgttcctataggactaagtagcctgtgatgttgctcttctttttgcccctgacgccagcatccaacagggttctattgtacacagtttccattatgtggggctccacagaaaattagccgaagaactcccccgggtgccaggtggcttgtaatatctcattaggaatggctgtgtgggaagaaacaatatttttagcagtgggtaggaagtgttattgaaatatgacttctttgacattatggaacttagaatcatcggttcaagtcagatggtactatagtaactgtaactacattggggactgagatcaaaagaatgggaaccagaattcggcactagcttatttctctcttttgcatatgattaagcagtattgaacctatctcagaatacagcatcaccagaaacaatgccttgcctagtactgcataaatgctactcagacaatacgtttctggactcctggaggagttctgaatctttgggaatggatctgctctctgactaacggaggtagcaggttgccaatgtctaatgaggtgaggtccacagtagggctgtgtgagctctgcttcatggggaggtgagtgagaagaaatgccacagtcagggtttgccagggaagagactttgcagagtttagtgctcagggtgcctaccgggtggctcttgggagggatatctgtggagggaggagcagaagcaggattggaaagagggagaaactgggctttggtgcaggtatagtagcctcagccaactgcatggggagtcgtggagctgaaaaggcccatcagggttggtccatgttgtgttgcactgactgggctttttcacctttgcagctgtcagttagtagccatgggtgccccggaggagtgtgattttgggggcatggctctctgaagcaagccgttcctgaagggacaggctgctgaaggctgagtgccaactgtattctcagcaaatagaggcaagcatttcttccttgaaagggcacctcagccatgcatctcccttgtccaccacaagatttccaagtacttattttaatgtgagtccaggccactccatcagtaggcatctcacagcccactgacttgggaggatcaccacttagttttgtttggtgggaaataggaattactgcttataacaggaattgccttttaaaattcatacaaatgtatggggtacatgcacagttttgttacatgcatagaatgcatagtggtaacatcagagcttttaggttagccatcattcattaactaatttctcatcatccaccccctcactcttccaagacttcattgtctttcactccacactctatgtccatgtgttatacattttttagcacctacttatgagtgagaacacgcctggcttttgactttctgtgcctggcatgtttcacttaagatatcgacctccaatccattcatgttgctgcaaaaggtgtgatttcattctttttatgactgcatagtattctatggtaaaccacattttctttaccaattcattcattgatggacatttaggtcgattcactgtcatgactagtgctgtaataaacatacaagtgcaggtatctttttggtatattgatttcttttcctttgggtagatacctggtggtgggattgtagctagcactcagtttgaggtggaatctgtacttaaatgtactttccaatttgaccttaacatcttcacgtctcacaaacctctgggctttgccattctagacaaaatgcttacttgtaagtttctggagggtggcagaagaggcaaggcacacctgagcacagctgcctgtcgctggcccttgctttcgtctcgccagcctctggggatctgacctggaaggtggtctttttaggcatctctgcaccattgcttctgctggtcagagtcacagagggcttgtttctccaaagcttaaaaaggtgtttttggtttctgcctgcccaaggtgattcttcaaaggaaggtagtaaatattctggaagaggcagtgagctgcagggaaagaacattatttcaggagttagagatctccattttgccttttatgtacagggtacatttggataagtttcatcactttccagggtgtcttttccatattatttgggaatgtgaaagggtgagattagatggtccttatggccctttctggtgctgtgatgttttcattcttatctccatcattaatgtgacctcattctctctaagccactcagttccaattgccttcatgtcccgcccctttattttggcctcttcaccttccaaatccttccttcactgtccacctaactgttcatgtcttttgtttccttccagctcttccctgatgctggtcttctttcccccacctggcaagcgtgagagggtgttaggaggggcagggctggtggcattgactgagagtcagtctggccatggtaggtgggcaggatggttgaagacaccaatagttcactgccaggcttaagcagagctgacgaggagagtgaggagtgcattagaagggtatcacccccagcctgggcaatatagtgagaccccatcttaaaaaaatcaaaaagttagctgggcatggtggcacacacttgtagtcccagctactctggaagctgaggcaggaggtttgcttgagcccaggaggttgaggctacagtgagccatgatcatgccactgcactccaggctgggtaagagagcaagaccctgtctcaggaaataaaaaaataaacaaaagaggggcatcaccagctcacagtgatgcttccgtgctttccccagagccaggaacttcccagccagggaatgaatctatatcaatgcagtctcatttcctggaaactggccaactgctgctcacctcagctaaaaggcgtgaagaacggatttgagggaagaatttgacagtgtaactacattaagcggtggagtgatgagatgtgtgcctcctccccagcatcagggctgttgccagatggcccagctgtctgtcatctctggcgaggtgacaagaccctgcgacttcgatgtgtggcacttgatcattacctggcatcccagtggtcagggccatctgctccgtttgcccctcacaagatggcaaagcagattctgcaaggcaccaacaccaatgtgccaggggtgaggagcatgggtctgttccaaaccagagagaaacagagcagacttcttggcaggtgccactggtacctgagaacatcctcctggttggctcatctgtaaagatgctcccagcccgtgtaccaggacacacgccttgtcctgcgatgatactctgctttcccacgagttgcttgattttagcccccagaagccacactctgttcaaatgagaaatcgagcggtactgacctgaatgagcattctcagtgaggtctgcactgtttagtgccatgacccagagagctgagctggagagacaagagattaggtttggtctctggactctcagacccttgaatatctctggctttttccaatgctcccctacaaagcacataagaggtttcactgggtaaaaagtgcactttgtgtattctttttccccagccatgccaagtgactcaggttcaagtagagttagttaaggtcatgctggataaatcctggaatcatagtggcttagtgccttagaggtttagttcccattgacacaaaagtccagtgggcaccaggggttggggaaagggagttctgctccacacagtcatccaggaaccaagactttcagagaccctgccttctttaccatgtggcttccaaagttgagcaggactgcaacgtccagcctgcagaaggagaggaggttagatcaaacagcaggtttttaagggccaggcctggaactgtgtccatcatttttgtgcacatttcatcagccagaactcaattatgtggtgcagtaactgcaaaggaggctgagaaattcagtctgatcttttgtggccaggagaaaggaaaaaaacaatgtctctattgcagagggtgtggaagattcatttctagaaaatcgtctctcatcattattgtgtacatggtatctatccagccattatttgtctatgtatgtatctatatttctgtcaatcaatccatcatctatctagtttctatctacctatgtttctatctatttatctaccgatcatcatcatctcactatcactaacatcagttaccgtcgttaataacagaatgagcacccgtacaacatcttctaaagcaaagctgagatctggcaaccgcttacatctgtccatgtgtttctctctcatcccttctgtctccccaacctaaggcaatcatcatcctgaatcttgtcctcatttctctgccaaacatttttagagttgtatcttttctacatgtatgcccaagatgtctatattttcatttcagttgtttttgactttataaaaaggatcttgtagatgtgatcttctgattcaaattcttcatgtaaatattagattgctatgattcgtctgtattctggtttgttgctgtgactgtacctcagtttattcatccactctcctgtaggtgtgcttttgggctgattacaggctttgctatttgaacaatgctactatcatcatctcttacataccttgtgttgtacgtgagcaagattttttcttgcctgaaattaggagtgcagttgctgggttgttcagcttgatgagatgatgcttaactttcagcttatcctcctgtgaaaatgtatacaaattcctgtatacattttcacaccttcttcaactcttgatgtggccagatattttaagtttcaacaatctccccattgtttgttgatgatcctaatacacatacaataacctttctatggttaatttcccatggtggctgaattcccaaaccaatcattattttcccgatttcttactgcatcccaaagtagggggtgtcacaagatgtcaaaccagctctgaaatctgaaaggaagttctaacggaaagatttcatggacgggggaggctgctgtgtagagatttgtagggagaaactggatagtgagtcccttcctctgcctttgcaacatttaaattcctgtatcttcctgtcttggccactctacatacttttacatggactctacattttcactgagtttaggaaggtcaggagacaaatcagcaccgagcagttagaattccttggagaagcccagtcaagttaatatgcggtagaggagaagggaactagaatgtctgctggctgactgacagcacttgcagcaacctcagagtatggattcaaataaaaataatagttttccctgcagcagcttggtctgtctcgtcggtgccttcctctgcagttgaatacaggtgcagaactctgcttccctgggccctgaatgccattgctgcatttaaatctgccctcaatctgtctggtttcataggggcagtcttgtgaagataaatcatgtaaacaagttacagtaatggaatacttatttagaaactgtatttttgaaggcatgtattcacattgaaaggaagggtcctgtagtcgttcagcttgttaagaaaatccacctgtctggagcaggtacttgcttcactcaggtagccaatacatagcaaagtggggggacccacgtaggcttttctccgttgagtgaggggagggtaggagcctattctttaaaatgtgagtggcttttctgcctgggtgcacagccctttggtgtgatggaatgagcgacaggaaacataaggagcatgttttattccctcatattttctcctcctctccctgcttctctttgcaggctagtgatcttttctgtttctctctgcctctggctttcccccatgatatgggctctgtttttggtctgacttgaagtggcaaactagttgaaaatccaagctctccacctgtcactcactttcatccctctgaaagtgcagaaagagaaagcagatgctttgggcccgctgtgactggagaaggtgctggagtttatccattagtgttctacaaaaacatccacgctttccctgacatctgcgctccatcatgctgcccggacccatcagctgggtgcatttgggcttgctgtgcattaccgcctgacaccttgggctctccccaaagctgccactgcagggtacctttggaaagccagatagaatggctcttgccttgcagagtctctgctagtccccacctgcctctggtactcagatccctggtctccctgttaggtggaggcaaaggtacagtactggagccttagcaaggacctacagggtaaggagatgttccagaaggatgacacgtgggcctgccagagccattgtcttccagctggcatgaatattctatttatgtgttgaagcaggtgggaagtctgtctgtgtttatggagggtggtgtgtgctggatcccagaatgtgaacctttcccgtgagatcagaaccttgttccctgctgcagactgagtgcttagagcagcaccagccgtatagtaaatgctcagtaaaaattcgtttcatgaataaagagagaatccaagtgatgttgtatgtccaggacttaagcagaggccatttggtgaatcacatagaaaatctgtgggatttgcatagaatttacagtgaaaatctgaagccttgggctgggctggtcagcacctgctctgctcatgccccctggagtctacaattcagacttgtccaagcagacaaaggacaagggatcagagaggggagaggtggcaaagaatcagttgcatgtgcctgcccttggaggttggaccagagaaccgccctgcaggctggggctgcctttgctgctctgcttcccagatgtcatcaggccagcctgtgccatgtgagactgacagctctggttccacggcccgcggctggggtgaggtgcatgtgcccagcagtggccgatgcctctgagtcaggaatcaaagaacctggttttataagtgaagaaaatggtgccattaaaaggcaattattcaagtggtgtgagtcagcgatgcagctcctggcaacgccaggcaggagaaggcagtggtgtggggagttttctctccctctgcctctctctctttttaaacaaagctcaggctggaaagcagagcttgcacctgcatctgggtgatgtacggtaagctacctagactgccagattcctttatctgagcaacatcaggaatgggaaagacagcctcaaaccagaagaaagatccttatcctgaggaacagggaattgaaaaggtccttcaagctggctgtgtacttgaccttcaccctgctctcagatgctgcatgggggattctcctgcctgtcgacccaggtggtgtgtgaatgaaagaaaagtgtgtgctggagccggtggtcccgggagtgggggtcagacgtcttcccctgcgctgcaccctagctgcctgctgttccctttctctggcatgattttatggaagaccatgatgatttcatgtcttttttttttttttttttgctggagtgtagtggtatgatctcggttcactgcaacctctgcctgccgggttcaagtgattctcctgcctcagcctccagagtagctgggattacaggcacgcaccaccacacctggctaatttttgtatttttaatagagatggggtttcaccatgttgatcaggctggtctcgaactcctgacctcataatctgcccacctcggcctctcatagtgctgggattacaggtgtgagccaccacggccagccagatgatttcatttctagagtacttttcttgtttctgtttttttttcccctctaaatctgctttgctgccacggcaaccagcactgcattaccaccttcacatggagagaggtgtgatggggacaggacagaccctgcttccagcccatcctctgaggctcctgcactggcaggcatggcagagatgatcacgaaaaccacccgcttgcctcctgaatctttttcccattgttggtagacagcctagagagcaaagagttttttctttccacagaaggacagtggcaggggaaagggagcaaatgtcaggcaacagccaccaaagtaccaaatatgggtttaaggttcagggaataaaaactcaaaattataacaaaagggcaaaccaagtatggaaaccagtcagccctcactcccatacttccctcccttctgagcagagtcttagcccctctcctttgttttaataaatcaaagtagaaacaagttcaattgcttttttgagaggaataattttaaaattggctgagtttaaacaacagcggaaggcctcctgtctgtttcacattcataaccaggtcatagttcatcttaattggtagcatttttagtcggctgtggagtttgtcaaaattgaaggagagaaaagttcagcctctctgccttgggttctgggagctggtgagctggtcagcactgccaagggcagctgggctcggggccaggctgtttggtggtggcatgggtgagcagggggcatcatctggtggaaggtcccagactggctggagaagggccagcaggactcggcagagggcacagcggcttttcgaggtgtcaggccacgttggagggcagcagtaggtcatggatctactgagggtgagtaaggttgcagaggtgcagaattgtggttgtgcaggcagaagcagaactagaatgtccaggcagatgttagcccatcccagctcagttcaggcaaacacagaaaagagagtctgagcactgaggtcagaaacagcttccaaggctctacctggacagtcgaggctcttcaggccccagcatattaattctgcactgaatgtctgtccttggctttccttttatgaatttttatggtggtcgcgagctggaggtggcaggggacaaactgaagggcatgcccagtgctgaggacagaggcccagagtaggggtgaaggccgtgggcacaggggtcagccctggcttggaaaactgagcgccccttaggagctgagtgacctctgggtgagttacttaattgctaaccctgagtcttctcatttagacaatgaagctgacaagtctacacagctctttgagggaattaaatcggatgatttatataaagccctcagcacaaggcctggctcaggggaagtacttcagtgaaatctttattccttctgggtcaggagctctcacaaggggccaggtcctgttgggatcattgttagagtagtcacaatgcccgatactggagagcttgcacagtcacacggagtggcagtttggaaattcagaaatcctaccttaaaggcaagagctgctcttcagttgaagtgtccatgagtcttaaattctatctttaaagggccagtgagggatagtatgggtggaaagtaggttattagatcttctagagaagctttgtagggaaatagcccaaatctgtaacagaaggatgctcacctggtggggaacaccaagccaagagcttctctcctcaagggactgggctggaggagatgccaccctggggccctgatggctgcggccgcctggggactgccacggtgagtgctgtgggttctgtttgctggagtccctggccctctgccatattttgaatgacatgcttctccctttgcatccccctgggaagcaggtcatgggaggtgagcacttgtgggaggacgagagggtaagacaaagttctcatcaaacttctccgtccgtcagggtcagcaccttgtgacaacaaaaatagatttttaaatgtttatgcagtacggggtcttcacaggcctgagtttcagctggcaggaggagtgggcagctgcatttcagtggaaacgagccatctttgtggatggtattgttgatacaaaagagaaagactataatagcaataaaagctatgatttcaatgcaccgactatgttatcttcatgtggttctatttatttctcttcttaaatatttacagcattcctttgaaaataagaataacgataatacaaaattaataatattaatggtaatgatggtaatatcccctttttgcgtgtctctgctatgccacagtctgtgctagatggtttatctacattatttctaatcctcacaataaccctgtgagaattttcctcctattttacaactaaggaaaccagggctcagtgaggctgtgtaagttgctgaacaacctagttggcaagcaaccacacctggatttgaaccaatgtctttccctctgaagagccctgcatgggttttgggctctctgagtcagaagttatttcagcaccatcagaaatggaatggaatgaagaatattaatctttttaacataatgcttttgtttcctccacacagataccccaaaagacacctgcacttacatgttcattgcagcactatttacaatagcaaagtcatgcagctaacttaagtgtccaccaatggttgattggataaagaaaatctggtacatatataccatggaataccacacaaccacaaaaagaatgaaatagtgtcctttgcagcaataagggtagaggtagaggacaccattttaagtgaactaactcagaagcagaaaatcaaatattgcatgctctcacttataagtgggagctaaacaatgggtacacgtagacataaaggtggagagaaggacactgggggctccaaaagcgggaaagagtggaagagggggtgagggttataccattacctagtgggtataatgtttaatatttgaaggatagctgtactgtccccaccattatgcagtatacatatgtaacaaacaagcacctgtaccccctgaacctaaaataaaaatttaaaaagaatatgactcttttccatgaagccccaggtctctctggaattttagcctgcattcattccttcaatctgttcttgagaagcagaaagaagcagaaaggaaggtttcatatctgcctctgaggatcctgaaaaaggccatttcttgcgccttaagaaacatttcgggacctggctcttctcccccagcctctttttcttccatctaggttttgagattctcttccttgcatttttctgccttcccccttatgttaaattattccaaattaaccccacctatgcccctcctattatcttctcatgcttagtggtagtaagatttttctctgtgccagggaaaagaattagcttctgagttggaactcatttctctccactctaatcctatccatcctcaaattttcaaccctagtagaactttcttgaagagattcttgataatcctttctgtcttctcaaatcctatatcactttccatcccccaagttctgttggaattagttgcctgtgccttaggtgttggtgtgtgtatgtctcttcttactcagtagctcagcaagatttggaagacaggggttgtgcctctgttatccctgagcctcactcatgctagatttccccaaaccattatagaatcaataaaagcactcctccttgatgcttcctttattcctgatacctagatgcacctctgagcctcacaccatcactgctatacacatggatctgtaggaactcagacccccggacagcacgtgaaaatgtgaccagactccctgctctagtactgcgtccacatcgggtggaggcctcttacctccattgcagatagtgccaacctctgtgagtactggagagtgatgagaggtcatttagatcctccagtggttgcttggcaatgtgcctgcctttgcaatgtgcctttgcaatgtgctgggcctgggagtacagatggtgctttctttcagatctgtttcagacccaggaaatcaaattcctgtcttcccctactcttgtatccctcctcagaatgtcccaaggcctcatggcacagcacaatacgaatgtttccagggggaggtcactagacactggatctgatgggacagattggactgaccagtaagtgatcagtggctctgtctctactccagttgctggagtagcgcgtgggctcctcaggaccatggacaaggctaaaaaactggaaattttttttttttttcctttttcttaccagctgtcttggtgaagacagtgaaggccagtgaagctaaaatcctcttctaaacaaaccaggggaggggagcaagtgacatcctcccttcttgggaattccagtctctgcatgataaatcggaccctctggttgtctaaagtgacctacatggactgcgctctctttttctggagggaaagccctcatgtacaaaacaggctgacacttgtccactaattgcctcccactggaatgtgacttgttcagatattccactcaggtgtcatcgatttcagaggggtccttattgccttttaaaaaattgcatatggacttgttcaaatcaatattcttatataaaacagtggaaaaagccaagatattttctcttcccttgaattttttttagtatacacattttatattctgcctttaaagctatttctgttgcacagctgctttaccgagactcagactcctacgggcctgcttggtccgacacgtaccttgaatatcctttcacagtgtttgatttttgcagttggttgtataatgaggaaggagtgtgcagtgagtttggagattcctattaaccaggtcatccgtgaatctatttttgtgtgcttcttcattagaaatagcagggaacatgataatatttaaacacaaccacttataggagcttggcttaaaaaatataccttagtaagttttcttttcccattagacatttcaaaatgttgtactccagttcttcatcatcaaaacatcttttcttcatttacattctgggacatgaatggagaccattacaaatgactatgatattgtgggttggcactggaattggcaatcctttgcctcatgtagaccatctccggagtgcccgcattctgttcttggtcttgcttttgaagatggactataatgaaatagactcagggcaagatgatgaggctgggtaggacttggaagtagatagaagagtgttatcttcagacactcaagggaggatatctcatgaaaaaatggagactggtgtggtgccatgttgtacctaatgacagaatcactgaatgaaaactacggtgggacagattttaattcaacctaagaaaaacttaacaactagagcttctgccctctctggaacaggttgccttgtgggggaggaggtgaacctgcaggcacagcaggtgctagactccaggccaattgggccacctgccaggtgtggtcctttttgaaataacaggcccatatcaaccatgagacacagtggtacctggcataactattgcttgctgggggcattgaaaaaccacaggcattattgtctcttaggagcagaaactgtgaatccttttgaattgctgaagacaaatgccctgaatgagccactagagccagggccaaggacagaacgtgagattggagtacttgaggcagacatccttttatttcaggcagatactttatgaatgtggtctggttatttagatcatttcaaaaatcacctaaagtgaaccacagttcactttactttacacagttcactgttgcattgttcaggacttggccaacatcttgccaacatcaggatgttattaaaaatatactactgatccctttcaaatgcagagagttttacggttgatatagcactttctcatatatttctccctgtgatcttcactatcactttcttagaaggcatggtaaatattattatctcaatttttatatgggggaaactgaggtatggagcattgagtgactcatccaatgccatgtggtagcatcagacctaggatggatctagcttgtggaaattggaatcatgcaagcgaggccatatttttggctatgcaaatgactagcaatgtaactttggactgtcttataggtaagatgatggtggtgaaataagataaagtccaaagtgcctaccatattgctgttgtctgagattcttttgcctcttcatacagcatgctgtctgccatggtctttacttcttgcttgacgggtaggaggtgaaacaagtggagtttgtgggctgggtgaaggaatcggatgcactggggtgtgtttccagggtggtaacatgagatccttcagctgccataagatccgtttccgacagatcgctttcagaagcttgagatccttggctgcattttgattccgggtttggaatttgagaatatgtttatttactttgtgggatcatttgtggtgtgcggtggtggaggtggcctttatgaattcaaccaccctaaatggagaagagtcagcttgaatagtgaggtctccccgtgttgcaaagtatggggttacaaggaaagttatagtttagtctgattgtattttttaattttctaagtgcaactatttaactctaaactagattttataccgcttaaaggctctagacaaagctaacttcttccttgactacaaaagtaatatgtgattgttgaagaaaaatttaaaaatgaagaaaattgcaaaagcaattttctgtcatttcccaaagataagtgctattaaaattatgttataatttcctggaatgttttttaatgcatctatacatattttaaaacaaattttgtataatgctatatgtacttaaaaatctcttttgttaatggtaaaccttttcctaatgttccctgaaagaataatttatctgaatttggatttggaagccacatagttttctagtgtgatgatatatcaaagttcatttaacccactttctattgttggatatattaggtgcttacaacatttaattaacatataaatatatataacatgcaaaaatatctcacataaatcctttttaagaatttttagttttgtagagacagaatctctctatgttgcccatgctggtctcaaactcttggcctcaagtgatgctcccacctcggcctcccaaaacactgggactacaggcgtgagccacggtgccctgccctcacataaactcttgacaaggcattagatataagtctggcttgttcaacagaaaaactatagctggatttctattttttagggtaaagcaactctgttgggcatttgtgagaaaactataacctatgcacatattatggttaatcgatatgataacgtcaagagtgtagggagatccacccctctgtcaccattgtcagacctgttactgtgatcctggcttttcatacggttaatatcttgcataaacatcaaagcagtggactcatttttcttttctgttgattctcttgtagcctgatgaagtcctccgatattgatcaggatttattcacagacagttactgcaaggtgtgcagtgcacagctgatctccgaatcgcagcgtgtggcccactacgaggtaaggacagcgtttcccactctgtttgcaaatgtaggagggagcagcccgggtcattgttgtaggactccaggatcctccttctggacttggggcacatttgaagaaccacaggacttgagcctgtacagtctgaggtcaaggccaggacaagtgtatatgtgtggggttgggagtgagggttggggatgtcattgtcagactctggctgcttcccagatcctttttttaaaatttgtatctcagcccctggagactctgcttgggctttctctacttgttaaatctgtcactgtgcatccacaaagttcctttcagggatccagggtgcaatgcattgtgccagctcctgtctccacctatgaccccaaagataagctcagaagacctttgttaaacactgtagggaaagacagcagcaagtaatgaagcagccgtgggccacttcctccctgaaaatttcttccacctgatggccaatacccaacatgtgcttatcacaatcaagatgccttctgcagagttataaccaagtcttaaagtgcaaatactcttcaaagtcataaattagtggcactggctgtttagaatcggggagcaacagaccactttttgatcctctattgggagcagaggatgagaggagagaggttggcctgtgtccgaggatgaggaagaaatgaggtgctgtggattgagtaaagagaactgggagatcccaggatgctgagagctactagggcatgttctgttttcaaaagaacatatactagtaggaacatgaatttctttattttctttctttcttttctttctttctttttttcttttctttctttcttctttctttctttctttcattctttcttttctttctttctttatttttctttgctttctttctttcctttccttcccttccttccttcccttcttcctttctttttttcttcctttctttctttctgagatagcgtctcactcagtcatccaggctggagtgctgcggcatcccaagatgctgagagctactagggcatgttctgctttcaaaagaacatatactagtaggaacatgaatttctttcttttcttttctttcttactttctttctttcttctttctttttgagacagggtctcactcagtcatccaggctggagtgctgtggcacgagcatagctcactgcagcctccacctcctgggctcaagcgatcctcccacctcagcctcctgagcagctgggactacaggcacatgccactgcactcagctaattttttacttttatttttagtagagactgggtcttgctaagaacatgagtttccaagtgtaagaacttgtaagtaattttatattggaaggcttatccagcaattttctttttgtctgacaagtctgacaaatgccagttgtcactatcattcctcaaactcctctgggcctcagattcctctgtgcacaataaaaataactataataacacacacacatacgcacccagaaagacagtcaatgggccctgcatactcctcaggattttgtggtgaccaaatgagatctatcgaaattgtacctgtgaaaatgctttggaagctgtgaagtctatcaaatatgcaaagttatatgcttattcatcattaattcctttgcagcaatgttttgatgaaagcaaatgtttgatgaaaacttttaaaatcagcacctgtgaaaaaattcgtatagtcattgttaaaaggcaaccaagtgttagaaatcaatttgagctttaaagaattatctaaaaaagtccatcgtttgaaattaaggacttccaaatttctgtggctatggcttcataaacacacacgcacacacacacacgtgtgtgtgtgtgtatatgtatatgtgtatatatatgtatatttgtgtgtgatggagtctcactctgtcacccaggctggagtgtggtggcacgatctcagctcactgcaacctcctcctctagggttcaagtgattctcctgcctcagcctccccagtagctgggactacaggcgcgtgacaccacacctggctaatttttttgtatttttagtagagacagggttttaccgtgttagccaggatggtctcgatctcctgacctcattatctgctcaccttggcctcccaaagtgctgaggttataggtgcgagccaccgtgtccggccagatttttttattagtatgttttccccagttaaggaaatgggggaatttgtccctgctctgaaattccatagcctcccattagtactttatgttcttcctttattagactttttgtgttcatttgtaatcatcttactagattcatgaggacagaaacagagttttattcatttgatctttcgtaattgctggaatagtgcctgcccatgacaggtgttcagtgagggttcgtggagggggtgggtgtgtgaaaaaactgcactggtgaccctgccccacactgcctgactagaaaagtaacgtcagaacattgaaaacaatgaaaaattgtttaaaggaagaaaaaaattcagctgctcaatgaagtgtttagttatttgattgcatattttgcacgttttcctgttaacatactgtaccctcgctgttgcacaatctaattgtttagagaatgtgttagtgtttgttggatgtagctagatgacatagagaaaataaagcaattacaacagatctgcaattaacagtgttacacatcatcgagataacattaaatgcattcccattaattgtggatgggaactctgaatgatatttccctcccttcttccaggcagaggtaaggcccttcctacagtgagaaagagctgtgcattcttgccgcaaagctgctgagcatgtgaaaagggcacagtcaggactgaggataccttatatcaatttccggcctccccagctttggttgaggtttctccagcactttctttttctctaagaagatggcttgcatcagatgatctctaaggccatttgaaaactgatattctgtttctatcaatctgcctcttctctccagagacaccttccctgctgcagtgacttatggagtgggtctctaggagatcgaaattccattcaattcattgaaattgctgtcacacttagtctccatgccctattactgatttattgttttagtatgatttcatttttcagttcaacctgatagttttctcagcttccttatggggcaaatcagtgagaatccactgcgtattttctgtatatccagcaatattagagttagttattgcaggggattctgaacctatatgagaaatgatccttgtccctgagaagctcataaacttcatcgagagaaaaagtcaccgatagttcagtgtggcaaaaatacctgtatgattccaagcacatgatctgtagaattctgctgtctgcttttaaggagctactgacggaatttgatacaaagaaagtgttagttcttttgcccacttggcgtcctgttgtacattacatcgtgctgttaacttcgtagatatttgcatattacactttaaaagagggaagcatcatttagagctattatggccaagaaagacttgttggagaatgtcatgatttatccatgcctccacaaatgggttaagtttaggggcgagtggaatgagaaaaatcttggtatctatctttaaggagtattgagagggctaccctggcatcattgtgttaggaaaggatggggtcaggatatcaaggaaagaagagtttggaatctgtgaggctcttaagcatttggcagcataactctataactgaatatttctaaatgatagatagttggtggtggtcagggcatattgttggggaagagaatggcttttggtatgacttttgctgtgagacgagtgtgttaatcttccaaagtaggagagcaaaacaaaacagatgggttaatgcctaatagctgcacaccccatttaaaaggctgaacctttgcacgagaggacagaaaaacctaatatatgtctaaccaaccaaacctttacatgctatgctttaaaaatctatttttgcatatgaagtcctcaggtgaaaaaaaatagggaacatagaggcatttttatttttcttgctaagcgttaagaacacattaacatttcagtaggaaatataattagatgttgtctctattcactggacgaatagtctgagtcaacagaacaagtagacacagacacagaaggaagagaaagctttcaaaggaaagggcctaagcgttacgggggtaaaaaaacagtttcccagggaggccatttgtgtggtttgctgcagtttcaagtggctaaagaataatttcctgcaaagggaaagagttgcttgtatgaatgaaggagtggttttctgcaacgtaggaaaaagaaaaaagtacagggcagaaagatgatatatgtgtgtgtacacacatacacactccccccatacacatacacacacacccatccccaaaccaccaacacacacacacccacacatacatacacatacacacgcacccataaacacatatacacatacacacacataaacacacatacacatacacacatacacacagacacacacatatatgccccccacttcctacacacacccacacacatacacacaaacacacacataaacacatacacatgcacacataaacacacaaacacacataaacatacacacatacacacataaacatacacatacacacacccacacatatatacacacacagacacacccataaacacatatacacatgcatatgcacaaatgcacacataaacatacacagacatacacacgtacccatacacacataaacatatacatagacacacacacatagacacacatacacgtaaacacacacatgcccgagacactcccacacacatacacacacatacacacacatgcactcccacatacagatacacacataaacaccaaaacacactcacacacatacacacacaaatgcacacataaacacatgcatatacacaccaatacacacatacacacatatacacacatacacataaacacacatacacccccagacaccccacacacaaatacacacataagcacacactatacacacactttcacacacatacacacaaacacctctacacacccacacacgtagacacacacaaacacacacataaacacacacatacacatatacacacataaagacccacacccgcacacacatacacacataaatacacatctacagacacacaccaatactcacatatatgcgcacacgtacacacacatacacaaatgcacacataaacacacacatacacacccgcccacacacacacacacacacacacacacatattcgcatatacacacacatggaaagtccataatgttatgcatgggtttttgtaaactatgattttaagtgaaatggtgtataatggaaccaatttttttcctcatcaatgttatactgaaattacattgaatgaaatgatgttacttgaggaccttctagacctggtttcacttaaaggttcagtttccaagaacctatggatgatgttaagtaaggactttctctctccatatatatatatgaacatataaaaacatatatatttgctatatgttctctatgtattaaaatatatatttagaatatacacatatatattaataaaggaattcataaacacacacacagccaaaggaagaaggtactgagtagacctaagagagcgggaagaactcttgctgggcagatcccatcaagccagccatacatgcaccagcccagttgcttgtcccttcctgtgaaccctaataacccttgtgttgctgtgccacatgtctcatgaaatcagtggttaggcatcctcgtccctcccaagaggactgcaagcttcctgagggcaggtgggagccatgtgctgagtgtttttgtgcattcttgccatacctcccgtgctcccccctgtagagctttgctcctggctgtcatttactgacactgacaggggatgcacaggctaggggctgaaggtgggggagactggaggaggggaggggtgggacaattttgatgaaggcctaggtgtctgcaccagaagaagggatgatgtattaatacattgagcattggtctgtacttgagaccccaatgtcaagatatgggttatgggtgatagttttatagttatggcaaaggcatttcttcaagccagtgggaaagttttcaaacatctctgaatcttggtgaatatcagtactggtgaaagagcccttttagcccacctgggaatggcagaatctagtattgttctctcatcatggtagcagcaggcatattggacctacagagacatgccaaaacatgtatattttttctgtttctgctgttctgattgacttccgacagaactttggccttggctagcttctatttaatccaggggaatagctggaagggcattttctagcttctgtaagtcaggttggagatcaggtgtaagtgtcctgtgggtagtgataaaaaggtgaaaattaagattcttaaaatgtgctgattaaagtttcatgactttccagagctgctaatgcctttgttgccttttctcccatagactctcataccttcttcttgttacctttgctttttcttttttctaatagcccgaagtaagcatgcgggctaaatgacttccttctgatgcgtgagagttgtgggttttagatcaggcggtgtgactgtagcctgtcagcaccacccagcactgccccaaccggacttgagtactgtcggggcctgctaggcccacacctaccctgggtaatgcaggtgaagtgttcaaggagatgcaagtgctaactgggtaaagactaggaaaagtctttatggcaggatgcctgggaggatgccttctttgcactacacattgagaatcactgtttcagtatttttgaacgtcttggcatcatgagtgcttaatttctcccagatgatgttagtacagttattggtacatttgtccagggtaatatcttcgtaatatcctaggacttactacacagataatacttctgatatgataaatacaattattccatatggaagatctttttggatgattggtggtgtggtggcttatccctgattgcctgttaatgttcaacttctgtttccttgtccattttattgaagattcttaatcttctgtaagatttctaactacttttatattttccttttgttttattccagcagggccagcatgggcatcttaccttttatcagtcattgttagtcaaaatagttcactggaacacaaagtgaattgctggtaagaggctataacgaagtagacaataggctgaagagcacacccaactcaggcaatatgcacacggctaagagcagttgttagatgatgtgcttcatgctcattgattaagaggacacgggtagggtatgctctgtagcctgagttctcatttgcagacagccgttgatgtcacttagtggattttaggagtcagaccatatcccattggctagcactcagtcacatagcccacctacctgcaggagaagttggaaaatgcaatttaaatgtgtgggtaaaaggaaatggatttaacaaacacatagcatcatctctatcatggtctgcccttctggccaccaactatccatctcattctttccctgacatagaacacacacatcccctcttaacaggagtgacctcaagttcttcccaatcactgtattcagctcacatttcaggatctccaggagtgggcctccctgttgagtgggaatgtggctccccttggtccagtgacctatgagcaaaagagaaatactactgctttcccctacacttttcaatggtgacgataacagtgacatttctcaaccagaaaaaagaagaatgaagacaaagagaaatcgctggtccacagcaaagctagtatcctgcagggcgacactgtgacttttccctttccataaagtggggcaagttcccagaatagaatctgatcttcctctgcaggagggacttttctttttcatttttcccaatgacccctggcactgacccctggagttctttcctgtccattattctcctggccacatcagaaatggatcttgggtcttctctcctcctagggactgccagcattcatagtctacttccttcctgagactgatttaaggcttgcagaatattagaagtgtttctaatttagtgtcataatgtctttagtaatattattcttttaataatgtaaaaaggcttccgatttattttttagaaagttccatgtatcagtaacaaaacaattctctcctagatacaatttcaagactgcttgtttattttaatgcttccttacccatgtgaggaagcattgtctttcttttttccaatttaatggtgggtatcttaagattatcttaaaaaagcaagtggaaaggctatgcccttcatttgatttttgccaaaggcctgagtcacatgctcaactgagaagtttccctgggtctccaacactcaatgtgtttaaaaatgccgtctctcatggttggatgtctagaagcaattggcaaatggtctttccaattctctatgtcccaaatttatggattgtctctttcatatgacttctatctgctaatgggtcagttgcattctgacttctttttcttgaaaaacttgaccaaacactaaaatagacaattagtaatgaatatagtaacaaaataacatatatcaaagtattcttcatcctcttccaattcttctagaactctatccatgtcctagaagtcctagaatagaaccttctggttttcctacaactgtaagctccgtaggcaggtagtgtgccttccagagtattgttggcaagttttgccagtattttgctaccatataacctagatctacaatatcctaaccatccccatttactacccacctgccaagccaatgtcatatttttagggtttttttgtttgtttgtttaaggataaccccaatatctacgttagacaaggcaggctaattctggcaacaaacactttcagcatcttagaaataaaaaaaaaattctttcttccttacattatagtcattatatgttagtggagggggattttgggccacaaaattatttagaactcgggctggcagaggcttctgacgttgccctgagtatcaaaatccaactggtatctggggaactgatggggattgtgggtgactgcacaggacattttaggggacagccctggaagtggcaatatcatatctcccaggttccatggaccagaactcaatcgcatgttttcttcttactgtagagaggctggggcatgtcactttgccggatgcccaggaggaaaatgaaactggtttggtgaacacgtagtattgtctctgtgcactgtgtatctgtgatgctggaggaaatgtggtgattaggacctgcactggggatgctggggtgaaaaagaaagagaaggagaggaaagactgtgattcccaaagggagtggttttggcaaatgaatgaaacaactgttgaaaccgagtgtttgggagctgccgtgaagctgatgcccattttattacagtgccggggaggtaatggaagcaaacaatgtgctgtttgtctaaaaggcaaaagaataacaagctattgacttagacttttctcttcatttcccctgacttagttgatcaaacacaagaggttttccagttggaacttggagcctgtgtgccaagtggcatgtctgacctatagcatttctcttgtgcctaccttttggggccagctgtctcctaggtcctgagctctgtgcctcactgctaaatagcccgaaccatcccaccttctgcgtggagatggaaggacaggattctcctgggggtctcctcagctgtgccctgtggttgagggcactgcctgtggtatcccagagtcttatttagatggatgtttgagagaaattttcctttgctctcctctacaagaaaagccattcctcttttgagtggcagctcagtgtagacccttgactctgttttttgatttgcttttgacaccaaattcatggtcacatccagcaaccaaacagggtgctgtgtacacatttcttgtgcttgacttacctctgattgttattttatttcccctgttttattttattttatttttatttttggatggagtcttgctctgttgcccacactggagtgcatttgcatgatctcagctcactgcaacctccacctcctggattcaagagattctcctgcatcagccactcgagtagctgggattacaggcacgcagcaccacacccggctaatttttgtatttttaatagcgacagggtttcaccatgttggccaggctggttttgaactcctgacctcaagtgatctgcctgccttggcctcccaaagtgctgggattacaggcatgagctgccaagcctggcctctcctgttttattttaaatatgtatcactcatttattttatctgattgtattagatgtagatatattttggtatttgttcttgaagtctttgagcaaaatggttgagtataaatatgtgaatatttgttattttaacattttattcattcatttttttgcagaggcagcaaattcacaattcaaaaactatgaaaagtatagtatgtgaaaagtctcccacctattcctatttcttagctacctaattctcagatgaaaccactttccaattttctttgaaatattctatgcatatagatgcagcttaatttttccttttatatctttttcagaaatggtaacatgctataatcttagtttcatttgtcttaattgtggcatagattttcattttatgattgtatcataacttgtaaagcactattgaattgcctgataacccttggtagccttgataaaactctggtagaaaaagactttctccttgtgaatacttgtgtagtgatgcacatatcagttgcttttcagatctcgacctgtaatgattggttattgactgtgacaatttttctttcagcttttctattcccagtgttcacttgaaaacatatgcattcctgacccccaagtaattccgccaactgggcttgtttattgtttcaaaaagatattaacaggatggggaatccccaaagtaggtgggcttgagtgtggagcaaaaccatgtgtctttgcctaaatctcttctgatacttggaggtgctgagaacagtgtgctcttcttgtttgctgtgatttgagaatttaattagtttcctcagtcttctatactaagatgatttaattttgagtggaacttttctaacttcaaatgctatcactttctcagaggatcctacgaatgcgtaactgcacctgttcaggaggtgcccaggccatcttggcatctctgctcccatgactcctctccaccccgtccccagccccctgctccccgacctctgggatcacctttgctgtcactattccaattgcaggaaaggcttttagagtccttttaaagtttttaagttttattaagaaaataggaaaaagagaacaaaactgttttctatctctgccaaatattcctcttctgagcctctctacaggcctggctatgccattccccaactttgttctgatttgggaaatttccctgccttctggtccgagaaatccttcccattgatgtttttcattaattccatgaagctatcaacttgtcaatacgtcttctggaaatttagcttcttcaggtttggccctaggtaataccttttgtctgactcaccgggtctctggccctaaagccagctcccgtgtataaccttatggcgagccctttggcaagccgtcacttgctttaaagacccaaagccacatcttcctttcccacttcatggaaaggttcatgcttcctttggattcatctactgaattttccttcttctacccctggagtgaattcactcttagtttatcctcagagcaggcagagcaggtcttagctatgaaaacagcttttgctgtactcagggtcagaaagcctatgttgtatgaacagccttagctaaatcactttacccttcctgattttaatttcttcttctgtaacatgaggttggggatcttctttgtttttaccccttttctcatacccatcccctccctatgccctcatgggcaactaattcatgaggtttgatatgacttttatttatatatgttctttaaagtgtgcatggctttgtgggcatggattttttttacataatttttaaattttagaatagttttagatttacaagaaggttataaagtatggaatatttttgtgtacccagacatactttgtttcccctattgttaacatcttacattgctatggtacatttgtcacagctaatgaaccagtattaatacattattactattatatagcatatatatatttttattttttaatttaatttaatttaatttaatttaatttaatttaatttaatttaatttttgagatggagttttgctcttgtcgcccaggctggagtgcagtggcacaatctcggctcactgcaaccttcacctcccaggttccaagtgattctcctgcctcagcctcctgagtagccaggattacaggcacctgccaccacgcccagctaattttttgtatttttaatagagacagggtttcactatgttggccaggctggtctcaaactcctgacctcaggtgatccgcccgcctcggcctcccaaagtgctgggattacaggcatgagccaccgcacctgacctatatcctatattttaaagtgtcaagtccaatctttgttcatatttccttagtttctctgtcgtgtcattttctgtcccagggtcccacccaggattccatgttatattttgcatcatgtctctgtaggctgctctagactataacagtttctcaggttttcctcgttttggatgaccttgacaatattgaagattactggtcaagtatttggtaggatggccctcagccgagatacgtttgatgtttctcttataatgagattggagttatgtgtccttggagagtaagaccacagaggttaaagtgtccttctcattatgtcacatcaagagtacgtgctatcgacatgacttatcaatgttggtgttgaccttgatcacctggctgagggagtgactgtcaggtttctccacttcaaagtcactccagtccttctctttccattgtgtactctttgggaggatatcatcaggcacagtgtatgtaggcatgtatttttattttattttgtttttagagatggagtctcactctgtcacccaggctggaatgcagtggtgcaatctcagttcactgcaacctctgccgcccaaattcaagcaattctcctgcctcagcctcctgagtagctgggattacaggtgcgcaccaccacgcctggctaatttttgtatttttagtagagacgggatttcatcatgttgaccaggctggtctcgaactcctgacctcaggtgatctgcccagctcagcctcccgaagtgctgggattacaggcatgagccactgtgcctggtccggcatgtatttttaacatgttattatatgacattggggtgtgaatctcattcttatcttgctattcatttggcagtatgtttccaaaagccatccatgttcctgcatttacatgtaatctatggcttctaactgctgtctaatactccataatgagcatctattaccttttaactttcccattccttcagggatgggtagttagtttgcctccaatgccttactagcacaagcaatgctgtgacaaacatcttaacagattccctaaggaaacttgggggttttctctgagaccgtgtggagacaaaagtgactccagcttagatgctaatccactacgttggcttccgattaccccagtcttgtgaatgcctcctgattgctattttatctcctgtgtgtagtgctgtcaaccttgatgttatggcacacattacaggctgtgacatttgcctgttccggaggatgcctttaattgtcttgcacagatcatgtatcccctttccctatggaaatatacccagccctgggtctgggggtcacagttgtgaagatccactcgtcttacaaccacccaagaccaggcttctgtctgtaagttcctccagtaaaacacactttacctccaaactgaatttgtctcccctgttcttttttggctccttcagcatttgggggccacttagtacattcaaccctttcatggaacagatgaatatacagccaccgtaaggtatattattactgaattggactcagccttgctctactctccaaccaattgtacatgagggttcccagatctctacatatctgccaatcattggctttattcagctttcacgttttttcctaatctagtcaatatttgatatatattattgttattttaaattgtattttcttaattattataaagcttgaacaacttttaaacatactttttaaatgatttcatttttaaatgatttctattcgtatcgtttgcccatttttttattggtgtacttgtattctttttatttcctcctatattccttgttgaatttatacattgtaactatcttctcccattctgtcatcttcctgttatatctgctcatggtgccctttgttacttttaagcttttccattttatgtgatcaatttagtaaacattttgctctacagtttgtttaagaagccctttccactattagatcaaaaaatattaagtatactataattaatctgacacttccatttttcatattcatatttttaactctgtttggagcttacctttaaatattgcataaggtagaaatccattttgattttcttccatgtggtgagccagttttcctaccaccatttacaattcgttctttccttgtaatttggggtatcactttgctgtgtgttaattcccacatgtgcatgagtctgaatcagatccttttcttctgctttatgaatttaattttcttgatcttggtcagtctttactgtatttagttactgtgctttaatatctgagagggacaaatcacgtatctatcttcttttattgtagagttgacttagctatttgtttagtgtatgcttttgaatccatgtgaatacttgaagaagtccgcaaatccattggaaatcttgattggaatttcttcaagtttaagaattaatttaaagacaatgaatatatacatacacacacatgcatatatattatatacatacatatacacatatatatgtatgtgtgtgcatgtttgtgcatgtgtgtgtatatatatattttgtttgtttgtttgtttgttttaagacggagtttagctcttgtcacacaggctggagtgcagtggtgtgatcttggctcactgcaacctctgcctcctggttcaagtaattcttgtgccttagcctcccaagtagctggaattacaggtgcccgccaccatgctcagctaatttttgtatttttagtagagatggggtttcaccatgttggccaggctggtcttgaactcctgacctcaaatgatctgcccacctcagcctctcaaggtgctaggattacaggtgtggtccactgcacccagcaacaatatttttatagtatcaagtcatcttatcttaaagcaggggtatctatctatctattcaattttaaaccaatttctatattaaaatttcagagaaaggtaacttaataaacatataaaccatgagaacacacataattgttgtgtgatttgattcttaaaactatgttttttctttccattattttgtcaaggtttaatcattagtcttttaactaaattgtaatcatgttgagaacaaaagccatgcctttaatttcttttctttttttataaataatatcaagatgtatttgagattctgaggatacatgtacaggtttgttacatgagtatattgcatgatactgtggtccagggtatggatcccatcacccaggtagtgagcatagaacccaacaggtaggttttcaacccatgaccctctccctccttctccagtagtcagcagtgtctgttgatcccatctttatgtccattgttcccatctttatgtccatgtgtactcagtgtttagctcccacttataagtgaaaacatgaagtatttggttttctgttcctgcattaatttatttaagattatggccttcagcaacattcatgtttctgcaaaggacacaattttttcttttttatggctttccatgctgtgtatgtaccacacttcctttatccaatgcaccattgatgggtacttaggttgattccatgtctttgcttttgtaaatagtgctgcagtgaacatactagtgtatgtgtctttttgacagaataatcgacccagcagtcctagtactgggtatatacccaaaggaaagtaaatcattctaccaaatgcctttaattactttttatcctttctgtgtctcaacatagaaagagttcgggaatagtttttttttttttttaaatagttggcatccaggataagcatcttaccagaggcgagtttttaacattagttggcatccaggatagttggcatcttattggagattttctctgacatcctctttttccttcttcacatttcttttttttttcttcctcttcactgatttgcctgctctttccctctctttcttgttacctcccctgagtgaagatgtctaatgtgaccatgtaacgggagctcacacctacctccatttattgagtgaagctcagcactttttttttttttgcagtgtggtgcagttcctctgggaatgagcaatgtaacttaaaactagctgtgtcaataagtcaaggtgagttttcagctttatactactgcattgtcaaccgttagaaagatgttaacatttattgccaagctgtctcttaaatatcctgtaataaaaagccaaaatatgctgtcttttttttttccaaattcacccttaagctgcattttcattaccacattttctttgcaaagtgctgtaacattctttattgaaacctttattgtttcaggtgttctcatagtagtttcctttgatctaaagaaaaaaaattattttcttaaatgaagggaaaggaaagtattatagtgtatcctttttattttgctagtgacctgtttaacctctgccctgtgggctgttattgcctcgtgtctgcttttcaatctatataattatgatgatccagagacataatttgacctgtaccctatcaaaatccatataataataagctatatgataatgcatttttcctagtttaaaaagtgtttcaatctgattgtgtcactgtgcacagaattaatcaagtcagttttctttgacactatgtgcactgggaaggcaagaccatgtttgaagaaataattataaaaatcaaatgctgaatttgctgaaggcactgaaaaagcacagtatgccttgcctctagtattttaagaacctaaatgtctttggaattccttggcattgctgagataattgatattggtgatgctaattatggactaatcaattttctaatcctgttgaggaggaaacaaagttttgaaattaatgaagtcactgtgcctctatggcatttagaatttttcatgaaatgttttctcagtgaaggaatatgagataatatttactgtattagcacctgaaagaccaaaatgtgtttgctcagaaaagcaatcctgtagctaaaatgtgaatgtggcagagaggtacatagtctgtttcataaaaataaagagccatgccggcttgtaagatccagggttatttctttcatctttgaggacttggaacacttagatcatccatagccacttagatttgactccagaattcaagagggacttttgttttgttttgtttgagacagagtctcgctctgtcacccaggctggagtacagtggcacaatctcagctcactgcaaccttctcctcctggtgttcttagagattctcctgcctcagcctcctgagtatctgggactacaggcttccaccaccatgcccggctaatttttgtatttttagcagagacgaggttttgccatgttgaccaagctggttttgaactcctgacctcaggtgatccacctgccttagcctcccaaagtgctgagataacaggcataagccactgtgcccggctgacttttttttttttttttttgtcctcaccccactacctccccctgcccaagagagttttatcttgctctctgggcatattcactctgggaaactgcaagttccttctgcttgtttttctgacagtggtacacagaaagatacactggttaatgttcttatatttaggtcagccaaatagcataagatcctaaaggtgggtgacttgcagctatttctgagcgttttcttctaagtttggagcctggtgataaacaactgtgatgtgtgcctgcatttattatcccaacatatttttgaacatctacactgtgtaaatgtaccataatagcttctattttctcctctatggggattctagattttaaaaaaacacatcaaaaatcttgcactcattttcggtagggaattaagacagaagcagaaatgacatccacacaaatgagaaggatgtatgtagcaatacagatgcataaatatgtgccgtccatcacagagatttaggatgacttggtgagaaagaaaatacaacttgacttattctctattcaatgaaatgtgaaaataatataaagaactgcctgtgttttttggtagagtagctctgtatacataatatatttaataattaaaaacgaaatgtggttgtttcgtatacagagcaaagctctgtttatggcagcacatgtctgagaatgaaggctgcccaaagccaaactttaggaagcattgcttttctgtatttggacatttttcatatgtgtgatcatgaggagctgcacatccatgtcattaagaaataaagtcattgctaatggccttaattaaaaagaaagaaaaagagaaagaaacaaaggaaaactatgatgtgatgctaggtgtttgcttccatagaggtttagacgtttgaaactccaagtgccccagtgagtattcacactgtggatcgaactgcccacatgcaaaaagttgcaaatgctgtttctcaaactgggtataactttgacattctacaaattcttttagacctttaccgttttggtttttaaataattcttaatgcacgtattttaccaggtataaagatgaaatgttcccctttttcgtgataacaattaagatatattttttctagaataagatgagattattgttattttttctcagacaaggttcatcagatctttgagaattttgttcttgtgaaaacttttttttttaattatactttaagttttagggtacatgtgcgcaatgtgcaggttagttacatgtgtatacatgtgccatgctggtgcactgcacccactaactcgtcatctcgcattaggtatatctcccaatgccatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccgatttcatccatgtccctacaaaggacatgaactcatcattttttatggctgcatagtattccatggtgtatatgtgccaaattttcttaatccagtctatctttgttggacatttgggttggttccaagtctttgctattgtgaataatgcctcaataaacatacgtgtgcatgtgtctttatagcagcatgatttacagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagtcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttgttttgctgtgcagaagctctagaattttttttttttgcttacacttgagaaatattggtttaaacgatattatagtatatctgagcctactactcagttactcctttttggtcgtaatattttattttattattattatttttttaagacagagtctcactctgtcacccaggctggagtgcaatggcccgatctcggctcactgcaacctccacctcccgggttcaagcaattttcctgcctcagcctcccaagtagctgggattataggtatgcgccaccacacccagctaattttgtatttttagcagagagacctggtttctccatgttgttcaggctggtctcaaactcccgactcaggtgatctgcccactttggcctcccaaagtgctgggattacaggagtaagccaccgctcctggcctggtcttaatattttaaaattgcttttgtgccaataatctccaaagtcagtcaaccaacaattaagattatgaagatgatcattagatagatagattgactgatttatccatttcccagatatgttgtggttctgttttcaaaatggacttccttttttttaggacagttttagttcacagcaacattgactgaaaggtataaagatttctcatgtatcccctgccccacacatgcacagcctcccctattatcaacatcacccaccatagaggtgcattgttaaaagtaatgaacctacattgacttacatcattatcactcagagtccatagtttacctcagggttcacttttggtgttatatattctatgggtttggacaaatgtataatgatttgtgtctaggattatagtatcatacagagtaactgtatttccctaagaatccattgtgttctgtctgttcatcccttgctccccactaattcctggcaaccactgatctttttactgtgtccttagttttgccttttctagaatgtcatatagttggaatcatacattatgcagccttttcagattagcttcttaaatgtagtaaatgcaagctgcatttaagtttccttcatgtcttttcatgggttgatagttcatttctttttagtgatgaataatagtccattgtttggatgtcccacagcttataccttcatctactgaagggcctcttggttgcttccaagttttggcaattatgaataaagttgctataaatattcgtgtgcaggctttttttgtgggcacaagtttttcactcctttggctatataccaacgagtgtgatttctggattatatggaaggagtatggttagttttgtaagaaactgccaaattgtcttccaaagtggctgtaccattttacatctccaccagcaatgatgagagctcctgatgctccacatccaatactattgtcagtgttctggattttggccattgtaatatgtagtggtatctcattgttattttaatttgcagttccctgatgacttctgatatggagcatcttttcatatgcttatttgccacctgtgtaccttctttggtgaggtgtctcttaaggtctttggcccattttttagtggggttgtgttcttgttgagttttaagagttctttgcatattttggataacagtcctttatcttttgggtagggaattaagacagaagcagaaatattttgcaaatattttatctcaatctttggctgccttttcattttctcaacaatgtttttcacacaatagaaatttttaattttattaaagcccagcttgtcaattttttcttttatagatcatgcctacagtgttgcaactaaaaaattatcactggtcccaaggtcatctagatattttcctgtattatcttctagaaatttcatagttgtatattttaaatttaggtctgtggctcattttgtgttcctttttgtggagaatgtaaggtctatgtctagattcatttttgttgtgtatgtggatgtccagttgttctagcaccatttgttgaacatactcttttcttcattgtgttgcctttgctcatttgtcaaagatcaattgactctatttatgtgggtctatttctgggcttttgattttgttccattggtcaatttgtctattctttcaccaataccaaactgtctttattactgtagatttgtagcaaatcttgaagtcacgtagtgtcagtcctctgactgttcttctttttcaatattaagttggctattttggttttttgcctctctgtctaaactgtagaatcaatttctaaattgattcaaagttatccacaaaataactttttcagattttgattgggattgaattgaatctatagaataaattgggaagaactgatgccttgacaatcttgagtctttctatccatgaacatggaatatctctctatttatttagttcatctttgattttcttcatcaaaattgtacagtttttcttatatagatcttatacatattttattatatttataaataagtttttgtgtgctaacattcatagtattgcattttgatttcaaatttcacttgctgttggttatagaaaaataatagacttttatatactagccttgtattctgtgactttgctataatcacctatgaattctaggggccattttgttgattctttgagatcttttataaaaacaatcatgtcatttgtgaagaaggatagttttatttctttcttcccaaaaggtataccttttatttccttttctttccttattgcattagctaggactttcagtacgatgctgaaaagcagtggtgagaggagacattcttgtctttttctgatcttagcaagaaagatttgaattcctcactgttatgtatgatgttagctgaaggtttcttgtagatgttctttataatattgagaaaatgtttctctattcctattttactgaaagttcataacatgaatgggtgttggattttgtcaaatgttttttctgcatcttttaatagatcatgcgatttttttttctctttagcccgttgatgcaacggattacattaattgatttttaaatgttgaaccagtctagcatacttcaaatctcacttggttgtggtgtatcctttattttgtacattgttggatttaatttgctaatattttgttggaaaattttgcatctatgttcataggagatattggtctgtagttttctttttcttataatactgttttctgattttggtactagagtaatgctggcctcatagaaggagttaaaaagcagcttatggaattattgaaattgttattattatttttttaagacagagtttcgctcttgttgcccaggctggagttcaatggtgcgatctcagcccactgccacctctgcctcctggattcaagtgattctccttcctcagcctcctgagtagctgggattacaggtgtgcaccacctcacccagttaattttttgtattttttagtagagacagggtttcagcatgttggccacgcttgactcgaactcctgacctcagatgatctgcctgcctcagcctcccagagtgctgggattacaggcgtgagccaccgcaccccaccgaatatatatatgtatatatatatatatatatatttttttttttaaagaaagtatcatctgaaagacaccatagagaattggtataatttttcctaaaatatttggtagaagtcattagtgaacccatttacgtctggtgctttctgttttggaaggccattattaattcaatttctctaatatatataggcctattaacattatctatttcttcttgtgtgacttttgtcagatcgtgtcttttaagaaattggtcccatttcatctaggttattaaatttttggacatagaatttttcatggcatttttaaattattgccttaatgttcatgagacctgtagtaatgttccctttttaatttctgatattagtaatttgtgtcatctcttttttgttcttagctttgcttgaggcttattgattttattcatgttttcgaagaatgagcatttggttgtgataattttctctataattttctgtttctaattttatttattttcatctgcttgctttgaatttaatttttttcttctctttctagttttctgagttaaaaccttatgtgattgattttaattttttcctcttttctgatgtatgcattcaatgccatgaattttgctttaaacactgctttactgcatctcacaaattttaagttgtgtttttattctcatttggttcaaaatatcttaaagtgtttcttgagttttttttgacccatgtgttattcagaagtgtattgtttaatctccaagtattttgggatttttaaactatctttctgttattgatttccaggttaattccactgtggtttgagaactgatagtgatttctattatttctattatgatttttattattttaaatttgttaaggggtgttttaaagccagaatgtggcttattttgatgcatgtcctaaataagtttgagaatgtgtattctgctgttgttggatgagatagtctatagatatccattatattccattgattaatggtgttgtgtttatgttctttcttattagtttctgctttttggctttgtccattttggatagagatgtggtgaagtgcccaagcatagtaagagcttcgtttatttctccttgaagttctatcagtttttacctcatgtgttttgacgccttgttattaggtctatacactttaaggattgttatgtcttcttggagaattagccctttatcattacataatacctctttttatccttgataacttttcttgggcgtgtggtccatcgttgactcaaatgctgccatgcagcaaatgactgtagttagattaatatctaatatatttgttactgttctctatctgttgcccttgctttttgtttctgtttttattttgcactggtttctattgagcattttatatgattccattttctctcctttattaacacattagttattcttattttttactctttttattgcctggactacagttcataatattcacttacaactaatccaagtctactttcaaatagcactataccccttcatggttggtgtatctcataatatcaaaatggtcctaatccctttctcctttaccttgttttattgctttcattcatttcacttatacatacttatacaattgaatacattgttgctattattattttgaacaaattgttatctgttagatcaattagaaaaaaaattcttttattttaccctcaaccatgctcttcctgactttatgcagatctgagtttctgaccttttttattttcctttacattttaaaaattgttttaaatttttaaaatatctgcctttattttgtgcattcaaatggaaaacccttcagagagccctcagagccctcaggataaaactccaatgtaaagaggcacaaatctttaaatttggaataaagaaaaaaccttagtctttctttttctgtctttgcttttgtctgtctctgtctacacatatcagaacggaaagggaaagagtgagagagacggacagacaggaacagaaacagttttaaactatctaaacatcattgatatctaaatatagttttggatatctatctgtctctctttctctctatctgtctccctctctctctatctgtctccatccatccatctatctatccatccatccatccatccacccatctatccttctctctgtctctctctctctctattcatccatccatccagccagccagccagccatctatccttctctctgtctctctctctctctattaatccatccatccatccatccatccagccagccagccagccaaccagccagccagccagccatctatccttctatctatttatcaagatggaaatggacacacagacagacacagcaagagagaagctaggcaggatgctaaaggtaaggccagctgggaatatgtcccaattgaggggactggcctgaaaaaagccccttccaatggctagaaacacagttcaaaaacttggagtagagaagagaggtggaggaaagtctgtatgctgctaaaactgccttcaggtttaaccatcgttttatttactgatagaaccctgtgtcgatctaggtcgaagccttaggaagtaatgttgagaaatagtagcaatagcaataaaggcagagggaaattaatctcagccgagtgctgctctgggaaagcaggtaagaattatccactttgtcaatgaagttttcttctgtcagagccaacagaagttgaaagtgatcaggactaccaggagcatcagcagggacctctgtggctctaaagtggggtggatttatgcagcatatggaaagtcaaggcagctcttcacagtggaatcagtcagggagtaagaggtatttattggtttctagtgttcttttctgcttttcagcaacgtcttttctcataaaacctacaagcggggcttgaaaaataagatgtcctgcctgctgtgggttgtcatacattaaagagcctggcattgggaccttggaacagagcgatgccagtcagcaagaacacattctactgtggagcttgataaatgtttgccaggggaggaggaagagaacatcagaaagttctttccgagatgtgtgcagatcattaacttgcagatcaggaccctgagcatatctgctctggtttgtgtgtggatttccagttctttgaagactttcctagatcacaaggagatgcaggaaaaagccagtgaggagcctgaccgcttagcctgaagtagaggttccccctgcacccagttctttggcgacatactgtgccctcttgcttcccctgctaggaagctgggctgtgcctggtggagcagtgaagaccctggagaagagtgaagggcatggacacctgatactgcctccctaggaccttgccttacctgccagcccctcagtgccctggcttaattgcctggctcactccttagagggttctgacttggaattcaaggtcttgccccatatccaaaggctgcctgtcctagtgcatgttctaatgttcaacacagctacctcaaaatgggggatgctgcaggtgaggagactgtgacctgtcgacagatcccctgcctgataagcttactggtggcaacatttccatttactgaggaccgagtgctgtaccaatctttctgtgcatcctgtcatttctttcttccgatgacctgtcaagtggtagatatctcaattttgcatgctgttccttagaggaaattgtagctcatggaagtcctgtaatgtgcacagctacaatatctgggccctgttattttgcaaattctccaaataccaccgtccttagtcttgtcactcactccccctccccttcactgtctgaggttaaaggacaggtgacaatgcagttgagttcaattgtgatctctttaattcagtaaggatgtattgggctcttagaatgtgccaagcactgagcctggggcccagcacgcaggatgggcagtaatgtcggcactgtctgggtaatggcatggagctccttgaggccagagattaatgtgtgaggcacaagtgtcatatcactcaagtggccctaagtgcaccggcagaggcacactgctcagacaggtgctggtgctttttttggtgttagtggctagtggagtaggatgtggtgtggtggacaggcccggattcacagaggcactgggaggtgggatctgcagagtgaatgagggttcagtggttagacaaggggaaaaggacactccaggtggatggcacaaaagctcagagctctgagtgcatggaaatggtgtgcagtgtagctttgctggagcacagagtgaggggagtgagtctggaaagctaaccaggggcgattccctgcctgtggcccctggaggtgaagatcaggcgaactggctaaggaggggccagttagccagttatggggctggaaggccttgtgctgcatggatcctgccctgggaaggagatgagatctccgagcacagcaggtggctttctgttctgggacttcttgcagtttccctgacactcagaagaaagagagaaaacaaggtgacctctgactgaaaggggaaagaattccagactagatctgatgaagaagcaaaagggaatactgtgaaaaatgtttcagacttgcaattccaggcaccttcacctctccagtctctgcagcagctgtgcggggcggagccggggagggaaagagatatcattctaagtagtgcatttaagggagaactgtaggtctgcagttttgaaagtttttctttctttctttcttttctttaaataccacagagacagtgataaagagctgggtgagattcaagggttctggttagcagacagccacttggcgagttgctgacttcagcacttgctctgttccttcctcaagtgcttttctcctcctctgctaaatacacaaaaagaagcaccctgacatgaaatatcaatgtttttttgttttcatttttcagtactgatctgagtaaatcatgccagggtcatttattgggaaggaaaatgtggcatggcaggcgatatgccttgaggtgagtgtcatgtttaagcagagcagacaacggtggggccggtttcctctccctggggagcctcttggagcctgctgttaggtgcatgggcgctgtggatgcacactgggtatctgttgatatacaggctttcaaggccggttaaatatggagcggaaacgtcccctttctttgtagctgcgtcagcccctgagagtcagccagagggggagagctgggttgttctgaggaggggcttcacagaccagagttgctattctctatctcttcacacaccagagttgctattgaagactctgagtgagaagaaagtgggaaagaagaacaaagaagaaagtgtggaaaattaagaagctgtgatggtatattttaagcacttcttttgcttttcaggttcattttgtaacaggaagggaccaaaactggtctaggcagtgtcttggctaaatgctatgatgcttgtggtggtagtgaatggaatataaaacatccctttggatgctcaagaatgtcatcggtttgcaatttgcagaacggaaaatgttgattataaagtatggagaaatttttatatgcaacattaatgcaacggatagtataaaataaatctggggattgaaagtttatatcctgagttcctgagtctcagacctttaaatcaatactccactccactgatgagagcagtttcccaactgatgcatcagtacagccagtcaaaacataaaaggagcccccagggaggaagcaggtgtcatactaaattctcctctcagcctagggacagcctaggctctgaattgaatttctgtaactgtaaattctggacttaactatgttggccagaaattgcactaaaaaacagtctcatggtctggtgatcatggtattcataaggatccagtacagcttttaattcgtgtccttggctgcctgatggacagacctcgtgaggtttgtatttgtgtctttaggagtcaggtgtgccagggcctctttgcatgggtgtttcacgtgagtgtgcaaaccattggccacaactgttcttggaggtttgcccccaaatcagctgcaatgatcggatgcttggctataaacatggactcaaggttagggctttcaaggtaagggctaagtccagagtagatgtgtgattagactagggtctggggagttataccataatgccaggatcatagaatagcattgctgatgagacattggtaagtggagaaataaaggtgcagagaggacttctgaggctttgtcttaggttcctaagctaagacagagtgtttctgcatctgtcaccctccctcttctgagcttccagggccatctagtcctcctctgctgtcaggaaaatgagattccatttgccacttttgcccaatgcccaccctcccccgccacctgtaagcccttgtcttcacatgaacgcaatcattgccacacaaaagcacaaccccttgacgatgacagctggccgtttgtgtccccagctgagacaaagacccagagaggagaaaactgatccacaggggagggacatgcctgacctgggaatacctgtgtccactggggaaaggagagttagaaaggcagcgggactgtgtgtgtctcacagcatcaatgagctaaaacccagaccacgctgccctgcggtttcctgcaccaggccacgtgctctgctgttgggcttcatttcttctgtagttgtctttcccccatccctaagacagggaggcaacaccaagcccaagtaaactcccccggaagaaggctgatagagaagcaggactgtgggctattctgtagagagtgcctggagtcatctggctggagaaagactttgtgaaatgcaatgtagtgtgtttcctttctgggtgccctaggtttcaatgagtagtcagaaccaagacacatagtgctatatggtgtgttgggtaactccatgtctgagtcaggggagattctgatgcctccaaatgcccatggagtctctgtagcttatggtgccaacaagctatttctcatccatgtgcatgaagtcagttcttcctaaaagcatcttaccctgtaagaaagtgaggcttgttatccgagttctgcaccacattatgcatcaacactaatgcatcagtgcatttgattaaatgatatttatgtttgagttcaaaaatttccaaaaaaaacattaaaaaaattgccttttgatgtctcctaaggcagctggcaaagaactaattgcaagggaaattctctttggtgaaagtggacattctgcttaactgaatgagaataccagcgggtggggagaaataaacatgctttgttttccacagaagggagcttgcatatgtccttgaggagtgtacagatctggggcagaaaatacacaaatatgtgcttctactaagagatcccaaggaggggcgagtccgtcacacttttcctgaagaaggtgacaagaggaattcagatggattgtaattacagatgtcacacctcaggggacccctcaaccttgagaaacttcagggcttagacaaacgacatagatacaaatcagtggctctggtcctcacagaccagcaggtttgaaaacattggggacattacttgtcatgagcaattcattttacttggaaatgttcgcaagcgttggacttttcggcatgacttggagatgagattaaacatcacgagagctttagaaacacccccaaatggaaaatttgtaacgcttgaaaggaagcagcaaattcgcaaaaggatttcaaggctgttgttaaatcatgctattaggaaagaaaggtcagcccttgcccgattggaaaatcgatggagcgtggctctggaacttgtcttcctccttgtgtggacagcgaaagatggcattccccctccaggggcacacggcctattctgtgccttctctcaactgtccttcagtcttcttacctggcaatgaaaggcaaagtagggttttgtttgtttgtttgttttttgtttctgtatttttaaattcacagacttatttttgtgctcagttttaggtttacaaaaaattgagcgaaagtacccatgtacccccctctcaccacggtttctctctgttattaatatcttgcattagtatggcacatttgctgcaattaatgagcccacatggacacatcattatcacccaaagcccactgttgcgctcagggctcactctttgtgttatatctttgatgagtgttgacaagtacataatatgtatccaccatcacagtatcatacagagcagtttccccagctgaaaaatcctgtgtgctctgcctattcaccatccccacacccctcaggcaaccactgatctttttgccatgtccatagttttccattatttagaacattatatagctagtatcatataggatgcagcctcttcagattgacttctagtacttagtaatatgcatttaagttttctttatgtcttttcatggcctgattgcttagttattttcttttcctcccctctcttcccctccagtcccctacccttcccctcctcccctccccacctcctcccctcccctcccctctcctcctctcccctcccctcccctctcctcatctcccctcccctcccctcccctttccttccttccttccttcacttcctccctcccttcctttcattcctttccttcctttcctccctcccctcccctctcctccccttccctccctccctccctctgtcccttccttccttccttccttccttccttccttccttccttccttccttccttccttcctgaatactattccattgtatggatgtgccatggtttacctactaatctattgaaggatatcttggttgctaatggcaagatttttaatcttatcattatattagtattagtgaacttgagaggggaaagtggccagttcagggaatatataactatttatagtctcctttttaaaaataaaacaagacttttgtcagtttataaaagaaataaggttgaaccatatgaaattgccaatatttaatccttttttcacatacaaaaatagtagtttcatatggttcaacacagcatatgctcacagtatatagctcacatacagaaatgtagaatattgaaagtgaaacataggatttttttgtaggtaaggaaatacaaaattaatgtaaaagtattttctgcctcaaagtccagtcagactagtttcaaccccatagctagttttagtctttttaatcccagaaagaggtgaactcattgcatgctgtgggtggatagcaacactggtggattttgaagcaacccacccggacatggagttatggcccctctgctgtgcagcggccctcctgatgaagttagctggtgctcatagctatccaatttattgacaagccagtggacaccagggcacagggctggcctcctatagcttccttgtctgtgggctataagggagagcttcgatttctcaggctaagacaaaacatggcagaatatgctgctcagtgtagtgaaaagtgtgctggtcttagagtccgtagttggtcaatagctattatttaaaaaaatctatgttctgagttctggagatctagcagtgagcaattcggactattccctgccctcaacaagcttatattgcagaatgctggatgtgggtgtggggaactacatgagcagaagatggcccaactcagccatgagccagggcgaaggacctgtgtgaccttggctggttgctcagcctctctgagccttagggtttttggaggatcagaggagatgggctattgatagtatacatgaaatcactttgtaaattgtacattactctctcagtgtagtttctgtggttatctgttttcaaactataaccctctgctttggaagcgggatttcccaggcttaagtactttggagctcctaggagcgcttccatgttacctcttattccatcatgattttggaacctggtcacatctgtgctcccctgcactctctggatgccatcccatgctcctccagtcccttctgaacatctgttccctgagtgggttctggatattttttctagaagttttattattttaggttacacagttagatttataatccatcttgagttaatttttaatatggtgctgatatagatcaaagttaattcttttgcttatggatatccagttgcttcagcatcttttattggaaagagccgcctttctccattgaattacctttgcttctttttcaaaatcaattgaccatataaatgtgaatctctttctggccactgtgttctgttttcattaatctgttggtgtatattgatagtaataccacactgtcttgattaccatagctttttgataatcttgaagcaggtagtgtaagttctctatctctgttctttgctttcacagttgttttggcaattctaagtgctttgcatgttcaaatgcattgtagaatctgtttgtcaaattctacaaaaaatggctacagaggttttcattggaattgcatggaatctgtaagtaacttgtcagataattgacatcttaacaatatcaagtctttaatccatagtattaatatatctctcaatttttttgttttcaatttttctcaacaatgttttgtattttttagtgtataggtcttgcacatattttgtcagatttatccccaaatatttcatatttctgatagtattataaatggtatttaaacaattaaattataaatgttattctttaaaatttaaattctctatgatcacaccactgcattcattctgggtgacagaatgagatccatctttttaaaaatatcaatttctaattttgtgttgctagtatgtagcaatgcaattggttttagatatcaatcttgtatcctgaaacattgctaacctattgattagatctagaagcttttaaaaccattgttagcctaccaattagatctagaagcttttaaaatagattctgtattttctactgctacaatcatgttgtttaagaataaaaacagttttttttctttattttgtggaaataaatgaagaccatccaaatgaaaacaaacaaagcgtatttattcagagcttgctatagcaagagagtcagccacaatcatttgtgtttaacagagactcaaaggcaggcaggggagtggggaagcttcatggtggaaaagagagggaatcatgtatgccttgactggaggtattggcatggggaagctttaggtgggttaactagaagtggggcagtgtacatgactggtttggggtggatatttggctttttttccagttggttctaagttggaagtgggagcaatatgagaaaagctgtcaattactcattatattctggctgttctgtgctgattgctacaggagttattgtttggctttatgggctgtctgctacacagtagtttgccttcctggactcattactgcagatagtaggttggcttcccaggctgattgctacagtttgtgggtcagagtactatttgtttttaatttttaatttttgtgggtacacagtaggtatgtatatttatggggtacatgagatattttgatacaggtatacaatgcatagtaattacatcagggtaaatggggtcttcatcccctcatgaatttgtcttttctttgtgttacaaacagtccaattatactctcctagttattttaaaatgtataataaattattattgactctagtcaccctgttgtgttatctaatttttgtttttatatatggtctgaccattgtccatttgcatattcagtctttcattttgcaattttgatgcactgaatttctttttcttgccttatcatgctggctagaacttcccagtacaatattgcatatagaaagggtgacagtagacacgtttgcctaattcatcttggaaaaaacattcagtctttcaccattaagtacaacgctagccgtaagttttcataggtgccttttacaggggtgaggaagtttcctgctattcctagtttgctgaaagttttcctttttaaatcaatttatgtttgagtttctcacaccctttttttttggcatctattccacagttgcaatgttgatgtgaattttcttctcccttcttcgccttccctctctcctccctccctcactcccttccctcccttcccttcccttcccttctccttccttccttccctccctccctcccttcctcttttccttcctccctccctcccttcctccctccctccctcccttcctctctctctttctgtaggtatgataaattctattaattgatttttaaatgttaaatctaccttggattcctgggacaaatatcctttggtcatgatgtattattcattgtatatgtccttatatttgatttgctaaaaatttgttaagaattcttatatctatgttcatgaatgatatcagtttgtgtttttttttttccttgtaatgtccttgtttttgatatcagaataatactggcatcagaatgagttggaaagtattccctctttttcaattttgggaagagttggtgtacaattggtgttttttttgttaatgtttggtagaatttcttagtgaaaccatccaaatgtgatgtttcctttgtgaaaagattttaaccacaaatttaatttctgtcacccagctgagattgtgcagtggtgcaatctcagctcactgcaagctctgcctactgggttcacgccattcttctgcctcagcctcccgagtagctgggactacaggcacccgccaccacgcccggctaatttttggtattttttagtagagacagggtttcgccatgttagccaggatgatctcgatctcctgacctcgtgatccgcctgccccggcctcccaaaatgctgggattacaggcgtgagccaccgtgcccagcctatttattcttaagctttggtagtttgttttttcaggtaatttgctcatttcatctaagttgtagaattaattggcagagtcatttataatattacctgattattattttaatatatgtagaaggagtcatgtttttttatctctcattcctgatattcatgattagtgtcttttctctatttgtttccccattggtctgagtagagatttatcagttttactgatctcagacaaccagcttttgctttcattgattttctcttttgtatttctatttttgttttcttgatttccactataatacttatattttttcctttcttctgctttcatgaggattaatttatagtagtcctccttatccatagttttgctttccacagtttcaattaccctcagccaaccatggtctgaaaacattacaaggaaaattctagaaatgaacaattcataaggtttaagttgcattctttcctgagcagcacatgaaacctcacaccatccaggttcatcccgccctggctgtgaatcctccctttgcccagtgtctctgcactgtgggtgctctctgcctgtgagtcacacttgtagaccacacgggttgtcagatccactaatgaggcctcaccatgcttgtgtccaagtcacccttacttgacttaataatggctccaaagcacaaaagtagtgttgctggcaactcagatatgccaaagagaagctgtaaagtgtttcctttaagtgaaaacatgaaagttctcaacttaataaggacaaaaattgtatgctgaggttgctaagatttacacaagaataaatcttccatccatgaaattgtgaagaaaaagaaatttgtgttacttttgctgtctcatttcaaactacaaaagttatgaccacagtgtgtgataagtgcttagttaagatggaaaggcattaaatttattgatggatgacatggacagaacatgttctgattgacagcgatggggattggcactatctgtagtttcaggcacccactgcgggtctgggaacctattctataaaagaagactgccgtactgttctttttctagttttataaggtgcaagctgaggtcattgatttcagatctttcttcttttctattataagcatttagtgctgtaaatttgggatggcatttcaaagtctccatataatgaatacggagtgttaaaattgattgggacacttgaaattctcatattctatctttacattttacagttaaggaaacatatattagtcagcattttacaattaatttatgtaccactcttggtgtttattgaaaaaatttctcgggtgaaaccagttttggaatgttacctatctttatattcagagacagactctgtctgttctgttttaatcttgttaactgaatccaaaattacattctagttactctttgtgggcctagaacagccttcagtgaaatgcaatcccaattttcttctgtaagcacagtctgtttgttcccatctatcctagggtccagaattcttgaggaaggggaatttcattagacatactaagccaaaagaagatgtcacactgaagaaggtggctgtgtgaattctgacccgtaagttgggaggcacaaggactgaatgaggatggttaatgaatggatgttcacagaaggagatgctgagatttcacaagagaataaccagaacgtgcatgctggctgttctttgttttggtagcaataactcaaccaaaatacttcacattccagattacttaaggaggtatattttgacccttgtttgtgtacggtatgcatcagaggtttgaagaatgaatgaatgaatgaatgaatgtcatgtacttctgtgtactatttaccttctataattcataaccattcaacttttctcatagctgaaatatagcataacttgtttttctttttttggtagaattggtttaatctagtaaaaaaagcctacgaatattaataggactcaaacctttgtcaatttcctttctcactttggcccaattttgtaaattcactctcagcagagaggagtaagattagaaataccagaaattggattgaaatgtgacttagaatcaacacatcacccccttgttgaagtccagaagaaagggctgtgcagaagagaacagatggttgtgtttaaggcacaaatttcttctggcttcctaattcagcaaggaagaaaggaatccacagccacagcctccccttggctgctgtgttttgtcatggaagtcagaaacaactgcagtgggctgtcaaggagctgaaggcagctaaaccctctctcctttaaaaaaaaataatggtcatcgttttccacccttattaaccagttttcagaatcttagtacatttctatgaaacagcaaattatttagcaggtaaaaaaaaagtgggccaggcttatttgaaatctagctaagagcagatggtgggagggaaagggttatgcatggtactgcataatgtggtgcccaataacgttaggatgaagactttattattttccctggatgagaaaatgtccagcctgaatgcatgattacattggttaaacacttgtcagtagttttggactaactttatatgtgcatatttatctgtaggctgacttttgtgaagagactgaatcaaaattagattgtcaaaaatgatgagggtcaggaagaaattatagaatcctgaccatgtgtttgagaaagacaagcagaactgagtttgacagacacttctgtttcctttgctttaacttcagtctgagacagtgagactaattaatataccagaggtaatcatttcaaaccaaggagcgttttttggacacctacagtacattgtaccttgttagaatatagaagatctaacatgcattgttctttgccaaagggttgtggtttggaaccacatgagacaagctgggcagttattaatctgtcttttatgaattgccgaaatgaaaatcagaaagggctaaactatgtggccaagacaatgagagctgtgagaggtcagtataggatgaaattagtgttctggagatacaggagaagatttcagagacgggtcagtcttgcaatagacattgaagggtctgtttacatatacatagtctagtatatcaaagggaggcatatgtgtatcccaggaactggggtgagaatcagcaaacgcttagaagcatcaatatgcaatgcgtgatcttgggtgcgaggaaaacatatcctgcagtccagcactggagttaagactttagtctctgaagtcagaaagcctgggttcaaatcctggctctatacagtgtgtacttgtacaagttaaatattatttaacctgagaatgcagaatgttaaaagttcataatatgtttttcaactcagtctatgcaagccacctctcttattatttactgacttatgtacttttatcgtcacatcctgggatggatttgaccttaggcaaggcagctctctgcagctcaggggatccctgaaaaggctggggtttgtcaaaccccgggagcaggggtaatgattctccgttgaatggggatcggggcagtgtgtcttcacgtccatcaaactgatggaactctgagttttaagggtctatgtatggattctggataaatgtttgttattatttgcaaacaatacgttttagctcttcccttcctattcttagatctctttctttcttggcagggaactccagtgctatattcggcagcagtagtgatagtggccatatttttcttgtttctagtctttaaaagaatgctatcaatatttccgtattaagtataatggttgttatcgatttttcatataacctgtatggagagaagaacagccctatctttccctagctacttgaatttttaaaatattataaataggtgccggattttgtcaaatgatttttccgcattgatttagatatgcagtttttcttctgttagtctattaatgtggtgaataatattgattttttcatgttgtgctatgtttgcattactaattaatccatgattgatcatgatatattattttaaaaaacacaatgttgtattcagttttacttaagggttttggcatcaacatttaaaagcaatggacctatcaacctcataaaatgatctgggcatttgaacctctaaaaaatattgttggtggtgttagtggtggtggtggtggtggtggtagagaagagaggaagtggttggtgatcatttcagttattattattttttgagatggagtttcgctcttgttgccagggctggagtgcagtggtgccttctctgctcactgcaacctccgccttacgggttcaagcaattctcctgcctcaacctcccaagtagctgggattacaggcacctgccaccacgcccagctaatttttttatttttagtagagacagggtttcaccatgttggccgggctggtctcaaactcctgacctcaggtgatccgcccacctcggccttccaaagtgctgggattacaagcgtgagccactgtgcctggcctcaatttctttaatacttgagatttttttcaagttcttttttattcttgggattttttatcatgtttcctagatatgcatctcttatgtttatgtagttatttatagtagtttttataactttaatttttaaataacagctttattttgatataaatactatgaagtttaccattttaagtgtatagtttggtgatggttatttggtggagttttgcatggatcaccaccactgcttccagaacatttacaccacatcctccaaaacccctaaactcactagcagcataggttagtagtattaaacaaagtctgtgcctattctcccctttgtaaagcccctagcaaccattaatctattttcagtctctgtagatttgcttattctggatatttttatgtgtagaatcatatcatgtgtgccccttgtttctgacttctgtcacgtagtgtaatatttcaaggcatatccatgttgtagcatgtgtgagagtttcattcctttctatagctgaatgatatttatcataggatatactgcagttttaaaatccattcatcagttgatggatatatgaattatttccacatactgattattatgaataatgctactacagtcatggacaagtttttgtgtgaatatgtttttcaattctcatgagcgtacacctatgagtgaaatttcagagtcatatggtaactctcacttcttcatgaactgccaaactgtttgccaaactggccacaccattttatgttcccaccaggagtgtgtaaggtctcaatttctccacttccttggggaacacttgttattgtctgtctttctgatggccaccttagcatgtgtgaagtgatattccaaggacctatttttccagtgaccaatgatggtgaatattttaccaatgaccagtgatggtgagtatcttttcatcaacttattgaccatttgtatatctcttctggagaaccaatacctcccctcaagcctcacaactcgcaccttgactataaatcccttgttctgattgtatttggaatcaagtccagttccatgctggagcatttcttcccttcttgcaatagtttttgaatgaaatctatctttaccactttaacatctgcccagctctggttttctttaactaagtcctttgcccatgattttaattgagatatttgtctttttataattaagtcgaaaaaattgtttacacatttgggataaaagtcccttaacagatacatgatttgaaaatatttctcccattctgtgtgttgtcttttcactttctttttgtttttgtttgtttgtttgtttgtttgtttgcttgttttcgagacggagtcttgctctatcaccaggctggaatgcagtggcatgatctcggctcactgcaacctctgcctcctgggttcaagtgattctcctgcctcagccttccaagcagctgggactacaggcacccaccaccatgcccagctaatttttatctttttagtagaggcggggtttcaccatattggccaggctggtcttgaactcctgacctcgagatccacccacctcagcctcccaaaatgctgggattacaggtgtgagccaccggtgtctttgaagcacaacatttaaaaattttgatgacatccaatttatttatttttcttgtcacatgtgcttttggtgtcacatctaagaagccattgtttaactcaaggttacaaatattcaaaggcttttatagttttggctgttacttcaaggcctacaatacattttgagttaacttctgtatatggtaggaggtaggagtccaactccactgttttgcatatatttaattgtcccatcattatttgttgaattgtgctggcatggttgtcaaaaatccattaaccaccaatggaaggatttatttatggattcttttcttttttttttttttttttttttttttttttgagacggagtctcgctctgttgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgaactcctgacctcgtgatccgcccgcctcggcctcccaaagtgctgggattacaggcgtgagccaccgcgcccggccttatttatggattcttaattctattccattgatctatatatccatctttatgccggtaccaccctgtcttgattactatagctttttagtaagttttgaactggggagtgtgagctctccaactttgttcattgcaagattgttttggctaatctgagtccacgtgagttttagaatcagcttgttcctaagtagtttttttttatgctattggaaatgaagttgtttaatttcatttttagattgttaattgttagtgtttagaaatgcaattggtttttgtattttgatcttgcttcttgcagcctggctgaattcgtttcttaattgtaatttttggtggatcagttaggattatgtcatctgcaagtagagagagttttatttcttctttccagtttagatgcttccctcacctccctcacccccacaatttgttgcttaattgtcctgttgtgaacctccactacagtgtcaaatggaagtggcaaaaggggatgttcttgtcttgctcctcatcttagggggaaagcttctgatccaccatgaagtttgctggtagggtttttcacagatggccctatcaggttgggaaacttcattgctattcctagttgttgagtgtttttgtcatgagagggtgttagattttgttcaaagctttttctggctctattgagatgatcttagggtttttgcctttccttctataaatgtggtacattacattaatgggttttcatctattaaaccaataaatcttacttggccatggtatatattcctactacctaatatgtctgctttatattttttatgatttcatgtttttgcttcatattggtaatatcttctcaacttcttaaatatacttatctttcttatttaaaagtcttggttcatatattccaatatttttgtttcacttggttttgtgcccgttgcctacaagaatgtcggtgctccggactaaaacaggaacattgagcaagggatttgatataggaggaaagataatggttctttctggaagtgcagacagtcccaaacttacaatgtttcaacttaacaattgttcgactttatgagaaaacgatacaccttctgtagaagccatacttcagtacagtatttaataattcacatgagatcgtcaacactatattataaaacaggctttgtggtagatgatttttgccagctgtaggctaatgtaagtgttctgagcatgtgtaaggtaggccaggctaagctatggtgtcgggtaggttaggtgtgtcaaatgcatttcgatttaggtgatgcatttcaatttcagtttaccgcaggcttatggggagaaatcccatcgtgagtcaaggagcatctgtactgagtttcagtagggtgttcggatagctaaagggcaaggttgtgaaggtggttaggaagaggagaaaaaaaagttgggaggggagggaaagataagattctgagaaatgaaaactggcagttgaagagcttgagagctggaaggcattagagcagtgcccctgccaaaagtgggcttccttcatgctccacacctctcagcctgctgttttcaggttgccggcgggttggccttgagactatttctccctgattttgcctctcactgaggtgctatccagctgaagccagaagacagctcactcagtctggtttcttttcctgccaatctgggcttggcagccaccagggagagatgggagagttgaaaagagaggaaaggaaagccgcaatttttaaaaatccattttcctaggaagcactgggggagctggtgaaacatctaatgccccaaactctatccctagtaattcttattattcagtcacgaaactgccttttaaaaaaactccctgtgattctgaataggtgatccaaggatcaaactgagagagaatggaaaggaaaggactcttgcagtttgacctccggcagtcccctctcagctctccccaggagtgggtgctttgcgtgccctcacctctagaaatgtaaacctctgcctgtgtttctctctggcttctctctggtccctctagttgagggagaggcatgacatagagctctgggcgtttcttggtgggtgggtacttgcattagttcagttttcaccctgctgataaagacattcctgagactgggtaatttataaagaaaaagaggttctacgtggttggggaggcctcgcaatcatggtggaaggcaaaaagcatgtcttacatggtggcaggcaagagagaatgaaagccaagcaagagaggtttccacttattaaaccatcagatcttgtgagacttattcactaccatgagaacagtatttggggaaactgcacccatgattcaattatctcccaccaggtccctcccacaacatgaattatgggaattatgggagccacaattcaagatgaaatttgggtggtgacacagccaaaccatattagtattgattaaatacagataatatatttccaaaatatataatccagcttctctagccaggtggttgagttgaggatgcattacaatttaaaataaaagtcctgcaactcaaaaaatcctctactcaaccacctggctagagatgatggattacgtatttcagaaattccctgtttttctttcatcatgccatcaattgaaagcaacctgcaaacagactaaaatctgggtctttgagtaagcaaatagaaaaattgaaaagcaggtgggggttgagctgcaggtgataatggaattgcagctggcagcatgttccttcttcccctaaggcctgtaaagttggattaaataaaacaaatactggtggaataatcaaatatgctttggagtacttaactctgtttggggactcagaaagatgggattcaaaagaaaaaatttctgttttcccgtcattaggtgaaacaaagctgcttacctatttttctacagtattatagctggccccagctgcactggtgagagaattttcatccctgccccacttccactgagtaattttctgtgcaaaaaactgactcaagggtggggagggcaacattagtgtagagatgggagcaacagataggctgttctgtgcacattattttacactgagaaatgttctttatagaattcgctgatcacttttttcaggttataaatgttatgtattcctagaagtattttttgaaaataatgtggatacaaaatcttcaaaaataaagtcacattttaagtgcaccctaggaatttgacttttaaaatataatttgatgagagatggagaatctctttgttcagcaaatactctacaattttgtttgtttagttaatccaactttttcttctattattgctctgtttaaagcgagttttgtttaagttgtgtttactgtaatccgatttacctagctacttaaatagttaacgagtatttaaagagcaacagccctgtgcagaatatttaaaggtgtgttgtggggttggatcaagagaaatggaagattcactcagaataaccgagttcaatttgagaataattaatgatacatgctacaaagtataaagtaatagggtaaaaagataatctaatataaaaatgttatacagaataatgaggtgatcagagtatgttgggggagctcctgggagccttgttgcagctgttgaccttattggggttgtctgagagactgccctgcctgccttgtcattcacataagggtggggacacttgtccgttgttttttcccacagactaaacctcactcgaaatcagtggctatccattcacatgtgatctctctgtggcccctctcagtgatcccaggtgatccagccatgccctccgcccctctgcccagatgcttcaggggccctgcttttcaggcttgccctcaccagtggccatcggccaacactcagggatgtagctaacaccactccaccagtgctttcggtaggaagagctgaggctgcctgggaggcccggggcaacaggaaaagggctctctcaagaaaagagaatctcccaccagatcgaattgcaacccctaagcttgttcagccttatggtctgaattcagattaggttgtcactcagtctgagatgtcaggaaaggccttctgcagacaaaatgtcccctctccccgcccatctgcagccaggtgtgtgctgcacggcaaccttcccaaaacatagtgtggattttaaaaatttgtttatttttgtttctcaaccactttataatgtatttttaaatttattttgtaatatcttgtttttaagtattgctgctatccctgttatccttcccattgttttcatcactgatttattttgtgaaagttgtacactgttgttctgttttatgtcaaaatcaaaagtatttaatgaaatactagttctatttaatgtggttatggaaccagctggaaacacaaaacaaacagtgattgtacagcaggctggacccaggaggtcaggttcattttgttacatacgcaataaactcatgactttacaaaaaaaaaaaaaagaaagaaatcggtggctatcacactagtccttgctcttgccagtagtggggttaatttttggactccacacaggttcttagtccagccacaaattttatagaagaaacctgagacatcagaaactgtagctcaggattggctcatgttgtttaagattccacatttcagaaggatttgttaactttgttacttcacattacccagtcttctctgactttaatactgatcacattggctttattttttctcttatccctacctttaacttctcttcaagggctttctggggaaatagtgcttttttccccaaactgcaaaagagaagcctagatgagcctgtgttcttttatttctcatgtgactctgtttaaaatgcacagacatcatagagacatatttagctctgtactgaacaccacagaaaactgttcctccaggctttggtggtaatttaattttttgagttgcaggacttttatttaaaattgtaacacgttgatgtagtcacttgtgtaggcagacagccacgtagataattacaaacatgattccacaatcacaggcactgcacatcccaccgtacatgatttttttctccagcaaaaatttgctttttcctaatactttttatggtaagtgttcctcactttaaatgctgttttaaacatattttggaagaaacgaagtgacctaattctagaaacattgggactaccctttttgcttttggaaattgaacggattgctgtgtagaagaagaaagaccccaggagaacatctagtgtagatggatggcatatgtattagtcagcctaggctgtgtcataacaagataccagatttgggggcttaaccaacagatatttatttttttgctgttttggaggctagaagtccatgatcaaggtggcagcagggtcggtttctggcgatggctctctcctggcgtgtagacagccgccttcttgctgtatcctcacatggccttttctctgtgcacatggacagagagcacaatctctgatgtctcttccccttcatataaagacaccggtcctatcagttagggccccacccttgtgacttcacctaaccttaattacctcctgacagaccctgcttccagatacagtcacattgggcatgagggctgcaacacaattcagtccagaataaaacaaatgtccacgatcctataattaaaagctaaggcatggcaccttcagccacagaagcctgcatatctgatcacaggtctaaggacactttaccaagctagtatctagtggatccctgactcttggaaacagtagaggagttaattctgccttgtcccaaacctctcttcctcaacacactgcctctgtttgagctgtggactctgcagcaagacagctgccaccctgaatctccacttttgcaccagttgcagcaaaccctcagtttcttcagagcttatgcttcaactgcagtcttcatcagctcacctgctgagacgtttcctccaccgtgcactctgtcaaatgcctgtgggcaatgccgcttaggactatctctggtctgtgggctcccttgctcctctctgacctgtactgcagccatggagtttagagatggaagtagatgtgtgagtctttcaatttcatttttggaacgcaacgggatctgtaacaacatgtttcaaatgtacacgacacttttacacaatggtcttaattcttcaagggtcttgggttcttgttccgaggttaacttattctttccttcacatgctcaatcactgaaatgacaaatctttattgagcaccggccatgtgtcaggcattgtgatagattttggggatacaacagtgaaaccaacagatataatctctgttcactgaaaacttgtaagttgtgggaccttgagaaaatctcttggtctttctgggacatatattcctcatcttaaggtaggactattagaatgataaatcatcagtgttagaatgaatctttaaaatgatgatttttccatctgattattggaatgatttgatcttctaagtaatctaaaatttcaaaaaagcattaataagaaaacttaaagtcacttgtaatccatataaacaatgctaatccttttgtacatttcttcctagatctttgccttgtatatgcatacagatgcatatacgtttttgtttaaaaatttatattctgattagaaactgccttttaatatttattatatatatatatttctatgtcattgaatattatcattatgcttgccagtggctctttggtatctattatatggatatattacaatatttatccctcttgttttagggcatttaacttattttcccatgtttactactataaataaatggaaatacatgtctctgattgcttccttagaataaattcaaagaagtaggattgttgactcaaacaagtttttgctttggatatatattacaaaatttccatccaggaagcttgtatcaatttacatgcctattatctatgtacacaagtgctagctttttctgcatcttcaccaatatggatatatatattttgtaaatccttgccaatttgatgggagaaagaaacacattttttaaattaaacagttgtaaggtagcacttggatgaatttctttttgtaagtcttttaactattagtatttctacaattcctatttctatcctttgtctattttaatgttgtttctttctgaataaatttgtgaggacacttctgatctcaaagatagtaaagccattttcttttacatgctgcaaatatttttcctactttgtggttttcttcttacacatacgtatttcaaatttgtagccaggtccatcagtcctgcatttttttctttctttgcttagaaaactttcccatcacaaggttaaatatattttcctagttttcttttagtcccaaattattgactctattttgggactttttattatattccatgtatttgtctgtttattctgccattaaagccatattatatttgttctgttttttcatatataagatctttagtttctttttttttctcattttactttttattctaagcattctagaaattgtctctatcttgacttctacatagatctcctgtgttgattctgctattaaagtgaaagaccttcaagataaagctatgatgttttgaatttccattctgtattaactcagaccctaataccttatctcaatctgttgtcttatctcatctttcagcttttaccctgttgatattttcttgaattaaatgacaaaaaagtgccatttaaaacttctacttattgtagtaaatattttgcaaacaattgcttaatttccttgatagtttctcaaaaccttctttcatatttttttcacagttttttttttatagatgccaccaatctttggcagagcagaaggttattaaagccagccatgtttccctgctatgtgtgattggccttggatctttccaacatctacctaaagccttttagaatcttctgatttgattttagcactaggactcagttaaagaccatttcagtagcccagtggcctgggcaggaggtctgggacctggcacctcggggtcttccagcagaggagtttgacttcttccttccctatgttggagaagccttcctttagggaccagctttctcttcctagagttttagttgacccatcattcattctaggtacacggagtttctgtgcccaatgttcttcccctgacaaataagagaagatacatccatttggaaaagagttccattcgttagagggaatccccagcacttgtggttttctatttgtcttgtctgcatttgaccctgcctcctagtgagaccatgctgcaccttttccagggctcatccctgggaccctcagtgaagggatgcttcctggggttttgccaggatgccctttcatttcatcctgtgtgatggagtccctcatctcgcatcagccggttgttttgcaggaacccgtgttctagatgtttggtgtttgctgtcccttccctattggctcctcttctccccggaatgacctcaaatgtggtggcatgtgagaatcactctttgttccaggttttcctgttttattgaggtcctcggcttattttagctggtttctagaagaggtataattagatccttctgatgaaataagatggtggaagacttatctaggaaatcagaaatggatcttaaagcttatttgagataacacctctcctgccagcctcacaactgtgattcggggatgaaataagatgatgaaggtggaaggactttgaagactgcctgaagcattatgcaaatacaaggttgctttgttatcgccacgttttatgataccagaaatcagtagccctgctggaagcaaatttgagttgtgaatttttttgaggcatgtgtgataatggaagatggttatttaggtgaggcaaaaagccattctatttctatgtgtttcacctccttctttcacagcaatacatctgaaatagaggtttgtcttgttctttattcccccaaagagaaggctggcctgaatttccattttagactatttccttgagtgccaagagattgtttcagcaaaagaaactaatcttcagataggtctgtccccgcacaatgcctaggatcgggggtaaaggctttaattaaaatggaagagttggtaatttctggttgatctgggaagcttaaagttgatgtggtttgaatgaaataaatgagttttgctcaaaatgcaaatattaatgcaaaaaagagcctgggattgactctcagtgtaattggaagagattgttaattctttttcatgtcttttcccttaatgtaatggttctttttttccccctgaaactctgtaatatatacatttaacaagtgggtattaagtgttctccttaaagttcttttcacttggcagtttgcctgtcttttcagactcttaaaagcagtggaaattttggtactaataaatcttgggaaaaagtaataaggatgtgtttttgcttgtgtttatttggatgacgtaagagccagtttcagatgtagcttttcctccagtccttcacagtgtagttgtgcgtatagcttaggcctacccatcctctagtctctatttatacacagaaagtgaaagtgacacttatgtaccctggcatatgtatgtactaaaatgaagttttaaaattggaagtagcatatattgctcttgggttaagaaggctcatctaataccaagtactccaatgaaacagaaatgcattttgaatgttaataagacattaacaagggttgatgaaaatgtggacaattataccagtatacattaacagcatttctgatcagtgatgctttttactaattacaataattgtgggtaaaaagtatacacaatgtgaaatcaaaatggcttaagcattgcaaaattattattattatatttatgttataggcaaatttgttataaaaataaaaaataaaaaccagtcatactccccatatcctaatgaatcatgggttttttttctttttcttttctacctgtattatctacttaagcacttttgtgtaattgtaatcatagtatctgtgcagttttgagtttagcatttttctttcaacattcattatatatgtaggtacatatatatgtatatatataatatacatttaaaaacctttatatatatgtgagtgtgtgtgtatatatataaagtttcttcccccccgcaattctccctttaacacagggcatgccacggctgctttatcagccttctgttgttaaatctgcaattgtctccctaattttttgttcctatttaggtaatgcggcaatggatatctttgtttcaattaattttaactttcttgttgtaggaaagtttttgttcatttgtttgttttttagaataaattgaaaggagtgagattactgtgccaaatctcatagaatttccagtaggtacagggtagagaggagccagttagaggaagacactgtaagtgtctcagagtctcatttagagagaggggtgagaaagccaggaagaaaggaaaggatggctgaggtgggcggctcacttgaggccatgagttagagaccagcctggccaacatggtgaaaccctgtctctactacaaatacaaaaactagccaggcgtggtggcacgctcctataatcccagctactggggaggctgaggcaggataattgcttgaacctgggaggtggaggttgcagtgagctgagattgtgccattgcactccagcctgggcgacagaacgagactctgtcacaaaaaaaaaaaaaaaatgagagagaaagaaagaaagggaggaagaaagggagggagggagggaaggagggagggaggaaggaaggagggggctccctggcaggtctccatcctcaggtgccacaggcctaggttggaggcagggcaagctgtagaaaccccaggaacgatctgcagggaacctctttccctttgtcaaccaacgtaatttggaagcagctttggatttgagtcaggccaattgggaatgtgactccacactcctccccctgagaagtctgcagattttcacttcctgctggaagttgtgggcagggaaagcagtgaatctggtccaggcaccttggggaaagcaaagagagggaaaaacggtgcccagggaaaaggaatgctgctaaataatgaactaggatgcctccgccatcattccagaatcaggtggtatttgccaaagctctgattttcctcaccggaaaccctaggcaagggcactgcctgaggtgtagccattccttttcctgccaaaactggaggtggggggccccgagggaggaaaacaggcctgtactgatcaaaatcactaataagcctcaaatcccaacatctcacatcactaatggcttcatatcagagcttggcatttattttcctttccttttcagccaatgggttctgactagtttgtctagctgtaattaaataactcagtgaactctgcctttactagaaggtctttttaaaagaaatggaatactttagattaagaggaaaaaaaaaaaacagccacaaaccaggccgcatgatgagatttccagttttgccataatttcattctctggaaatccagagctttaggagattgataatgcagggaatgtgaaaagaagttcctctatggtaacaaatgtaaaattgaaaatccacttcagccacatttgagctcacattgttcccacttatttttccacccattatcgtctgcgtgctttatcaccagctcaggctctgtccacattcagcatcttgcaggttaaatgttcctttttattcttttgactgtagtagtagtcccaatataaccatgactccttccttacctctaaaataccctcagcaaaatggcagaaaatatgtacagatgttagtaagctgcaaatttatttgcaaagagaaaaatataagcctgcattgtcattttcaaaaacatgtagaagccgcaaaataatgttgactcatctgacatacatctacatgtctgtttctcttaaaaaatcttctagacaaaaataaacaaacaaacaaacaaaaaaaactccagatgacctttgattaaaacctactatgtaacctagaaatggtgctataagtgttgacaatatatttctaagtcacatttcagtacttttacacatttgtaaaaatttttcatgtttcattggcacttttaaacccatttaaaggccttaaaagtgttcagggattgtctagaagcttggtcttttgttgctctagacagaatataggaattaagaaagtgatgaatgaggaaaatggacaggaaggatttacaatctatcctgtaaacaagatgcaactttctatgtgttctctgaaaatcactttgccttcatggctgattcataaaagtaaaccaccatccaggagatgggctaggatgcaactgtaaataaagtcatagtggaacaaaagcctggaaaagcaggaaataacctctgagtaaaggaaagggaagggggattggaattagggaacaatagattcgagaggtgatgcagtcaacagtgaaaaatgtttaatattatgcagattgcaatttttcatatgcaatgtctcatttgattcttatgacaccctagcaaatgttgtggtattcattttgtacatggagaaaatgtgactcattctgatataaacacattccaataagagactggcctaatatcacacagctaggaagtggtagagctggaacccagattctgaatgtgtgatgactcttagtgttcttttcactccgccatcctgcctcaggtagaaacttgaagttctgactgtattctttaaacgtgatgggaatccgggatgaaactctcagttgagcaaagaagaggaaatagggaacaaagaaggcatcagtttctccatgctgggcatggaccagtcagtatagccagaaatcaacaatcctgctaattccaaagaaaatgagtctttatttgctcaactgcatcatctgctggcaggtagcttaggctgtggtcagtccgcagactgacatacaattctctttagtttgctcatgatatctgaccttagagaatcccatcccttttgatagcttattaatgaagtctgtgtgtgggagagccatgagaaaaggcttctattgggggtgaggtgcaccaggctcccaaggaggcattgtccccagaccctgagggcagggcagcagtagtgagagagatcactgtgcctcttcttatcacaattaatgcttatgttatttcctttgcttatttgtttttatttttgaggaaaattaaatatagtatattatccaccctaggctacatgatttcaatgccttcaccttcttcattactgtgttttctcatcctgaaattacattggctttagaacttggggcaagccacttaacctatctgaaactacatcctacatccctcacaggagtatgcagaagtgtcttctactgaaaatacatttctttttgcatttgcgggcactggctaggtttcaaagggtttgaaatggcttatcttttacagtatctgcttatgcttttccttcccagagtcgaaaacatgcaagcaaagtccgactgtattacatgcttcaccccagggatggagggtgtcctgccaagaggctccggtcagaaaatgtgagtatctggtaccacgtgatatcctcagatgatttgttctgtgtactgagaactttgcaggtgtaggaattgtagtctagtccagattcatagaaaagctgagtgagtagaaatagttctcactaaatattacaggtactatgatatatatcgaggtttttttattttcctgccagaacttgcccatatagtattggaggagtttttgatgacattgcactgggaccataaacagtgagaatacacagaggttgtggggcagagagcaaggctgggtaaggggaggcaggaccacaacatgatgaagtattaagaagacaggacctcaggggcaaatctgtcagaaatattagatacttcactttctacatactttatttttcctctggtgtataaaacagaatgtcttgtttgttaatttataatgaagagtgtgcatattttgcaaataaaaatacccaggcttcttgatccctccctctgaaggaacatttgcttgggaagacaagtgacaattataaagtcgctttgagggagtcaagtcagagcaaagggcttatttcagccaggccaaggcaaaggctgatgaaataaatattccttcctcccagcaggggttacttttcctaatgagtagaatattcatatccaccagctgcagaggctcctcctaataaacactgtggattaaacacagaaattcctcgccctttgagttaagaggaggctgcaggcgtagaatttataccccacaccatccgtgtgcttgtgatcttgttttctttctgctgccatgtagatgacggttttcttttctcattaaaaattaatacatgatcactgaagaaactttacaaaaccttcacttgtgtatttttcacaggggataaaaagagggagcaagagaactgcctatgagcagaggttgtgagcatcaaggctggtgtttttaacaaattctaagcatgcctcttggtgtcacaaaatgagctgttcatacacagactaatctggaacactgcagatctgtctttactgccttgttgaagcagcctttagagcttattggaagcaaaagatgtcttgaaaactttgcaagctgctaagagccgggactgagtctagtttttttttagcccttagcgttaggaccctgggcaaataattgatctcttgaaggcccagttttctcagtcaggcaggccataatcatcatattttactttcctcactggactatggtgaacattaaatgaagtggtagataggaggcgtactgtgacttgccaagcatcacatgcaggcactgacaaaacagctaaataagacgcagtgttgccttaaagaaattcataatgtagtatgggagattgacattgtataaagagtagctataatatcacagcataagtgtttattaacatcctgcacaaagaaacatggagacaaaaggcaagcggatcatgccaaggggctctggtcagggaaggtgctcctgaagagttggcatttgagctggagcttggggacatgaatggattttaccagatggaggccgcaggagggagggaggaggataccaatttcgtaggcacattcctctcagaaaaacttattaagccatgggagagttggcctacaccagcttttatgtaacctccgaactctatggctactggaatcgtgcttcccattgggagagtatctattagcagaaagaatagaattcgttttttacttcttgaaattatccagcaatcagatctgaatcctttcatataatagccatttagtgtcttatgctaatggtcagagacaatggggttcacagccacttgacaattagcttaaagtggcaaaaaaacagagatgactgcactcaagctagtgttgtagttgtacaggctcaagatggtccttgccactctggtcaggtgcacaatcccctttaatcaagctccggtgctgccaataaccgcaaggacagtttacagtgggaaagatgtttggatttcagagcaagaagcatctgtttgcattctttatcaaagtccccgtggaaaccttttttctctgctgtttcctgggttttgaaaaaccttgatctaccaatgatttatttatcaaatcatttttctataatttattgagcataatataaaagcaaaccagtaaacagaaaaagcaataaaatcgtcttactttttgagagtgatagttgatgcttttgttacactgtgtgtacatttgtaggtgaatatatactttccgctatgcattttgatctattggacacagcgtggaagtcacccccaatacttctcaggggctttaagagtgtatattggtaattatatgaatcaactttcttttgtacaggcttatacctaagaattgagagactgaatatataaagacgttgtctggagaataagaaatggtgtcttatttttgggcattgaagccattgctgggtccggggccagggatgactgctgttctgggtgagtgggtgcagtggctcacacctgtaaacccggaactttgggatgctggcaagaggaacacttaaggccaggagttcaaaaccagcttggacaagatagtgagaccctgtgtctacaattttttttttttaattagccaggcatggtggtacatacctatagaccccgctcctcaggaggctgaggctggaggattgcttgagtttaggaatcagaggctgcagtgagctatgattgtgccactgcactccagtctgggcaacagagtgagacactgtctctaaaaataataataataataatatcgaaggtatagatttttcataaggcccaactgacataagtcatatttatttagcattttgttttcaaagcactttctgcatgtattattattactgatactctctccactagcacgctgtattctcagaaggatataataacactttattctactcacctcacttcctactcagattctgtgctcccaggggctgtgagaggtttgcatcccagtgttaactgattgagaagagcattcacatctgccctgaatacccccagcgtatggctttgtaaacagagaaaatgtgttcctgatttcccacaccctgaccatgtatgaaccctgctcccaccccattcataggaactcgaaatttacttacaaacgcagtgaagggcctattatacttctaaggtctattgttgccatttctacttcaggccatttggcttttgctgttgttgttttaaacacccaaattcatttctatcttctgttttgacattgtcagctgtttaaattttctcttcacatgcttttatctttagaatccttactcggatcttacattttttttccccctggaagacatttttcccttggggccacagagtaaaattaagtgagaaataaattgttatggtcaattgccttagagaaattttcagtaatccctccagcgttagagacagaaaggacttcagtgttcacgcagtccattgagagtctccgtttttcacccttttattatcttcagacccgtgggtcagatgctttgggaaaaaatgatctgtatgggaaacagcatttttaagtaaaaaaggtgatttagttttacctgggttttttttttgtgtgtgtgatactttgatttttgcaaaatgtaagtaactgctgaccaaaatcgcaagtcagttttaagtaaacagtatttttatgtggggttaagataattccctctaaacatagagaagcttggcatttggttagtgtcatcagtgttactactcttaatatacatgctttccttcagatctgaaatattctgcatagcttgagaagctgagtgtcacttttacaagtccctaaacatcctagagtctagatggggaagaatcaatctaatctaaacccttcttattacaaaggtgaaaataaagaagtaccatgacttgaccaaagtggtcagacctgagattaaaatcctgcttccctaaatgctattcctagtcttttcccacatatcttgaagtggtgtcttattttttggccttgtaactgttatggggtctggagccagggagcattgttgttctgggcagggtaaaaatagtggctggcttttatcatgcactttccacacgtgttctaaatgctttatatatatgagtgatctttcatcttcacaagccctggagaaggcaggagttgtcactgtccccacttagcagagaagcaaacagagagattaagtaattgactgtgatcacccagctagtacttgacagagacatggctggaaaagtagaaaacaaaaggagatctactctgatactgtaaactagctccacaacatcccatcgtaagacgataacgagcatctgcaaagcgctgggggacatggacaccttccccaacacagatcaggatctagtggggaagtcagatgtgtagaccctgtatctcaatgcagcatgataagtgctaccatagacatatgcctgggcatggtgaagggtccctggcctctcctgatacgatggggctagataagttttcctggggaaagtgacactgaaccacttcttaaaggatagatttgggtgagctaaataaaaaagagtgggaaaaggcccttttgagtgtgcagtcagcattggtaatgtcttcagggaaacaaactcagaggcatttcttgagtatgaagttctagcactgttgactacctaaggctgctgtaacaaattgccacaaactgggtggcttcaacaaagagcatttattctctggcagttctggtggctataagtgtgaaattgaggcatgggcagggccttcctctggaaagtctgactgagaacctcttccttgcctatctcatagatgctggtggttgctggatttgaaactgtaccacaaaaacctctgcctcttctatcttttcatttttgttttttttatttttagagatggggtcttgctctgtttcccaggctggaatgcagtggcatgattatagctcattgcagcctcgaactcccaggctcaagggatcctccagacttagcctcccaagtaggtgggattgcaggcatgcaccaccatacctggctaatttaaaaaaaaaaatttgtagagatgggatcttgctgtttccctggttggtcttgaactcctggctttgagtgatcctcccacctcagcttctcaaagtgttggtattacaggcatgaaccaccacacctggccttcttctctgtgtgtatctctgtgtgttctctctccttcttataaggacaccaataactggatttatggcccaatataatccaacatgacatcttcttaactacgtacatgtgcaagaccccatttccaaataacattgcatgtcctaggttgatatgaatttggagggggacattattcacttagtactatggcagaggcaggagtcgaggttgggatggtgggacattgtgcgtaacgttgacatttactttgtcaaatgtccccttgtcttctcaagtggtctgctgttgacttcgtggtcagttctcaaagacagatgcgtttaccaacaagtgctgtgtgtttggcttccagcttaaatagtacccagcactgagagttagaagtggagattctatccccagttctgctacgcatgagtttcacaactttgctttagactttctaaaactcaattaccatggttataatcaagcaatataattgctgtcctgactgtctctcagagttgttaagggactcaagataaagtcatgtttgtgaaggtgcatgataaattgtaaagtgtgtgtcaagtattctgtcgtggaattttttcttctttcttgtggagtatctcctgatctatgggccctttcataattaatcaatcagccaatttctactgagcttctactatgtacagagtacagagccgcatgctgtaaaggacacagaaaaaaatgaaatatggagttcatcaggtagttggagagaaaagtcatacagaaagcaatttaaaaacaatcaagggctaatttgtgtggccctgcctctaatgaagttgatgatcagagaagtgattttttgatggaagctggagtgcttaacaatggcttccccaaggcaaaagctttagaaggctctggaagatttgtaccatgacggggcgcctgttcttggtggagctgcctgctgtgcaaagccttagagggaacaatgaggaaggcctgtgggagacctggttaggcagagacttgcaggggcccttcaaactgactttcattcaatatttatttagaaagcccctttgaaaaattagcaatacatatgttgttttatattcaaaataaggaatcaagtccataacccagttataacattaaaacttgtttggaattggatctcttgtggatagctatagttacacacatttggccaagatagagattatgtttgtggatataattatgaagtactatatgacatatgtttaaaatttccctttattgccttttgttatagcaaattatccccccctgccccactgccccagcccaccctcacctttctttcttccttcttttctcttcttcagcttccttttgttaatttccgaactagcaatttcttgggaggacaattaaaggtttataatgtaggtaacacaaatccttcatttttaggaaaccacatgcagtatcgggttcaggattgtagctgaccatagctgtcaattctacgttggccaagccccaggttggtgataaaatctgctgtagctctgtgcaacttgcaggtgcatggtgcaaaagcacgagagagagagagagagaaagagagagagaccgcgacagagagagagagagcatgacagagagagagagagagagagagagagagactgtgacagagagagagagagagagatctttgcggtcagaatgttgcctcgaccatgaaaaaagtcagctttgccagaagcaagaaccattcagagttagtgagtggaaacttggcttaacaggaattttgttttttctgacttctttcattgcagattttgtactgtttttagttaggtgacccaagatgctgcttagctctcctacccccaatctggttctggtgagggtgctgcgaagcagggctagagcctggggtatgtttggggagggatggagactgggttggccagtaggaggggctcggttcctgagggcaggtgaaagatttgcagaagcaagtgtatgccaacttacagatgtttccaaagggtcaaataaaagaaaaaaatcagcacttaggtaaggactgatcatatatggaagtctattgcaatagggggaatgtcccaaccacttggagaagtaaagcacggctagaaggagctgggtgttggagagtcaagggagtaggtgctgtgagtgagcaactaaacaggaacgtttctctgcatatgtagtcagtcgattatagggaaaggctgttggcagtagtggtgtcttgtctgcattcttgcataagctctcagtgctcgcacaagcataagagtgggacaaagttcagggaccgtgggaaagcagagaagactgaccaaagtttggtcaggctgcgttagtgggcattttgtccagatttgttagtggggacagatagttcagttaattatttatgagctgaagaatgggaattgggagagtttgtgtctggccttgtcaataggtaaataagatgatcatccacacatcttatctatgtcttttggggaaaggttggtctttgcagcaagctctttcctggaacagaaaaggatgggagatttaaaagaaactattcctgttttccagaagcaggagctcatgtttttccaggacttcagctgaagttcaacattgtcatgtgggtggggcgcgaccaagacagtcgacccttgttttagttggcctgtgctgctataacaaaatcccatagcctaggtggcttaaacgtcagaaaggtaattctcacagttctggggagtctgagatcaagttgtcagccgattcagtttctggcgagggttctcatcctgctttgcagatgaacatcttatggcagttcaggtggcatatgggatagcaagagagatcacctctttgtgtctctttttgtgagggtactaatcccattcatgagggctccactcccatgagctagtcatctctcaaaggtaatactatcttatgacctttacatatgatcgcactggggattaggtcttcaatataggaatttagcaaccatagattctagactggcttttccctttttttttttttttttttttgagatggagtctctctctgttgcctaggctggcgtgcagtggcccagcctcggctcactgcaacctccacctcccaggttcaagtgattctcctgcctcagcctcctgagtatctgggattacaggcccgcacctccatgccctgccaatttttgtaattttagtagagacggggtttgatgatgttggtcaggctggtctcgaactcctgacctcatgatctgcccacctcagcctccaaagggctaggattacaggcgtgatccactgcacctggcctagactggcttttctcagataccattccaaagggctgatgtaatacaattatgattgcaatagcgttatgcatgtttcttttctccagtaggtgattagaaagcattactgattctctgtttcattttctttgaatgtctagtgtcctttccgttgttctgtctttaaccagtagagacagttctctctgtggcattagcaagtctgtgtctctgctttgctgcacgcttatgctagggagcactgtcaccatccaactctgaagggtcaaaatcctatttattcccaagatccatttttctttgcttccttctagagaccaccaggtattcagcttttcttcttctttctatttagtatttttttcataataagtaatttttttgtgtgctgttcacacaaatggaaaagaccacagacagaattttaaattagacattgtcatttacagaaaatctatattcagggaaggaatggttaagggtccttaataactaaaatctggtgatgaccgtgccatagttctttaatacgtcaacacaggaattgttgctctgtttattttttgaaagggataatgataacatacatttgaaaagagtcatggtgactaatgaaaaaaccttacagattgtcatttcactgagtctaccaactttctcttacgactgatgtggagtggtgactgtggagggactggcttcatgacaagaagagaaagggaatacaatgaagtcttcctgccatttctgtccttcagttgttcagaggagtattagggttctctagagggacagaactaataggatagatgtatatataaacaggagcttattaaggaatattgactcacacgatcacaaggtgagatccaacaataggccgcctgcaagctgaggaaaaaagaagccagtccaagtcccgagacctcaaaagtagagaagccaacagtgcagccttcagtctgtggtcgaaggtccaggagtcccaaagctgaagaacttggagtctgatgttctagggcaggaaggatccagcatgggagaaagactaggctgggagactcagccagtctagtcttctcattttcttttgtctgcttttattctggccacactggcagccttgattagatggtgcccacccagactgagggtgggtctgcctctcccagtccactgactcaaatgttaacctcctttggcaacacctcacagacacacccaggaacaatactttgcatccttcaatccaatcaagttgacacccaatattaaccatcgcaagaggtaattcattgcccttccaaggatatttgatggatacataaataaagatattattttcctatattttacataaagtatggtacagtatatgtaccattttaccttttcttttttctttttttttttttgagatggggtcttgctctgttgcccagcctggagtgcagtggcacaatcttggcttactgcaacctccgccctccaggttccagtgattctcctgcctcagcctcccaagtagttgggactacaggcacgtgccatcatgcccggctaattttttgtatttttacacatcttggaggtcatttgacatgaggtaaagggtgtttgtgtgcatgcgtgtgtgtatgtgtgtacagtggatgctcattatttgtggattccatatgagcagattcgcctactcattgaactttacttgtaacctcccatcagtactggcacacatttgtagtcattcacagccatgggcagggtagtgaaaagtttgagtcacccaaagtgcatgtttccagctgaggtcaaaccaagtaagactctgccttcctgcttcggcttccatactatgaacaagtgtccttctcacggtctgtttggagccatgcttgttacctttctgtgctttttgttgtcgatttcactgtttaaaatggcctccaaacgcaacactgaagtgctgccctgcgttccaaaacacgagagggctgtaaggtgcctcagggagaaaagacatgcattaaataagcttccttcaggctgagtgacagtgctgagtgacagtgcttcaggctgagtgacattgcttcacggctaatgctggccgtgagctcagtgctaacagatcaccaatgtatatcaaataatgtgtcttttaacagaaacgtacgtaaaatgaggttacatattgatcagttgaaaatgttatagacagaggctcacaggaagctaatcttgtatttaagagcaatggttcagtatttgctaattcagtgttcatagcaactttatagaacagaactaccacaaataataagaatccagtacacacacacacacacacacacacacacacacacacacacacacttacaaacataaacccgaacagatgctgagtatttcattgtaaagatatcccataatttatgtagtcccctacttacggatatttgggtttttcctatcacttgctattacaaagaatgccatgatgaataaatgtgtgtatctctttttcaggtatacaagtgtgtatatatatatatatatatatatatatatataaaagaacatttcctagacatgaaattgctgggtgaaaacatgtgtgcatttataattttgataagtgttgctgtgtttctccatggaagctgtattcgtctacactgcccggggctgccagcacctacagtctcctggagcacctttctccacaagcctggtggcagaatggaacacagactttggacttttctttgtgttttttaagacaaatacacagaacttgatgtttgagagtctgctctgtatgccagaggcatgagaataactttaagcatccagatgctttttatcttcccccactcaaagtacccctggtgggaggagagtgaagcaataatgtttaaggtcccaaggagaggatcaatgtgtatgggttcccttcatttgggtctcttcagggtaatttgcaacttctatagtccagttaggacaggcctgctgttcccacctggaagacctgaagggcaattagaaaatcaatagatgcgatttagtatttatgtgccacactggctcaagtcagaagtcagaaaataaccactggccaaattcagccactgcctgtttttgtgtggtctgtaagctaggaattattttaaaaatttttaatgtttgaaaaaaatcaaaagaagaagggtatatcatggctcataaaaattacatgaaattcaggctgggtgcagtggttcgcacccttaatcccagcattttgggaggccaaggcgggcagattgcttgagtccaggtgtttgagaccagagtggacaacatggagaaaccctgtctctacaaaaaatacaaaaattagccgggcatggtggtgcatgcctgtagtcccagcttcccgggaggctgaggtgggagaattgcttgaacccgggaggcggaggttgcagtgagccgagatcgggccattgcactccagcctgggtgacagagtgggaccctgtctcaaaaaaaattacaggaaattcaaatattaatattcataaatagaaaatcttattggaacacagccacacacatccctttacatgttatccacagctgctttcatgccacaaggggagaattgagtagttgcaacagggatggtatatcccagaaggcctaagatatttactgtgaccctttacagaagatgtttgctgcccattgaaactctaaaggtgcctttcttctcttccttatcagactttcagtttgtggctgttagagtttcacctaagagagaagcatcatttcaaacccccgagtttccatttgcattgttgctatttggctttgtttcttttcagagaaaagtttgaaatttgtgaacatatgatgtggaaacaatgaggacagcttatttctgtttctttcttcttttcttttctctctctttccttcttttctttcttttccttctttcaagatagggtcactctctgttgctcaggctggatggaatgcaatagcataatcatagctcatgatctcaagtgatcctcccacctgagtctccaaattacgcagaccacaggcatgcatcacggcaaccagctaatttttaaatttttaaaaattttttagttgatacaaggtctcactatgttgcccaggctggtctcgaacctctggcctcaaacgattcttcccgtcttggcctctcaaagtgctaggattacaggcaacagtcagcccacctggtcgttttatgccatctgtcctccaagccaaattatggtaacccaaattcctgagtcttctaggacagcccagatttaatatgttctttcttgtcaatacaaatcacctcaccaaactatacccccaggtggaataaaaattttttgttatacaggtacaaatacacaaataataatttaaatgaaaaaaaatagtagaactcgtcattggtggaaacatatggcatattgcttcagctacacatgattttctcggcctgagaccaattctctagcttgggactctgcttctgaaactcatttatactgagatatatatcatagttataacttatgcctagaatctgatacagaggagaggaaagaaggattcattggaaagacagctgtggaaataattgttttccctggtggagatagtgccatgggtctttgatcattggaaagcctggtagccccctcctgtactctaactccactgttttattgttaacatatcattgcatatactctcttgtttgtttgcatgccatttgttaaaccttttttcttttttttttttgagatggagtcttgctctgttgccaggctggagtgcagtggcgtgatctcggcgcactgcagcctctgcctcccgggttcaatcaattctccttcctcagcctcccgagtagctgagactacaggcgtgtgccaccatgcccagctaatttttgtatttttagtagagatggagtttcaccatgttggccaggatggtctctatctctgcccacctcggtctcccaaaacactgggattacaagcgtgagccactgtgcccagcctaaacctatttaatgtgtcaggccctatgctaaatacttgatagaaatttcatgtgaactttataaatatgagtaagaatctttgtcacctctggtgaaaaacatgtggaaggagcttaagtcaagaatcttatccaaagttacacaccttgtaggtgatacagccaagattcaaactcaatactgtttggctctagaacctgaggtctgtattatcctgtgatcttcaatcatttattttttcattcagaaaatattaattgcttgcctaccaagagtcaggcagtgtgctgattgctgggaatttaacagtgaatgaaacagatgcagtttctgtttacagaacttacaaggatagtggtgggggggaatggatgttaatttttaaaaatcgtacaaatatttaaataaagaaacatagtggaaagcttagaataaagaactccacaaggtctttggaatcagagaagggctttcctgaatacgtgatgcttgagctgtgtctggaagttgattagtgattaactaagcacagagatatatgttttgcagtgatggtggggaagagtgtggtgtgataattccaggtagagtaagtaggatgtgcaaaggccctaaggtctgagagaacatggtctttggaaggagtaagaaggaagtcataaaaaagaatgagttcatgttctttgcagggaaatggatgaagctggaaaccatcattctcagcaaactaacacaggaacagaaaaacaaacactgcatgttctcactcgtaattgggagttgaacaatgagaacacatggacacagggaggggaaagtcacacaccacacaccggggcctgttggggggtggggggcaaggggagggagagcattaggacaaatacctaatgcatacagggcttaaaacctagatgacgggttgataggtgcagcaaaccactatggcacatttatacctatgtaacaaacctgcacgttctgcatatgtatcccagaacttaaagtaaaattaaaaaaaaagaagaagacagccagcatgagcacggctggtgtctggagacagaagcaggtagtgatgggagatgcagagtggactcaggtaagaagagctgaggggagctgtcgagtgtcagccttgcaagagtccactgaatcagtgtggctgatggcagaagtgaaaaatgagacattgatagatttggaggatacctgagtaggtaaaaatagatgaatgggataattagtgtaagaccaaaggaggtttccaaatgacttccaggctgagaattggaacgttgctgtcccgtcccgcggtcacagggatgctgatctttaagtccatgactgcagagagtgggaggacctgagaagcagggaggatgtgaggaaaaaccctttctccaggttattccaggttcttcacgtggagcaggagtgaagttgcatgaagatgcagtttgcttccagccaagggggtagtgggcagcctggtagaagggactgggcaaactcttgttctcagagcttcctttaagccaagactttctccttctctgatgacaagaggagtagggggaaggaggagaagtcagggcaagcccagtggcagagggacacagggacacaggctagaggcaccctgcaattgtgctgatgcccaaagccaggagagggggctgggttccagataggtgccaagtgagagggcaccctggtgtcacaaagtagggcagcagaaggttgtctggatggcttcctgggggaatgaggaagtcagcagtgatctgatatgtgcttccagtaggaggactggggttacttaaacagctggtagaactcaggtgtggtcttgggatctcagtctcagtaactcctggagggtccaccctgttcttccttaaatttaaaaggcagagatgggaagacccagagatcacagcgttagactttaggaggacaggggtcttcccttatacatctttgcatcctcagcattttgcacagggggggttgatgttcatattttcataatactgccctattctttttctttgaaacaattataattttaaaaattattttaattaaaacctgtcatttgtatagaaagtcttacagagcaacagaattgcatctggttttcattatacacctatcgaagtcatcctcttcttctgtaaccgccctcttactggctgtctctcttggtcatcgctgccctaagcttgaccttatttcacatcaggcccgttagttcaggggttgatgttatagtttggttatttgccccacccagatctcaggttgaaatgtaattcccagtgtcggaagtgggacctggtgggaggcgatcggatcatggggatggatttcttgtgggtggtttagaatggtttatctaattcatggtttatcatgaggactgcaccatccccttggtgcagtcctcatgagagtgagtgagttcttatgatatctgattgttaagtgtgtggcacctactccccacatctcttgctcccactcctgccatgtgagacacctacttccccttctgccatgattggaagcttcccgaggcctcaccagaagcagatgctggcaccatgcttcctgtaaagcctgtagaaccgtgagccagttaaatctgttttcttataaattacccagtctcaggtatttatttatagcaatgcaagagtggcttaataaagttgatttgcagctagcagaggtcaatgtccttcccagattcaatccatatttcagccataagagagaaggagtgtgttcctcaggaagttcttatctggaagacattatggctgtgcctcaggggtgaaaggattgatcatacatattgcatgaccctttgtcatggaagattatacaccacatcctttagcagtgtctttcctttgacacactaaatgggcccttgaaaatgagcccaaatctatttttgtttagggtagtttgaataaaagaattctggtggcaacagactgcaaaagagagtgattattttatatcacaatcgctctctaacttcagttctgcaaggttaatttccaatgctggtgtttgtttttggggggccccactggggtggccaggaatctccagacatggtctgatggcccacctgggtgtggcagctgggttcttcagtattctctttcctttctgctctgtttctttttttcaggtgtctgattctccagtatatctttcctgaccccatttttcccctgatagatggatttctttggttaacatgctagagtcccacaaaacataagtttatttttctcatgaatctcaactctttcctgaaaatttgtatcattcgcttttaataaaattcctttccttctatgtctgggtccatttgtcttcatctcttgctgggatacagggagggatctgggaggatctcgcctctttgccttcctttgtcctacatagcaccgtgagtcttcactctcatatggctctcataaatcacgcttgctgtcttcctattaggtgaccccctgtgaccattctgcttctctttagtaacctctgggcattccccatgcctaaaatattattcttgcagaacgaagaagtctgtttccttcactacattctggcttgtgactgtttggctttgtttaggttcatgtattaagaatatatatatatattttttctttttgccttagaatcagccaagggttgtgacattaaaatacaagatacatttataacttcatgtgacctggatttggtgcaggtcatgctgagacaatgatgaatgtctcctgatcaacaccagaaaaccttgcagaaaatacatttaaaaataggagtgatgtactgagttctactaatttgcagtaaattgtctttttggacttacgtctggcaaacccctactgtgcacctgccctgtgtcacaggctgcattgggaaatctgcatatattatcttacataattttcagaaaattctatcatgtaagcattgctgtgtgcattttgcaaatgatctaaggaaggggcagagggcagtggaagtagagataagatcaaaagtgaggtcacctaaatctagcaccttttttatcttgtcacctccctgtggccgcctttgatgcattgcatttctttatttttaagaacataactttcactcactcctgcctcaaccatttcatgcataagtgaccttagtagtcccaggttcctgtagaacattttttgtgagagtagctcaaggaattcttcccctcaaagcctgcagtgggtggaacagtgttcacagggtcatcctaactttgttcttttttcccaggtgcctgctgagagttggtggcttgcagacttgttgaaaatctgaggggtcagataatgtgatgccactaattcagcatcatgtaaaagagaggtcataggctttgaaaactcccctggggtcaagttgggcctccagttcctgctagctgaatgacctcagtcaatttccttaatttttattaggtttagtttcttcatctaaaaattttaaagaataaatatgataatctaagcttaaagcaaggagtacaggatgtggtgagagacaggtgctcattaactattacctccttctcctttccagtggaccagatgatcctgaacctctttctgattggatatttgatagtgtattagtctgttctcatgctgctaataaagacatacccaagactgggtaatttataaagggaagaggtttaatggactcacagttctatatggctggggaggcctcacaatcatggtagaagatgaagggcacgtcttacatggtggcagacaagagacagtgagaatcaagtgaaaggggttaccccttataaaagcatcagatctcatgagacttatgcgcttccacaagaacagcactggggaaacagcctccataattattatctcccactgggtccctcccacaatgcatgggaattgtgggagccacagttcaagttgagatttagatggggacacaaccaaaccatatctgatagggagtaagagaaatcaacaaaaaaagactgattagaatgagctagtgggtctgtattccaagatcaagttctgcttagagatgcatttcttaaaaaaaaataaaagccctaagtaattgtcaatgaattagaaaaacagagagaaaatattactgtgttcaataccattcttgttttaaagaagctaaacgaatacaaagagtaaaaaaatatggtgttggcatttgcacattggggctttgcttggaggaacacaacttgtcattacttggctgtgatccagccccaatatttaagtctagccagaagagagttaagatattttgaacagctctagatgacagcacacacagccctgaactgtgtgcatggagcagctggttgtattcccctcctttctgcttatgggtggtgttattcagtcatggcacagtgactttaatagatattaaaaatgcagctatttgagcatgtcattctcaaagccccattgaaatgctctacagcagcatatgtgactgaacatggtacaaggccattacctgcctgcaacaggaaccattccttttgatctgtgactccgtatagcaaaatagttttgtaatcacgtataattcatctattagttttgtctttgtgccaagcatagttaaaagaaaaatcatgtggaaaagattatttttattgtgaattcctgatggaaaaaggcattttccttcaaagttattatctcggttttacagctgacctttaaaagagtgtttatgactttaaatactccagagctcagcaaatattatcctccatataattttagatagtcattatagctttgtctataagcactgagtatgtatcataagacacaatgttggtcgtttaaaatttttgatattttattgtaaaagaaaaaaatcttgtttcattggtacattgagtgatgattgaccttttcttattaaatttcctcttcacatttcatctgtatgtaatcctagaaggtcactggttggcattagcaaccccagaaatgaatggtcatgatgtcacatcctagaattaacaaattagtttgtttggtctctcattatctattatatcccttactgtaatgggggatgaaaaaattcaagatggaattgtggcctgcaatgtcttgaacaccaagaattagggatcttcagtgtgtccctcctcccacctctcttaccatacatactttgcatttttatgtgttgtttttttttctgtatgctttatgacatactcctgggcatgagttttctgctatcatggctgatgatgcaaaaaaaaggggaaagagaaagaagggagggagaaagggaagaaatagagtgctatcgagggaaaagtaaaaccgaatcataaccaaggaatatctgagcctggaagggtttatatggcttttcaatggagtcttgccacctagaaataaaatagaaatctatactcctgtgtgcatttcacttggacttccagaaaggctgggagatcatgggcgagtcatgtaacttccctgcattatttcctcctctgcaataaatgatcaattgttcctttctaattttaatagcatgtgatttaaaagctccttggaaaccaataccatgatttaataaaccaaacggatcagtggattgttgataatttcaagtaattcttttattttatcatgaaatcattatccatttttataaaccattaatccaagtttcgtgcgtattctggcatagcataagtagtgagcacagccgggaagggtccctgccctccattgaaagtggcagctctcataagtgctatggatgaagggtcacggtccctgggagagcacgtggggagagatcaccagcctcggaatgagggaatttttctgcagcagtgattctgagtggcatctgaagggtgcacaggcttttactgggtaagaaggttaaggaagagcattccaggaagagggacagcattatgaaagtttggggagaaacggaaagaaggcaagtgaggctagtgcagaacaaagcaggatgtcgtcatagaaaaggctagcatgaccaatatggtaggagccagaccatgtgcggtttttagggaaggagtgacaatatcatttatcatccaaacatgacacttctaaaagtgaaagggcactattagtagtaaaactgggccgggcatggtggctcatgcctgtaatcccagcactttgggaggccaaggtgggcagaggtcaggagtttgagaccagcctggccagcatggtgaaacctgtctctactaaaaatacaaaaattaactgggtgtggtgatatgcgcttatagtcctaactacttgggaagctgaggcaggagaattgcttgaacccaggaggcagaggttgcagtgagttgagattgcgccattgcactccagcctcggcaagagagcgagactgtcaaaaaaaaaagagaaagaaaggaaagaaagggaaggaaaggaaaggaaaggaaaggaaaggaaaggaaaggaaaggaaaggaagggagaaagaaagaaaagaaagaaagaaaggaaggaagggagggagggagggagggagggagggagggagggagggagggaaggagggaaggagggaaggaaggtgggaagaaagaaagagatgttaaccaggagtggcagttcctctgcggagctcagaggagagatttgggtggaagagttaaatttgtgtgtgagctctgcagttgagaacgtctaccaagaaagcttgaggagagaagaaaagtgagccgggaaacctactggctgcgaagatggtgagaccaccaaggagatctggaagaaacaggcaggtaggaggaaaactaggagtgtgttgtgtcagggaagctaagggatgcttagctgagtactaacaaattagttctagaggatgaaataaaaatcatgtgcattttattactgtatgttcaataacatatatattgagtggaccatttttgtttcctcaagagaggaattgagtgatgagcaatataaaacaccaaatgtccctattttcttaccttcacagtgattttgatgatcttagagataggcgtaggagaaatccatcctctggctggaaatgggggaatattgcctggcagatctggctctgaacattgtcctaagttaaggaatgtgccatctgccgtcctctttcggcacttattctctctcagagccatcgtgcttgaatttctaacaggatcttcaccctatttccagatccttggcttgggaaaggaccttgtaaactcatttatactaaggtgtaaaggattgataagcctaagtctattgttttgctcagagaactacacctgaaacaacaataaaactgtctctgttctggaaaatgcagttttctgagtgtggggaggatgttctgaacctgcctcttttacttgaattacttgcttgtagtttgcttttaaataccttcgaaatagaaccctagggtcacacaattgtagactttggggtgctttcagtctagagtaatcacacctcagaggacttatctttcctttctctccaaacctgcttcctcttttaaatttccttttagaatttgattaataacaccaacttcttcccttcttcccttcacccaggctagaaacgattgaattatatttgacctgctagctcaccacatccggatgctgtgagtcggccctgcctgccactgctggcttcatctttgtcccttcctgtggtttcagagtgagatcacgcttttatcaactcccccttggcttcatgcctctgcctcctgacccttgttccaagtctgttttcttctattcagcctagaaattgtgctaacagaattgcctttcttatgtaaggatctgaacttgggcccatcctctctatacatctttgctggtgcattttctcctaaagcctaaatttctcaaagcacctattgtccttctaagggctgccgaactagagcttgcctgccttacttgttatttttgtttgacattagttgaaaattgcaggatagcaagagaagagaccagctaaaacattttactctttcttcattcctagccgaaggtgggggtctatcattttatgcctctttgtgaagatgcaagtctcaaactacccaaaagaacctaatacctggggtgggtgttgcttaatcattcaatggggaggaactctgtgggttacggctgagcagctccaggaggctgcagtgaggagggtgctggaagtggagtgaaggcttcagcttgatgtattcttttgcttaggacagaaatggtgagcccttgggtaaatattatcacatttcttaatatttatttaagatgcccttatttaagatgctgaagagcagggtgttcctaatattttctagaaatataaaaggaagccagcgtgatgactaagccagctggacacctgcagatgtgtcttgccacctggcctcggctccatctccctaccccatcttcacccctagcaggagcagactggcctttgacttctgctggctagggacacggactccctggattcatctggattaagaatccaagacagtagtcatgatctgtgaagcagtctcttctgcttcccaggaggaagaaacatcttaacaggtagggttggagaatccaaggtcccacggaggggacttgtcataaagaggcccttcacaggcctgtgttatctcattctagtctctatctttctgggctcagtgctgggcattcactgaggtgaaccataatcatgtcaaacctgatactccttgctcctgggagcattcattctagccatattttttcaaagctgttcacccttccagaaatggacatatgctctcctcttcctttttctggagaagcccattcctcactcacggatctgctcaaacagcacctgtaccacgaaggccaccgtgatctgtggctccacagccagaatcagccgctccttctccgtgcccctgtccccattaccaccatgatctgtggctccagaatcggccgctccttccccgtgccccagtccccatgaccaccatgatctgtggcttcacgccggaatcggccgctccctgcccatgccgctatcccaattctgttttgcggtgtatgtgtgtgtcctgtgtacccagggcttccaactctctgtgaggagccaggaccaatgggattctattagtccgctgtggtcctcctgcgtcactcatgcttcaagtccttgtgcgttgtaggcactcagtgagtgtaggatgaataaatgaaggaccgaatgagagaacagcccctgggttttagccagacctctgtcagtgcagaacgtcccttgcgaagctgacatcctggccctggggaagtgtttggtggacaactcaggcaggagaacctccaatccgctgtctggggctcctcccgatttcttgagtccattagagaataatcaggaaggaagctccctgttcagctgtcatcccaggtcactgctctcaggtgttcactgaaacgatgcaatcaaataaatgttttaaagccctaaattcttcctgagtagggaaagacctcaattattcaaaggcttctttcagagaggtcagcctttggccaacacagaaaataaataaatgtatttattttcttttctgattacaaaatgatgtacaatgattgtttcttaatattgtagctgggattataggtgcctgccaccatgcctggataatttttgtatttttttttttagtagagatggggtttcaccatgttggccaggctggtcttgaactcctgacctcaggtgacccacttgcctcagcctcccaaagtgctaggattacaggcattagccaccgtgctgggacaatgtcttttttaagctttcacaaccttttccaaattttccattgttatttctccttaattattgacttctacattttattctttgtgctttttccccagtttgtgaaattgtcttctaactttgagacggctgtttgtgtgtgtgtgtgtgtgtgtgtgtgtgtgtgtgtgtgtgtgtgcatgcgtgcacatttatcaaaggttgttgctgttcacatgaatttttgctaaaggagataacacccactgaaatagattcttcaagaatgtatgaagtagattagagggaggaaatgaaaattggagggaggcacctttgaatttgaggtccctataaaatcagtttgtacatttctgctgcagcatctcagtccttcaacactggcccccaattattgttttttaaatattgtttatttattttagttgaaaattaaaatccctctcctaagacacatcactgttaacagtgggatatagattgatcctttcagatttctttacttttatatatctgcaaatatatatatatatttatacacatatatttatatacaagtgatatatatttatatatataaaccacacatagaaactatatttccatattatatatatatggttttttaggcagaattggggttacattatcagtaatattctgtattctacttttttttcgagacagggtctcactctgtcacccaggctggagtgcggtggtatgatcacggctcactgcaacctctacctcctgagatcccaccttagcctcttgagtagctggggactacagtcaggtgcaaccacacccagcttggttttttgttttttgtttttttttgtatttttagtagagacagagttttgccatgttgtccaggctggtctcaaactcctggcctcaagtgatctgcccgcctcagcctctcaaagtattgggattacaggcgtaagccatcatacctgggtattctactttttatatactaaaatagtttagtcagatttctatttcaatacatatgttttatttttaatgctttcttgtttggtgttatattgatggatattttctaatatatttaaccaatctcttacaattgaaaatttatgttgtttccaacttttcgctattatttttgtccactggtacaggaacttacctagagacagtccgacacttgtcattgccacaattcaatgcaatgcacatttcacagcctttgagctgtgtagccaggctgcccttgctgccctgcagaaagatgggagtcattgatattcccagcaccgatatatgaaagtctccactttacctcatcttcacaaatgatattgttaatataataatactggatattaccaatctttttaatctttataaatttgataggcaaaaatgcaatttctttcattaatacagatttaatcactagcaagatcatcgtttcctacgtttatgtctttttttttttttttgagacagacttccgctctttcgtccagactggagtgaagtagcgcaatttaggctcactgcaacctctgccccctaggttcaagcgattctcctacctcagcctccccagtagcttggattataggtgcatgccaccacgcctggctaatctttgtatttttttagtagagatggagtttcgccatgttagcagggctagtcttggactcctgacctcaggtgatccaccctcctcggcctcccaaagtgctaggattacagacatgagccaccatgcccggccaatgtcttttttaaaccttcacaaccttttccaaattttccattgttatttctctttaattattgacttttacattttattctttgtgtttatttccaagtttgtgaaattgtcttctaactttgagatagctgtgtgtgcgtgtgtgtgtgtgtgtgtgtgtgtgtgtgcgcatttatcaaaggttagtgctgttcaaatgaatttttgctaaaggaggtaacacccactgaaatagattcttcaagaatgtataaagtagattagagggaggaaatgaaaattggagggaacacctttgaatttgaggttcctataaaatcagttcacacatttctgctgcagcatctcagtccttcaacaccagcccccagttcgttcgttttatgtgtaaggagttagagcacacagatttttcacaaggctccataaactgctgtgtgcacagtcctagaggtctgtgaacttagatgggaaaaattgcatctttatatgcaccaatctcttgaaagttagtatttctttcaattataaatgtgagtaacaactaacagtaatgctagcagtttctgacaccaataaaaaccgatattttaaaatcacattactgttgttgaagatatcttaaaatatcactactatgaattgaaactagattttgttattttataaagaagcatattgttattgtatcttttatcacacaagcattacatattttgatggttgcatttcaatagatcgtgaccctgtgcgttttgctttatgcatttaaaaatgttattttgtgcaaatcaaaaccacaatgagataccatctcatgtcagttagaatggcaatcattaaaaaggcaggaagcaacagatgctggagaagatttggagaaataggaacacttttgtatgttggtgggagtgtaaattagttcaaccattgtggaagacagtgtggcaattcctcaagaaataccagaaataccatttgacccagcaatgccattactgggtgtatacccaaaggattataaatcattctactctaaagacacatgcacatgaatgtttattgcagcactatttacaatagcaaagacttggaaccaacccaaacgcccatcaatggtagactggataaagaaaatgtggcaacatatacaccatggaatactaaacagccataaaaagaatgagttcatgtcttttcagggacatggatgaagctggaaaccatcattgtcagcaaactaacacaggaacagacaaccaaacaccgcatgttctcactcataagtgggagctgaataatgagaacatgtggacacagggagggaatatcatacaccggggcctgtcggcgggtgggaggcaaagggagggagagcattaggacaaacacctaatgcatgctgggcttaaaacctacacgaagggttgatgggtgcagcagaacaccacggcacaggtatacctatgtaacaaacctgcacgttctgcacatgtatcccagaacttaaagtaaaacaaacaaacaaacaaaaaccctgataggtaaagagtttaagtgggcacatagtgagtaagtagcttatgtcagctcttttcttcctgtgtcagttgtactgctggaactcaaatagatcactgtattaccttttacaatcccaaattaaagaatttccagaatcaagcttgtcatctactatcagtgtcttacacactttaatattctcttctctcaggagggggagatttcaaaagaaatatgttattttgaaaaggggtctttaggcttcaacaggctgctaagggcatccaaggcacccacaggttaagaatccctgagctggaaacagcgttaaagttacgagaagggtctaatttgctccttgatgagaagctaaggtttcttctgttgccgtgactccttttgggtattcttttgcccatgtgactgagttaagagcttttcggaggctcctggaagcttctcaaatgctgtatcaaatgtattaacatccacccacgttccacattaaatgcattttcattataaaaacttgaaaaaattatttaattttgttttttaaatccttggttttgagaaactaatttaatttacaactgaatgcaatttcttgacaaccagtgtgcttactcaggggttctagtaaagagggaaaatctaacatacaaattgttttctaaatgtaatgaaacttttatgagcactaaatttcacgattaatgaagttgacacacgatacgttttgtgtacatttaattaaacatttagcaatagcaatttttgtgattttcttttcatattttggagccatttttttaaagtctgttttataggtcctggaaagcacctagacgcttgtgccagtgtctaacagattaaatgttgacaggggccacagccttttatactcaaccttttcacagagcacatcctccacctcctctcagtaactgaacacttggttacctctcttcgcgcaaggactttcctgccgccatctgtaggagtggaggctattggctgccccttgctggggggacaacaggcagtgttagcacattcctacttcttccttgctgcttgcatgcttttactcagtgcaaaaccatcccctgtactttaagattcattttatccacagatatcatcctgatagttctccttttgctgtaagctgttttagcctttatgctctttgatccctgagttaatagccttcctgctgtccagccaccgccttgcacaactttcacctcccatggggacaaggtatcctgccttctaacctcagagctctgtggcagggtctgaactttgttcaaggcgtgtctccagcttcccaaacaaagcagagtcattttctcaagaaatgtttgtttcttaataatgcatgaattctctttgtctccactgcaatccaactccccagttcgactcttattcctttgttaacacctggtacctcttctgtattaaaatgcaatatataaacttctagtcagaacctcctactcgtctaattctccaactcctgattcttgggactcattctttacctcatccatatcccccgtcccttcctgcttttctttccaacccatccaatactgacttctttgcttctcttttcgcagctctcccttagaccagtcttttgccagcatcctcaatatcttagctgtaataagaacaatggcagtcatattaatcactaacatgaccaagtgcctgcagtggaccagactctaggctcagtgcttcccatgcattgcttcatggaactctttgatgtaggtactattatcctcttcattaaaaaaaaaaaataagcaaaggataagacagattaaataacttgcctcatatgatttgaaaattcagacctgatattttatgcgattttccgctatatgtatacataatcagacttcctctcaactccacttcctctccttgagcaagtttacgcaggcttctcatctcatttacgtcccgctcacatggctacgggcacctctgaaacattggccaaggttactgatgacttgctaatgaccgtgccagtaggcctttttagttcttttctcacctgctcttgagcatatgataccaacaattattcaagtattatttaaaacaacactttatttttttcctcttggattcagtgacttttcttcctcctccttttccttctatttctgaccacttcattctctgtggctggcttgccttccattgctcttctttcaaattctgacccacccagagatctcatccttgcctcccatccctcttctccttaaatcgggggtgtccaatcttttggtttccttgggtcacattggaagaagaagagttgtcttggaccacacataaactacagtaacactaatgatagctgacgagctaaaaaaaaaaatcgcaaaaaaaatctcataatgttttaagaaagtttacaaatttgtgttgggccacattcaaagctgtcctgagccatgggttggacaagcctgctctaaatgtgctctctgtgttgttttatttgctgcagtggcttcaatcaccacccagcctgttgaccttcagacctcctgcttacttctggacctctgtgcccaaatgctttatagatctttccatctggaagttgcttaggcactgcttatgtccagtcagagctacctctattccctgtatttccaatcttggtcaatgaagcctgcccagtcagctaggctggagtctatctcacttttacccctattttcagtccatgagtacctcgtctctgttgttagctgcttagcccctcatctctttcttccacccgtccctcactggttttcacatcctgctttgcttcactcctgcccatcctcacagactgccagaggactgttctcaattgcaaaacccattacttcacgagccttcctctgctcatactattacctccaatcactccttattcttgtggactgcctcccttaactccttttgttatgtatttgtgcaatgcttccaagaattttggtgactggtttttctgctttctttagttgggctctgtgtgccttctgggcagccatgatgcctcttcattttgtacctccaagtgcttatatggtacttttcttatagtgggtgttctgtaaatattcactgaatgaatgagaatcatgagatgccacttgagactgtgagctagaccttactgctgaaagatgtaaaaatagcattccaggaaagcaagagttctgggtaatatctgccattgcctgactgacatttgttccttgatattggtataatgtggccaacagggtccctcctccacctcctgtacattttcctggtgagctgtttgcagcagtcaggaaaggttagaggagttgtcatcatttttaccagcttgatgtgtttgcctggactcagtccttctccatgttcctgaggctattgtggttgaaagattcctaggagataaggtgaggttggtcagagtcttcctgatccccactgatgggctgtaggtctgaatagcattggttgactttatacagtgtttctcccgctctgcactgtggcattactgcatctactgagacatttacttgtcttatctgcattcctaaataatccatcttggattcttagcttctaagaagactgaatttgaaagatctaatttccagcttcatctcagctaccaatttactgtgtgccctgggacaagtcactcccactccccgtgcctctttctttctctggaaaaggaagatgcttcccgagcgcccatccagacatgctgttctgggactctgagtgttgtgatgggtcctgcggttaaacgtccatatgtctttgtttacagtgtcttaatagtgagacactgaactcactgctttacagagactattgaatacactgaacaccatgcttagcaaattgtgattgccagctataggaatgtcccttctgagaggagagttgaaaaagtggctataacacaaaacctgtttcctcaagctttatgatgggttaaattcctgaaaccagctctcaaatattttttagatccagtttctaactcatatcctttattttagtaatgcttttaaaaaaatctggcactgtctgaaaatggactattctaagtaagtatgtttttcagataactgactatgactctatgagcacaaaaactgaatagtgctctttttataaggatggaaatccttacaaaacgtatagaacattgtcttgtcctataaagagaaaatattgagtataatataatttaaatttcctatgtgactaaagtcatgtcttttattcctttattcaacaaatacttattaaactccaaatatatgctaagcactgtgcttaagtaatgggtatctcatgtcttactttgcagatgtattaccaccaaagattcctccttattgcttcatttatacaagttgactgttttgattttatatattaaatttggagttctgagcaatgataaggcagagtttctgcctagagcatcagatttggtgggcaattcaaactgtcacatgctcagtcagtaaaaagctgagtcagctgtgtctcacaccagccattttagtcatctagacataggcgttcccacaacaaagagtctgaaatagcaaacagcaaactcaacaggctctgtaatctttaggtcccagtagattctaattttattttatttcaagcaagagggcattattgcaaaatatttaatttctgtattaatgtctttagagatttttttaaattttggacaattccaatcatataattttttctttaggagattttcaagattggcctccagtaaccttgaaaacagccttaagtcatattatgggatggtggtgttctggaatagttgctgttaaatgtaaggtgactcctactttccctttgacattcattttaaacctggagatggtttctacagagagttgggagaacagactggggaatgttttctaatgagagacgggtgattaccagagtcttccagaatgttagagcatgccgacaggctacttctactctctctctctccgctcggttgtacttttccatctccagaatctttcacctagggcacagggcagtctcttcacaaggaaatcgtctaaatttacacccaaatcttccagactttgttttcttttattttgtaaagtctcacgaagtcaattgtggttcacacgcaggtgccgatgatacattacatatttcacacactgcatcttaaaactggggcttgtaactcctcttaagtgccatttaataatgtgccagggtgttttttattgttgcagtggggtgttacaggtacttagcaggagaggccagccatgccaaatgtcctgaaatttggagagcaatatttcgtaagtaagactagtcccatctaaaatgccaaacgtgtgcctattgagaaataactgccatgtccagcgcattccttgtagcttgctatcctcattctgttaagcattgttcatctttcctacttgcaaccactaatggttaaaatcctgctatctttgagtcttacctaggaactaccttccttgtggaactctccttgaatttcttgctggaaatagtgtctccaccattttagtgtacatagtatcttgtttttacagatcacttctggatgtagctaattattaatatctacctccaaggtgtcagcaccttcagggcaaggatgtgtcttactcagagtattcctggaataccatggggattcatggcaaggctcaggaaacatttgttgaatgaatgaacgagagttgttgagtaatagaaaactcttcattcctgctaatttagacctgttctaaggctgcctttcacaaccagtatttcttaaactggatcccacctataatagttatctgaaatccctgcatatgtcattcttaatgaaatctgaaagcagtgcctaaggctccaccaagaacagcgattctcgttggcctgtccctgaaattgtcttgacacaacttgtaataggctatgactgctcaacaaatccaaaagcttctgcatttcagcaacttgttaacaggcccccaaacaactctagttaattctgtagaatacacaagattcactttgaagtatataataatattaacacaagtcctgtgagttaacattgtgactaggcatgcattgcaaattagatgcagttaccctctctctgactttttaaaatgtagaacataatagagtttcaaggcattttaagcttggaaatgaaatataccagatttttgatttttgcaaagacaatgacaaacttaatgaaagaccaagaatgggtctgttctagtcactgaaccccctgcgataattgtctgcttgcaaagatgaattcagggctcttaaaaaaggatgtcagctccctttaactgtgctcagatttttaagttaaaagtatggaggtcagccaaacatgttgggttttgcttgtaagcccagctactcaggaggcaggattgcttgaggccaggatttcaagaccagcctgggcaacatagcaagacctctaagataatgaaaattaaaaattagcttggtgtggtggcctgtgcctgtcaacccagctacttggcagggtgaggtgagagggtcgcttgagcccaggagttcgaagatgcagtaagctatgatcatgccactgcattccagcctgagcaacagtgctaaacccccaactcaaaaaaaaaaaaaaaaaaaaaaaaaaaaggaggtcttgctcagcccaggtctgccagatgtccctggttcccagtgtctgcctttttcttcttcccacagttgaggccactggggcatccaggcctcagggcctttttgggaagagatgatgaaggcctaccccataacgttggacaccagtatcagtcatgcttgctccaaggcttatcctgccctcatggacctgtggatattttggatagctatagactgtccttcctcctctgcccctgtggcatcttggtaatttagctgccactctggagcaggtgcctgttcctaccagggagaagagtcctggatatgaatccagcccaatggcttgggccctgctcactgctgcccaactgtacagatgccagatgcctcttttctacttgggttcctaaggctgcaggccctggcacctcattgtgctggctccagctctgtctggtgccaagtgtgtgcctaggctgacatctctttcttgctggagctgactgcctgccagtacctgctgcagggtctgaccttcccgttgtaggcactcttctaaggtccctttgtctttttttctttttttcccaatttttaaaaattggggtaaaacatgtatacataaaatttaccgtcttaggcattttaagcatacagttcattggtattaaatacattcacagtgttgtgcaaacatcatcactgtctgtctctagaactctctccatctgataaaaatgaaactctatacccattaaacaatacctccctgattcccctcctcccagcccctggcaatcaccattctacttcctgtctctgactcccgtaggtacctcatgtaagtggaatcgcacagtatttgccttttcatgagtgacttgtttcacttagcataatgtccacaagtttcatccatgtttcagcatttgtcagaaattccttctttttaaaggctagatactattccattatatgtatacatcacattttgtttatccaatcatccatccatggacactgaattgcttccacctgttagctgttgtgagtcaagctgctgtgaacgtgtgtgtgcgaatatctctaattcttatttcgactttattcataaatcattttcttgactttttccgtgtcttccctgtagtctttgatcagctttacgacagctgttttcaagtgtttgtctcatagatttgccatcaggtgctcttcaggggcagtttctgctgatttactgatttactgtttttcctttgaatggaatgtacttctctgtttctttgtatgtcttgtgacttttttcctttttgttgataatttgagtctaataaggtagtaactctggaaatgattcttcttcttcccttaggtttgctgtttcttgttattgtttttgtctgtttctctctctctctgtctgatcattgtaggctgtctctgtgccaaggatcaacctgaagtatgaatttaaagtcttctcaggtcttttctgagcctgtgccttttactgggcatgtgcagtcattttctaattcccccctcccccgcccatatgcagttactttggaatgttccagtctttcctggctggctcccaaaaaagaaaaatacaggggaagggaatgggtaccagtcctataaatcccctggaacgccctccaaccaggggaagtggggcttgcaacaaatggggaggtgcaacaatagtgtccccccagctctttgcacctctgtgatcagaagcagtgatcagtgattagggtgcagatccttgatatttgaaggccagggttctttttgcccaccctggctcctgcaaatctgtgtaggttgctccaggaacccatacacagtatcctgctatggggctgtggctgggagatgagtagctgctactgtgcaaggagctgaaattgactgaaattcactgcagtttactgttcaagccttctcttggaagttgcaagccttcaatggactccagagttccaaaacagttacattagatagagtccataagtgtgactgctttcttgatggggaaacagattccaggaatttcctactcccatgatcttcccagaatcctttcttgggctctttttctttgagccagatttgtttgcccttctttgaggggagttgtttccctggggtttccttagagccttctgaaatccccaccaggctatgtcaatcccactcagacacacacttagatctgaatcctttggggcaacatgggttgggaacaccttaagaacctgcatacacagaacatagaatgagtacaaattaagtattttagaggaataaagtattgtgaatgtgttagattgggcaaataaaaaaggatcatcataggatggcacattcatgcacatttataaataacatttctatttttgtatgttggaatcccaacagacatgctcatatttccaaatgagggatagatttaaatcaattcatcttcaatcacagttttcctgttatgtatttttatcatgttctcatatatgtgaaatcattagtaaaagtaaagcaaagaatgctggtctctttcatctttcagcattattgaagcaggaaagatgactgttttcacaatgtgtttttagggtgccaacatttaaagggactgggaaaaattttactgtaaaaatactcatgaattcatgactatgggcttccattcatggataattgtgataaatgtttcatttacatttctattattatggattatctgttttctttttagtttagattaaaacataatgtactcacatatgaaattcaagtgaagccttctgtgaatcacaggtctgcagattttaaacataattatggttactcaaatatattgtttatgcctgatcaaccatgttttaatcaatgccaaataattttgtttttttaaatactgaggcttcaagaaagaaatatatgctcaagcgggcctgtaatcccagcactttgggaggccaaggcaggcggatcacaaggtcaagagattgagaccatccttgccaacgtggtgaaactccatctctcctcaaaatacaaagattagctgggtgtggtggcacgtgcctgtagtctcagttactcaggaggctgaggcaggagaatcatttacttgaacccgggaggtggaggttgtagtgggccaagattgtgccactgcactccagcctggtgacagagcgagactccttctcaaaaaaaaaaaaaaaagaaagaaagaaagaagtatacaaagaaagcactaatatgcattaactaaaaattatttgttgctttggatattggttgattatttagtatctacttagaacatgtgtataactacttgaaatatgatgttgctttgctgtttaacatggttaacagtaaaatgtgtaaatgaataataatgctttagactggatttcaaaatgtactatatatgtagcatgaatacccccacagttttacttagctcttctagcttaaaggtcagcacaatacacagacctcccatttggatacttgatatgacagagataattaactgtcctccaaaagatttgtaccgtacctcctagagtacagaattgttgctgacaagtgtcttccctactaaagacatcatgtcctagccctccttacaattagatgggtcatgatactagttcttaccagtggaatgtgaacagaagtgaaatgcatcgcttttaggtcaaactgtttaaaaagaaaatgtaaaacggttgaacaaagaaacaaattcatgatgtattcatgcattagaatactgttcctcaatgggaaggaaagaactactgattctggcaaaacatggataagtttcaaaacattgtgtgctagaagccaaacacaaaagagaccatactgtataattcgattcgtatgaagtccagtaatagacaaaactagtctatggtgagaaaaatcaggaagtggttgcctgcggggaatggcgggttgactacacatgagcactagacaacattctaggtagaaaaaaaaatggttggcgtcttgttctgaatggttattacacaggtgtaacagttgtcaaaactcattgaactcagcacttaagatccaagcatttgtgtgtgcatgtgtaaattacattttaatgaaaccagatgtgccttcctgactctctctttccccatcctccaactcagtggttctcaaccagaggcaattttgtctcccaggagacatttggcagcagtaggaggcatttttgattgttgtgcttctggtgtttagttagtagtggtcagtgatgcttctcagcatcctacaatggcacacaatggccctccacaacaaagcatcacatgttctgaaataccagtgatgctcaggttgggaaactgctatagctgaatgcagtatggacccacaagatggaaacatttttgccaccagcacaggatgttacatgaacaagaaaaaaatttatactgtgttaaggtacggaagtattagagtttgtttgtttcagtggttagcatcactttaactaatataccagactttaaatccttgatgctaagaataatatttatgaggaaatgtgagtgaaatttatcttaagttttaatatcaagcaaagctatgcttcctctaaaccattattgtaattttatcttaaggacattgtcagttttataatttcgtgtgtttcccttcttgtttcaaatcacagagagtaattcttaggcagctcttaactctccaggaacatatgatttgcgtttctgcatgctccccttgtctttaatatttttctatctttatttcctagcactaatcccataactacctatttttgcttttggtatttcattattttttaaaggctagctcatattctttgcataaaaattcagcttataaaaaataaataaaatgttattcaaatacttaacattcctttattttaggttttgaattaataatggtttttgtatctcagaccttgaagggatttttatcttgtcttaacctcttaagatcgagagagataaaatgttcatagtgatagttcataaaattatttcatgtctaaaatagaaggtgttctctactgtatataaaagttctatactttatacatggattataacttgttcatctctaattggacacaccttttgaattattcttctgataaggaaatgggattcatgccactctgtagtagacattcttggctgcctactcaatatccaccctcttctcctttttccttctggcagatctccaattttgttcaagtatccactcatttcagctaatctataagcttcacgggagaaatacatccacttagcaccacgggtggcatcgtggttggattaagctgtggcctttgcctccttgtcagtcattggtttaatccatggatcggtggtgctattctggctactgaaatgcagaagccaactgaggtggggagtggaagttccaggaatgattttcctcaaccttagaaatagacacgagggaatatgattgttctgttgcttgtggacactgttgtatctgcctgagatgacgagaactctggcagccatcacaggactatatggagagttaggcagaagcacaaaccaggcaggccaaagatagcagccaaagagataaaaaagaacctgagtgtttattagacctccaaaccactaactaaaaggactccagagctaaattccctctccctttgttgtatgagaaaataatttcctcaagccagttggtttagggttttcttgtacttgtacttgaaagtatccttccgaaatatcttcttgtacctctccgatgacttagggtggttttaacatttacaatgttcctgtgtgtggccagtatgaaatccaggcttatgaactagaggatgtgagacctttaccttagtcaaactatgctctaagaagcggaacgcattagcccaagcccccaagagagttggcaaagttcttctgtgaagagccagaaagtaagtattttagactctgccggccatattgtttctgttgccactcctcaactctgctgttatagtacaaaagcagccactgagactacataagtgagtgagcatggctgtgtgccaataaaactattttcacaaaaagcaggcagtgggctaggtttgtgttgtgggtttgctgactatggtttgggttgtgtggtttgctgacttctgacctaaattacattcagtccaactatagctaatctaggttgatggggacacggaacagctatgagattacttacctggctccactttccctcctttttcttgcattatctgccctctggtagaataaccattttgcagtaaggcggcagaaaggccaaaagtcaggagagagaaaattgagaacaagagatttacatcatagacattctacttaatcagttactgaataaccaatgtttggctacactcctctgaaactatttgtctagaaaagcccacgatcttgatgccaccaaatgaatgagaaaaatgcatttgaaccaggtttactctgatctgtctgttttaacacaaaatatctttgaccaaataaaaggcaacatgttccgacttcagagtttgcataaaggcaggtgcatctgggcagtctgtgcaaggatgctgttctaattagggaaatggaaaagtctttaattctgaaagtgccagcctgtcatatttagccagcatactctgagatctaataaacctctgtcaaaaacaacaaggggtaatggaaatcaggtatgattgatttaggaaaatgccagtgatgagtatctgttgagaaataagtaagataggaaaagcagaatggaaattggagcatcctggcttagctggtccgatgataaaaattatgcaaatgtgcacagcacatctttagaatactattatcagttttacaaagcccatctcttacttctcattcccctgtttctttaaatgcaatgctgtctctgaaagtaggctgacatgaaatcatgattgttttttctttttttcttttttttgaggcagagtctcactctgacaccaggctggagtgcagtggcacgatcttggctcattgcaacctctgccccccaggttcaagcgattctcctgcctcagcctcctggaaatcatgactttaaaggagatatttagtgtacataagccccagagtgaaagcatcccagcgaatcacttgattcctctgtgacagctgcagaggatccgcaaagcacatgcatcttagactaagcattttgttttcaagcaacattgggctttgaagcccattccaaacagaagtatacatgcttcacatgaatacatgccatctcgagacatttttatccaggactttagtggactctgattaatactaatacatacaaaaatgaaaatagaacaaaagatatcccccctgaggaaggcccctcaggaaagacgttacattagctttgtttctaattaggtcctttctgccttttggggaatggaggagacctgaatccctctaactctttcatccagtcactccccacagcctgactgccactttacaattaattgaaaaacctatgcttttaagttgatgccagatgacttagcaggaataaacacacttacaggtgtctcaggaagcacaactctaatgcctaggaatttttgatgacttccctcctgatggcacttcccgcagtttgcaactaagtaggcaggcgttccatagcaaagtggtttacttgcaagtcatgtagtgatggaaaaggagtcataattttagcactattaatggaaaatatagacaggttaaacaagaagtataatgctgagttccaatccttcagttagtaaaaatattctgcagtgagtgtggggagctaaaggtatcatcccagctaggtctggaaccttcttttggcctggatcctgcctccctatccacttcatctcctgctctgcatttctttcccttttccagatgatgccatctcctttctcatctccacatctcacataggcttggccaagtcctatgcatccttcaagactcagttcaaatgcttcttcctctgtgaaggccccagtgctcttagggaaagttattgtctcttctgtgcttccccttgtctactgtagatcccatcacagtgcattgaggttgactgacccagtgatgtgtcattctccttctttcactgcaaacttctgaagattggaattattcatcattgtctcctcaatgcctggcatatagtagatgatcaatacatatctgtaagtatgagtcagaccactgaaaagctagatgtcatcttcagacattgtccaatgatgtacttatttataaaacaggttgaaacaaagtcaaacgttctttgcaaggctgtcagaacacactactgaaccgaaagccaataagctccaaatctgacagcttagagaatgatttcacatctggacttcctatgtgactttggtccaccatagagaccacatctggcttttccaatggtgttgccatccctttttccccatccaattttggattttattaccaagtaaagtcccagaatgaggtctacctaccccttttcttgtggttcttatcccagggctgctttgctggacagagaactgaaaacaatgagaacactggggaacgtcttttgtgcagagaaatctaagtgcagtgggaagaacaagcccaaaggacaagaaaagaaaaaaaaaacctcacataaactaagcagagttgcttatctggatctttggggaagagccttggctgggagcaagtgaagggatgtgtaccaggaagacttggggaagcaattttgcacatagggactcaggagggtggaaccagggtgcattttcacatgtggcattttcaggaagtggcagctctctgctggctctcactacccacacaggggcaggggacacagtccccctctccaccagcagcacctttctccaagacaaagggcaaaaatctatcccctggccctcctcattagtcaccaaaggacaaatgtattgtgttccaatggttgatttataaatatgttacctagagtatgaaacagttttaccccacaggaataatataaaatctggttagattcctaaatctggttagattccaccaatcctcattaatttagaattaatttagagaattaaacttttggctttcttttaatttaattaatacccaatctttttttttttttttttttttttgagatggaatcttgctgtgtcacccaggctggagtgcagtggtgcaatctcagctcactgcaacctctgtttctggggtttaagcgattctcctgcctcagcttccccagcagctgggattacaggtgcctgccaccatgccgagctaatttttgtatttttggtagagacggggtttcaccatgtaggccaggctggtgtcaaactcctgacctcaggtgatctgcccaccttggcctcccaaagtgttgggattacaggcgtgagccaccgtgcccagtcctacccaatctttagagcatgatttctattagaaggtatattttgggctctaaatgtagatactcattctcctatccctttcttccctgcctgaggagatttctaggtccttggtattcataggcaatgctctgggggttacagttctaagcactggttagtttctcacttttaaaacaagtgacacctctgttgctgcattgagaagacattttcacatccctgtcttctccccaagtgaagatgcaattccagttacaatggggtgggaagaaatggcatggtcccagtgggtaggggcctcacatgctttggaaaaccttttcttgtacatgagccattcttgtgttgagaatttgtatgttggtgatgttgaggactaacttctgagtatgcatgtggacgctcacaggtggagatgtatgtgagcacttatcacccggtgtctgattccacctctgtctccttctcccggtagagtcaaaccattctggaggtgcttcgtgcagcctgctacaatccccgcaggttcctcctcctgactgtgagcagggagggtgtttgttggtggtgtatgtgcagctttttcctttgggatttcattagatagttttatttttatgcatcaaagaaaaaagagcaggaatattaggctttttgagagtaatgtgaatgtgactttatcatatttgatggcaatttacttaaggacacacttagggctctttgtaaagaaatgcagagagtctacaaaaaaatcattacaagcataataaagctggggaagtggctttaagatgtgtgtgatccaattgtatacagtacttatctggttataaatacaaattccctccctactaagatgcttctggctaatagctctaaattacagtcgcatggcctggctttaagacaaagctatataaggtgtaggaaacctccaccctcagtgtcaccttaaagcttaaaaatagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggcaatgcctaggttttcttctagggtttttatggttttaggtctaacatttaaatctttaatctatcttgaattgatttttgtataaggtgtaaggaagggatccagtttcagcttcctacatatggctagccagttttcccagcacaatttattaaatagggaatcctttccccattgcttgtttttctcaggtttgtcaaagatcagatagttgtatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagggaaatgcaaatcaaaaccactatgagataccatctcacaccagttagaatggcgatcattaaaaagtcaggaaacaacaggtgctggagaggatgtggagaaataggaacacttttacactgttggtgggactgtaaactagttcaaccattgtggaaatcagtgtggcgattcctcaggcatctagaactagaaataccatttgacccagccatcccattactgggtatatacccaaatgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactccatattctcactcataggtgggaattgaacaatgagatcacatggacacaggaaggggaatatcacactctagggactgtggtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaacaaacaaacaaacaaaacacaaataaacaaacaaacaaaaaatagctttctcatgacattgactactctgcctctgagcctctatttcccccccttccctccctcccaccttactcagattgtgctaaaaggaaacagggcttctaaaagagtctatcgggctgggcatggtggctcatgcctgtaatcccagcattttgggaggctgaggtgggcggattacttgaggtcaggagttcaagaccagcctggctaacatggtgaaacccagtctctagagaaatacaaaaattagctgatcatggtgtgggtacctgtaatcttagctacttgggaggctgaggcaggagaattgcttgaatccagaaggcagaggttgcagtgagccaaaatcatgccactgcactccagcctgggtgacagagcaagactccatctcaaaaaaaaaaaaaaaaaaaaaagattctacccaggcatgctgatattttatctggcctgtgatctagctgggcattgatgccacacttcctgtctgccttgtcctgtaagtcagatggatgattacagcaaggaggaggggataatgcaagtccttctgaccacagactaatacctgcattcatccagagccacaataaagagtcctagaaaaccaagtgtagattttattaagttgggaacacctactctgaatggtctgctaacaccctttacattcatactcaataatagtgctggttaataagatcaatagtgacaacaatcacctgaatggaattgcttttatttagatcatgaatcatgaccatgttgatgttttcaaacaaatttctgagactaaataacatgccccaaaagttgataagaatgttcagctgcagacattcattattactttgcaattagggagaggcaagtccattgttgacctaggttcatgggaggcagagaagtagatggtcactgggtcctactgcagagggcatggtggaattgtctacagatcttaacatccagacaggactcaccttggagaagcatgggctgctgaggagtgtggggtctgtgccctttgcctccagggagagcaagcacattaaaaggctttgaatgggctgggcatggtggctcatgcctgtaatcccagcactttgggaggctgagggggggcagatcacctgagatcaggagttcaagaccagcctgtccaacatggcaaaacctcatctctactaaaaaatacaaaaattagcagggtgtggtggtggacacctgtagtccctgctactctgtagcctgaggcacgagaatcacttgaacccaggaggcggaggttgcagtgagttgagattgcaccactgcactccagcctgggtgactccgtctcaaaaaaaacaaaaaacaaaaaacaaaaaaagggccttgagtgccttctccacgaactcgctgcctgtcagtcactgttgctgaatatttctccctgctttctctaatttaccttcattaaagtattttatttatttatttattcatttatttatttatgttttgagacagaatcttgcgtgacacccaggttggatggcacgatctcagctcactgcaacctccgaccccaaggttcaagcaattatcttgcctcagcccccaagtagctgggactacaggcacctgccaccacgcctgggtaatttttttgtgtatttttagtagagacagggttttactatgttggccaggctggtcttgaactcctgacctcataattcgccgtctcagcctcccaaagtgctggggttacaggtatgagtcatcacacctggcctcaaagtcttaacaactcatatgtcaacttcttaattaccaaaagagagagaagaaaacatcagtttggggtaatgcatttaaagggagccctcaggctgatttctaggccccatccggttctcatctgagtgagcagtattttgaagttgcctccaagaattggacttgatcatttagtttcctctcatttctaaggattcctgggattccaggtcagtgccacaggggaaccttggaaagtgtatatatgtcagaaatttagaggaagaatgtcatcagaaattggaacttgaatccacaagagtatgagagataattgcttccactttggaagtcattatcttgtgcccccagaactcttatctatagagcaggcatgagaactatggtttagatgggctgtttgcacattttactttgtgctacaaatttttttgcttgcttttctctctgtgtgtgtctctgtcactgtcatggagacgaactggatgagggaaagaagaaggaggctgggtgagcaggtaattgtgcagtagctgttctccagagaatcctacccaagggtcatgggtgatttatgtttttcctccacctttgcccagactttctttctactgttgcctttgaataaactggaaatttaaaaaaaaatcataattgcagtttcctaaatcatttgacactccagtcatcctgcaagtattgttataaggagtttcccacagaacaaactggcttacttctatcttcaaggatgggatcagtaagcttggctagattgtccagttcatttgggcccaaagcagatttcctcctctaacccaggcctacctaagaggatgctggggtctgagtagagctagcctaacctccatggcaggctggtgacactgctgacgcagactggtcactgccctgtggattgctttatttttgggcagaattgctaccagttatgaagtgcaggatgctgtgttggttaattaacagctatttataagtggctatctatacgaggttctaatccagaagttggcaggaagaagtaaaagagaactgaaaaacaaaatgctaaatgcagtgtggtatcctggattggatcctgaaacagaaaaagaacatgagtggaaaaactagtgaaatctgtataaagtctggagttttgttaatagtaagctatcaaagttaatttctcagttttgatgaatgtatcacagttatgtaagatgttaacaggaggggaaacagagaacaacagtatgtgggaacttactgtactttctgcaaatttaaaattattcataattaaaaatttattaaaaataaaaagaaacaccatccagagtcaccataactttagtaaagtaggttcctattgacagattctttgaagttttaagtttatgtattttttcaagaaatatacatttttactgaatgctttattttgtttttatttatttatgattttaaattaatttttttgtttgctttttagagacagagtcttgctctgtcacccaggctggagtgcagtggtataattacagctcacagcagccttgaactcctgggctcaagggatcctcttgcctcagcctacccagtagctgggactagaggcatgcaccaccacacctggctagttattttttattcttattttgtagagatggagtatcactgtgttgccaaggctggtctcaaactcctggcctcaagcaatcctcctgcctggacctcccaaagtgctgggattacaggcgtgagccactgtaccctgcctgaatgctttattttgagtattttatattagaagatatttcttgatggaactaacacagaaaagctaataaatatgtgatttgttttgacctttttgtacaatctgtatcagagaccaactacttattaaatggtgagtggaaatctcagaatactttccatctgggtccttcaaattgggacttaaggaccttcattgtgtgcaaggtttgataagcaaaaggatgacttcaccctactgggaaaagatggtattactgagcaatcaaagataaaattacaggattatagacgagatacaacatgtttcagctcttctccttgttaaaatcaagtgctcagaacttttcataggaggacagagttttatatccagagagattaactttccagtgacacagtttcacaatgataggtatgctagcgtccagggaacaggaggagaaaaggcaggtccacgtgatacccatgggcttcctggagaaactgctaatgacaaagctccagctcagtctgaccagctaacaaagtaaaaaggcctaggtctttgttgatatctcaaggagacttgcttttagaaacctccgtggagcacagagtagtaatgaagatctcctgctagagggcgagacatttggaccctaatcaaactgactctctcttatttatttttatttatttttgagacagtctcgttctgtcgcccaggctggtgtgcagtggcacgatctcagttcaccacaacctccacctcccaggttcaagcgattctcctgcctcagcctcccaagtagctggaattacaggcatgcaccaccacacccagctaatttttgtatttttagtagagatggggtttcgccatcttggccaggctgatctcatactcctgacctcaggtgatctgcctgcctcggcctcccaaattgctgggattacaggcatgagccactgtgcctggcccaaactgactctctcttaagtaaagggaggaagggtccaaggaaacacctcctgtagtggatttgtggcattctttagcatggggctgactctctccgagggcttgatcccctccccatatttctgatgcagcaggtctggcgaggggccctgggcatttgcatgtccagcaagctctcaggtgacactgatgctgcaaatccgggtaccacattttgagaatccagactttcttttctgcgtatcatgaatacagttgagatttgaaatcttttcccctataaagccctccattaaagttatatcttttctttaggtctgatccttttcttttcctctgtgctgagtgataaagatagcagtggaaattggaggacaagtgtctgtctctgattggcttctctacagaactgaggacctgaggtagcacttggggtgataaagttataaaaccacaggcgcttataggcttgggcagaaaacattcgtgttgatgccttagcagtttttctccatgacttggagggcctggctgttgtcagggttgcaggttgtttggaagtccacatggcatgtaaatggacccacaggggaacctgctgaacgaagggacccagattagtgaggtgggccacgctggtggcagtgccaactagagacatctctgtagatctgccccatgcatgtctgggcttccttccaaagagcgaaaggagatcttatctcgtaaagcacacactctctctcccctttcatctgttaaccctataaaattgtgggatgaggggtttacttactctaaataattatttttcaaaatttgatttcttttttaaaagtaaaaaagtatcacctactgtggaatgtttagacaattcataaaggacaaagaaaaaaataattttgcataatcagatgtatatatatatcacctttttaatatttagaggcttgcctttcaggttttgtttctactcttgctctttcacacatgtgcaaatctttctgggtactatgtagatcatggctgttgttgcctctttatggctttgcctctcactctgggtaccagctatgtctttataatcagctataaggctctgtttggtagttatcatttccccatcactgcctgagctcatcgcctcttactccctctcctctcgtttggctggtttcctttgctaatctgtgcacatgctgctcacctcatgctcaaggcctctctactcactgttccttctacttcgaatgctgttccccagttcctcacttctttctggcctttattcaaaagtcccttccatagcgaggtcttcttggacccctttaacatttcacacactttttttttttttttttgagacagagtctccctctgtcgccaggctggagtgcagtggagcgatctcggctcactgcaacctccgactcctgagttcaagccattctcctccctcagcctcccaagtagctgggattgcaggtgcgtgccaccacgcctggctaatttttgtatttttagtagagatgggatttcaccatgttggccaggatggtctcaatatcctgacctcatgatccgccagccttggcctcccaaagtgctgggattacaggcgtgagccactgcccccggactatttcacacacttcttcctgtaaacttatttcatttctttcctccttagaaagcatgactaactaacataatatgtattctacattttacttacttgtcaactatggtcagcttctccagctagaatataaactccatgacaaaaggcatcaatggattgcattctgcactgtccccaggacagtgcctggtggagggttgacaccccataaaaagctgctttaagatgtcaaatgaatgagctcaacaatacatcataaattatattccatattccatggcatatttttctatatcatgatttttaatagctgtttccaataatagctttttcctaatgtatcaatatatgactataccacagttaattaaacatgaatttaataatgaatacacaacagtttgttcaaatattatcctctattaacttcagtattgtaagtttctgcttattttgctgttataatcggcaccttagcaatcaaccttgtatgtatttgctcaaatcctgataattttcctagaataaatttccagaaattaactttctgggtcaagaagagtgtacctttaaggtgtttgatccacattctcaaatcactatccaaaagactgtttctctaagcagagatttctaatgctgatttctttgcacctttgacaataagacattatttttcaaaaatattccaatttttatgagtaaaaaatggtaactcattaaataattttatgttccttaggtcactggtaaaattgatcttttttatattttttaaaattggatatgtatatttcttttcttttctttttttctttttctttttcttttttttttttttttttggttttgtttttgagatggagtctcccttttgttgcccaggctggagtgcagtggtgggatcttggctcactgcaacctccacctcctgggttcaagtgattctcctgcctcagcctctcaagtagctgggattacagggacctgccaccacaccaggctaatttttgtgtttttagtagacgccgggtttcaccatgttggtcaggctggtctcgaactcctgactgcaagtgatctacctgcctccgcctcccaaagtgctgggattagggacaagagccactgcgcctggcctggatatgtatatttctttttatccatttttagtttatgttgtttgcttaactggtggggtgttaactagctttcttttaacgctttgcaagtgttctttatatagctaagcatttaaaaatatgtatggttaatatttttttgccatttgcttttaaataccttcatgttgttttttttttctaccattaccttaccttgatcttggcttcgtgttatttcttgatatacagaacatttatatgaaataggatatgcatatattttatgttttgaactgttttcaatgtaaggcttaaaaagtttaactcatcctaagactgtatgagtatttctatttatttctcctagtgactttatggtttcattattttccccaaattgttattcagtccttcaattccatttattgaataatgtccttttcctccctgacttgacatttcctttattacatactaatttgaatgtgttattttgttgttttggctctgactgttttattaacttgtgcctttctgtagcagaaacccactttaaaaattattagagttttataatatgtttttcacatttcagactacaaccacttctcatttttgattttcaaaattatcttaattatttagtatccgtatttttcttgaagaagaaattcagaatcattttgttccaacctccagtgttcaaacttgcatcagttttgcaaatacatatgggaagacattattgctgttggctaattcaattagcaaattctttagtccctttctttagtgccattatgagatgtgatttgatatgcactgcttctggggcaatgcccaatttctggaagttcttcagctagcaaagctctgttcctccaggtgccatcttttcctgctccttgctacctggtttcccaacattaggagacagggccttctgtgaaaaccatgatttcaggatatggcgctattggagcttccctgtctgcccatgtagcctgtctgtttgtgggtaaggtggggagctgcattcaccagcatgcaatgtactaactgccttccccaccctgactgctaagtaggcatggatgtcacagaatggatgtagaaagatggcgaaacaatgtgtgttttatttattgatgtgatagcatgtgctaaagaaagaatggaaacaacagaagcccatggtacaggataacaggtcagcgattttgttagtacaaatctgagtctgggggacacagtggagatatcctccatgtcttatctttgtttcagaggtttctcttttatgggacacaactctgggttggttggtttttaataaaaacagtagcttattcttaaatatagtttttgctctctaggttaggcaccattctaagtactttccacatacaaactcatttaattctcaagactgccttatgagagaaatcctattatgatttgagttttatggcttatctcaattgaactccttatgccttacagcaggtagaaattcactttagattctggcatcaggtggtctatcaaattaatttttagtgtgtgcttcatccttttctatcttcgtcaatatttaaaagttatagttagggagacatctagggctgctaaccaggtacattttaaactggaattcatcttttataaaccttttattagaaaataaaacccacatacaaaatttagaaaacagatgtatcccttaatgagtcctaaagtaaacactattataaccactacccaggttgtgaaatagatctttgccaatcattccagaagcttttcccattgtctcctaccaaggttgactctctcttttccacagaagtaaccactatcctgacttttccagaatcactttcttgagtttttgtaaaattttatcactaatgtacccctctaatgagcatagtttaatcttgcccaatttttaaaatcttgacatactttttacatctattttagtctgcaggtttctttttcatcttttattctttaccatttacctataaaagaacctgggggcatttgacctaaagagttttctaaagtataggttttgctgattgtgtacttgtgatccccattcaacactttcctctgtcctttccgtcctctgaaaattggcagatggtttcagagacttgattggatttggggttgatacatttggcaagactataaatggtgttgagttctttcattaagaggcagatgatatctgattgtctctctttttgtgatgttagcagctgttgatgcccaatgcctagatccattaattcattggaggttgcaaagctgttttcttctatttttttcattgattaattggaataattttataacaagtgattttcctcatttattgtttgatactctgtgcttttaggaaaagcagaaaaaaatacttcattcttttcttttatcagtgtctaattaaagaactggttccctatcattctacaaaggtgaacaaacaggtttttaggaaatattactatgaattcatgtatttggagctatttgaaaaatcttggccgcacacggtggctcatgcctgtaatcccagtactttgggaggccaaactgggtggatcacgaggtcaagagatcgagaccatcctagccaacatggtgaaaccccgtctctactaaaaatacaaaaaaaaatttatctgggtgtggtggcacgtgcctgtagtcccagctactcaggaggctgaggcaggagaatcgcttgaacccgggaggtggaggttgcagtgagccgagatcgcgccactgcactccagcctggaggcagagtgagactgtgtctcaaaaaaaaaagaaaagtcttgatctttttaaagatccaattgtctcatttgcttcaaggttgcctttgagtccttgtgtcatgactgtagtagtcattcctagctttcttgttgtctagcatggcaagatattccaggatcatgtggcacacttcttagaattagtctttttttttttccccccacaaaaggctgggtttctttttgtggcaatggcacttcaagattgctagggtttttgagtgctagggaaattttgtagagtttgtcattgtttttaagccctcttcactggttagaattaagaaacatatatgtttatatgatatctcaagggtttatactaacacttccaattcaaatcacaattacagggtttgatactcgcctgtatgccatctgctcactctttttctacactgagtatgttggttcacaaagacgcaggaaacgatgaattagaatatcccataattattgatatactttatccaataatattgtgcatatcccgtgaataacaatattgatgctacagcaccagtataattaactgagaaattaaatctctttattgcagcacatattctccccagtgtctccccatctttaaatatgctgtatctatggtatctgagttcacagccattatacactgtactttatccccattggttctatttatcttaattatatctatttatatatctatatgtatatatctcagactaccaccagttgtttctttttttttttttttttgagactgggtctcagactgttgcccaggctggagtgcaatggcacgatctcggctcactgccacctccacctccggggttcacgagattctcctgcctcagccttcccagtagctgagattacaggcgagcaccaccacacccggctaattttttttatttttagtagagacagagtttcactatgttggccagactggtctcaaactccggacctcgtgatctaccagcctcagcctcccagagtcctgggattacaggcatgagccaccacgcccggctcaactaccaccaattcttatatcaatgtctccatagtcattttggttattaaaatcaatcttacattctagtaggcacatcagagacagctcatgagaacaagcttccctgagttctggcctgttttctcactgggtcctttatacttatatgtcagctttgctggatatacaaaatttgtcacacattattttgcaagtctaaaatatgttacatcatttgtttttgaagtaaaacattgcagttgaaatgtctgatgataatctaattttgttttccttccatctttttcttaaaggctcaggtaatttaaaaatatctttctatacggtttagtaattttactgaaaaatttttttgtgttgattgttttgggttgacatttaggggtatacatgaggctctttcaatacagttggccctccatattcatgggctccacattcatggattcaaccaactgcaggtcaaaaatatttgataaaatgaaataaaaataatacaacaataaaaaaaatacaacaataaaaataatacaaataaaagatacagtataactattagcatagcatttatattctcttaggtactataagtaatgcagggatgatttaaagtctacaggaggatgcatgtaggttatatgcaaacgctgacattttctttcaaggacttgagcatttgcagactttgacaactgtagggggtcctggaaccaattccccatggatactgaaggatgactgcttatacttcctttaattttaattgtaggagagttttctcaatttatagtttgttttgttttggtttgtttgctgggattatgcctgtaatcccagcactttgggaggccgaggtgggtggattacctgaggttgagggctcgagactagcctggccaacatggtgaaagcccatctctactaaaaatacaaaaattagctgtcgcggtggtgcgcacctgtgattccggctactcgggaggctgatgcagaagaatcacttgaacctgggtggcggaggttgcagtgagctgagattgcgccactcactgccctgcagcatgggtgacagagcaagactcactctcaaaaaaaaaaaaaaaaatcaagattgctttcctaacttaacagagcttctttgagagagagagagagagagagagagagagagagagagagaaagagtgtgtatgtgtgtgtgtgtagtgtagcatagtgtttaagaacagaatggtttgtttacggaagtgtattagctccactctcccccacatttgtctgaacctttgctttgtctccattgtttttgtcctcagttttaattctactctcagcagtttctcctcagtatgaagctgtggtctgaaaaaagttctggtgggttgtacagaaaatttgcaggtctaggctgtgtctgcccctccaggctctccacagacctctcttataatctgctgtggggatgggacatgcgctcctgatgccagctgctgttctcacacagggctgccaggctttctgtgaatacctgctgctattgagggttcctctggctccaggtccagcagagctctcattgcctcactctatttccctgcacagatgctgatagcatgcagattttgtgctattactggtttatttccattcacttatttttgaggttcatgagaacaaccatgtcacctagttttgtaataaatattatctgtgagttttttatttgcctttctagttctatttttatttgggaatttagagagattttaaaaaaacgataccactgctgccaacattttctgagaactctcattttattttgtatgtacgtagttttcatcaatcgatagatatttattaaatggtctatggcaggtcctattatagacaccaaggatatagctatgaacaaaacagagtttctaccctcaagacatataataggaaaagaatggtattgaacatatacaccactaaataagtgaaaaaacatcaaatataagtcaatttcatgaagtaaatgaaatgagataatatgtatctattcttttaaaccatttgattacatgtatatacacacagacatacatacacatactttatatacacacatatacttatatgtatgtatacacacacatatacatactcacacacaaagatatttgacttacatacaaatatgtttgaatagtattttctggattacaaagtgtgtttccatacaatgcattcttttatctttttatgaataggcagatagggtaggttttactccccatgtgacagaggaggaatttcatgtttaataattataagtgatatccaatacacttacagccaaagcttcatcaagtatcttttgaatctgaatctgctcttttaaacttaatattctattttttagtaccacattacataaaacactgtgctgggggttagagatgacaccttttcagcccaaataattgagtttcaatgagagacaataagatatatgcttagtgctgtcagatgggggtgggggggtgggggggcaggcctgaaggaagttctgtgggagtgaggaagcatcagctgtctttgtggtgggatgtcccggggaagcctaatgaaggagactgcatctgagtggcccttgcatatagagagacggggcatttctagttggagtgaaccatgtgaacaaagacaggtagacatatccttaacgtagctggaggagagcgagagttgaatcaactgtttagtttttcttcatacactcatcattcaatgagtttttaagttactatgtgccagggcagagatagaaagatagatagggaaggagcttagtctagtgggggagaggtgtgctccccacctgattcgaaagtgaaacctttcagtgggactgaatcttcacttacctgcagcatccaacaaaaacaggcagccgggagatgaggagcagaggattttagtgctgggattctgagccattttcttggcaggctgcttggtgttcctaaccttgaaaaaaatcaatttgcttggagcatattatgtctgaaaagcacccgtggaggaaaagactagaaaagtgtattgagtgttagatgttagcggaatttaaatgtcatgataaggaatttattttggggtagtaaagtgtggttgagagtttttgacaagaagactgacctaagatgccagtgtgtccatgaattcggccaaaaattcaaaaatcagtcccaccactttctgaaaagatgacatattgaagaatttatttaaaccctctgagcttcattttcttgatctgttaaaattgggaatttatttatgtatttatccactgacacctcatttattcattcatttttaagttcaactgatatttaataattagttctggctgggcgcagtggctcacgcctgtaatcccagcactttgggaggctgaggtgggtggatcacggggtcaggagattgagaccatcctgtctaacacggtgaaaccccgtctctactaaacaaatacaaaaaattagttggacatggtggtacatttctgtagtcccagctactcaggagtctgaggcaggagaatcgcttgaatctgggaggctgagttcgcagtgagctgagatcgcatcactgttgcctgggtgacagagcgagactctgtctcaaaagaaaaaacaaccaataataaataaataaataaataagtaaatactcagttctggagctacatggtctaatgcagtagccactcactcaaaagtgctattgaacacttgaaatgcagatagtctgaattgagatgtgctatcagtgtgaaatatacacttgatttggaagtgttagtatgagaaaaagaatataaaatacctcattaataatttttatgttgaatacttcctgaaaggaaagaagaaataagtttaagagagctattgtacagcatggtgactatagctaatgataatagattatattattgaaaaatgccaagacagttggtgttaagtgctcttgccacaaaaattattgctatgtgaggcaatacatatgttaattaactagatttaaccattccacaatgtatatatgcttcaaatgcatagaattttatctgtcaattaaaaaataaatttgaaaaaatgttttttgaaattaattttgtggttcattttttcaaagatatgtcatttagaatatttaaatgtggcctcatttacagcttgtactgtatttctattggacgatgctgctctagatactgagtgtacaatattgaatagtggtcagagacagatagtaaataagcacatttaaatatctaagtcatctaattctagactgtgaaataagtgctgtgatcttcccacctgcctctcatcccacctttgctctctcgggcccctctattcatttgcagcattttcttagccacttctcttggttagtggggcttatctaacttacatagttgtcctctctcaggaactctggctaatttctcccttttggggtcttgcaactaatgtgaccatctgtttaaatatttcttcaatgactgaaaaaacaagctaaagccatccaaattccaaaggcaaacaaaattcttcaactctcttcagtagaaatcttcattctgtctttcctttattgtcaaaaattaccatttcccccaatactatggaaattgggagttttcatccacagagtgtgtagtttgtatccaaacagcagggcatatatctgtctagttcatgccatccttcctgtagacactacagcttccccatgggactctgaacatcacccaccttctagccataggacacatcctttgtatgtggacaaactcacacaataacatgtcattgcagttatatccatttcagtacagagtatgatgccactttatgccaattggccttttcctaagacaaagcagtcatattggtaagaaaacgagggagatagtacattaggtggaaaacagagttaagtgaccaaattagaaatggttaatgaatggccatgtcaagtcgttcaactatttagttcatgtttatcaagtctgttttataaatccagacctgtgtcaggcactggctatgatgggaggataacttctaaagttcttataaatttcctgcctttaagatgtttttagaaagacaattctaaaacaaaaacaaaatgctaataaagcaattaaagggcaggaccaaatcaaaatgtatggcaaggatgttaaggactgggagaggtcaggaaggaagatgtggatgaaatttgcagacgtcttgaaataactcttggagaaaatggaccttaatatctggatgtgacttaaacaggtcaggaggagagagaacagcttgacccaaatggagtggaaagggatgcatgagagagaacagtgggagataacgttacccaggaccctgtagtcaatcaggaaatgtgacttccaggccttctgatcccagtaaagtgggagagaagagacatcattttctgcattctgcttttctccaaagttaagtaccagaatataaggagcaacatgcataacactggaaatagtggcgtttattggacattctatcttactacagggtatgtgctgagaggtgcagttatttctgcgtctagcagaaggtatcagatgactgttgccttcaggtatagcttagtagcagctgcaagtggagtttcattatagccacagaatgtcttgccaaaatcaacaccagtgatcaggattttagaatgtctagccagtgctcaaagaaattccatatactacatgggagccatcatgaacaaaatactcctcattatgattcgcttcctgaaagagtttcacctacaagaagaggatgcctggaaaagagaaaaaacaacaccttaagcttcaaatttcaacatatctttgggcttttgaaatcatttaaatgaatcttttagacttttcctctagaacagaatattgagatacaattcatatgtcacaaaactcacctatttttaaagtataaaattcaagggttttaggtatattcacagagccgtgtgactgccagatctacagtaaccttggaaactctttacccattagcaatcactcctcatttcccctcccatctccctcctccctgctcccccactgccctctgattcctagacaatcactaattcactctctgtatttatagattttcttattctggaaatatcacataaacagagtcatacattatgtggtcttttgtgatggattggcttcttttatttagcataatgttttcaagattcatccatacagtagcctgtatcagttctttaatcttttggttgcaaataccatgccattgtatggacataccacattttatttactccctctgcagttggcagacatttgggctgtttccactttgggctattatgaatgatgtggctataaaaactcatgtaaaaatttttatgtggacatatatttttatttctcttgaatgaaatacattcagttctcattttccacagtagctatgttctataaagttgtcatcaacactgaattagcaaatgctgagccactgcttctaagtaaaattcaggattaggtctgggagacctctggtcacaatatttttgtcaatccatccatatgtaaccttgttttgtgtgtgtttctgtttagagacaccttattgaatatatatatatatagtaaatttctttgctttttagcctcacaacactgctatccactatgctttttaatcgattgttatctctggaattcacaaatttagacaactgttttccatcgctccattactctctatgcgtgtttctttagcattttctggagtggtctcacatacagaccagtgaattttctctctctccttctggatgtaagtagtagtgattgcttcacattgaactcaaggccagcagcactatgacgcatgcctgagtgaagcttagctaactcgtgtgttttctccataaggagtttcaccgaactcctcactctgccattctgaaagtgcatgcctctctcttaggctttctaccttcacctaaagcaaaagagaatgaggacaatcatctgaattaaattaaagaaatctttataacaaaagggaaaggtgtttggggattaaatttctagccagtcagtgaggttttccatcctgattgaattcttctgaaaactttttaactttgcaaaatgctttgactgagcagccttaggttactccacaaacattctttttatttctttcagcaatgtggacgttgcatttaaacagtctgactgaatttttgcctccagtttgaaactcatattttaaagataatctttaagccagaaactttaaatatattcattgaggtcaattaatcaaactgtatggagtttctaccccgggctatatatcaaccttgctctggatgcagcaagatactctaatgaaagtgatgtcctaattctttttgtgctactgtaacagaacaccacagcctgagtaattcataatgaacataaatgtattcagctcatggttctagaagctgggaagtccaagattgaggggttggatctggtgaggattttcttgctgtgtcataacatggtggagggcatcacacggtgaccgaaagcaagtgagggttgaacttgcttttacagcaatcccactctcttgataacaaaccccctctctccataacagcattaatccattcatgggggctcagccttcttaaaggtcccatctctcaacactgttgcattggggattaagtttccaacatattcaaaccatagcagatgatataatctagagttgcaaagagccattaatttgggattttggtggctaagaatatgcagttaaaactctgcatagtgggctgggcagtggtggctgatgcctgtaatcccagcactttgggaggccaaggtggacagatcacttcaggtcaggagttcgagactagcttggccaacatggtgaaaccccatctctactaaaaatacaaaaaattagccaggcatagggtgtgcacctgtaatcccagctactcaggaggctgagatgggagaatcactggaacccaggaggtggaggttgcagtgagccgagatcgtgacactgcactccagcctgggaggcagagtgagactccatctcaaaaaaaaaaaaaaaaaaaaaaaaaaaaattctgcatagttgtgtatccaccagcgtcattagagcagttagtgttagtggcagttagaattgcactatgtgaataactggccccttttgtaaagtatctcactaagtgtgtactgttggcatgaaaggctgcctaacttttcagggcctcacagcccctctattgtcaggtacctaaaattgcctggtccctcttttacaactatggcatacctatatcccatgatacattattgtataagaattggttttcctcttctattatttttaatttttctatatgataatgagattgctcaggagagcagaaatctaggaatatatattaaaactaccattgtgaaactaacatatttccctactgaaccctcaagttggtttataaattgttgtcacctctggttctttacctggccatctttctgtcagttggaaaaatggtgggttgccatagacctccctgtgttacctgcctcctcttttgacttttatgtcatacaagttactaatcccacaaatgaaccctctgctccactcattcagtacacacttgaaggtcctccagtgtggtaaatgtggtgctaggtgctggctcctcactatcaatgagacagtttcctagaccttaaagaagttttgccatctcatgaggcagacaaatatgaaaacaagtaagtgcaataattccatgttctgtagaagaagaatgtacaaggcacccaggagacccaaaggctggttctcacttctcccagacagtagagggagccagaaggagtttcaggctggtacagtggctcactcctacaatcccagcactttgggaggccaaagcaagagcattgcttgagcctaggagttcgaggccagcccggaaaacaggttgtagacattctctctctacaaacaataaaaaagtattatccaggtgtagtggcatgtgcctgtgatcctagctactctggaggttgaggtgaaaggattgcttgaacctaaggagttccaggctataatgagctacgatagcaccactgcactccagcctgagtgacagaacaagactctgtagccaaaaaaaaaaaaaaaaaaaaaaagaaaagcagcagcttcccctcaaggaagtgatgagccaggaagacagattctggtacgactgaattagacacgaagtgattcaaaagggcattccagcatttcctttaagaaggcttaaagatgaaaacccacacagtcctgatttacattaatgttttttttttaatcttacaattaggagtatgtgagtccaatatgagactctagttctttgattataatacttccccttattttctgtctacttctccaattctcctggtgccagcctccttgataacagggcatggagtcatattcatctaccacagcacctaacacaattagtaggtccttaaaaatgtgttgggtaaatacataccataagtccatttttcattcattaagggcaactctttgtcctggaaactagttctcagtcattttgtatggtgatgctggcctctatgtctgggcctctagactttctttaggcatttctaccagttagagcttcagggagaaaggccaggcatggctggagttttcactggaagtggtggaacagatgcatagattctaaagagaatgcacagatgaacagatacacagattctaagactgagaattaagctctggcttatgaacttgttcctaattttaaaaaattacacgctttgacctatgtcatgcgtaagtagttaaaaaaatggtataattcaaacactcactttcaccctgataatcttcctttttaaaaaagggtaagacttgatttcattcttttttatggctgagtagtattccatggtgtgtgtgtgtgtgtgtgtgtgtgcatttacattttctttatccaatcgtctattgatggacacttatgttgattcaatatatttgctattgtgaatagtgctgcaataaacataagagtgaagttatctttttaacacaatgatttttttttcctttgggtagatacccattagtgggatttctggatcacatgatagttctatttttagttctttgttacgctaatagcccagacttcaccgttctgcaatatatctgtgtcacaaaactgcacttgtatccctcaaatgtacacaaattttaaaaagtgagacaaatatatatcctccagcatgtagtaaagaggcaccaagtttggtctctcattcctcttgcataatctactcctcatttaatgggctggaacccttcaggaactccctgatttgcctcttcctggtgatcctggtatatgccatctccctggcttccatcctgtctcctaggcttgactgaggaggtaggtagctcaggggagccaggaagccaaccctgccccttacctccaggtccatttcatttccatagtattccacacagaactaaaagtattcgtactattttgtttttttctctatggagaaaactgaaagcactttggctttaaaccctcagcgagagtattgccaatgagcacagcctcagggctactagatttcctagcaggagaggacctattgggaaagcccctcctctctccagtggtcccttccactcactgacaacctccatcccagccccaatgtttgaagtctctccctgaacttcaggcaagcctcctgctcctgggacacacacacaaccccttccttccaaggatgaaatgctaattatcagagatattacagactaatgtcttaaggaggaaggaattcatttcctaactaccacataatttgcaaggcaacactctctctagcagtctggacatcttattactatgcagataaaatatgtaattcccttcctccaaccagttgccaccctcatcctcctcaccatccaattttaaattgtactgtctgggctcactaggaataagagaagcggccattgtggggccatatactcattccagcttgctctttaacaaagagatgttcggctattgctgcaccattaaggaatagattaacttcttatttaaaagtctgttctgccctccatttctaactaagcaggaggggaagcaatggattactccttcccttcataagtataggtaattgatgacctgcgagcacaatagcaggtcacatggtctgaccaaggttttatttttttctgaattatgattcattttcattaagtattacaaaggaataaaaatccagctggatttaagcattttgtgcagcatttaatgaatcacctttcctgaaaaaaaggaaaattacacaaactctcccagaaaatccagccagcacagtcatcatagctttatgatacagaatcgagttaattatgaaaaacactcaattccttaaagaaatctctaaaaatcttgaacatcatggccatgtatcctggtgaggctaaaattggtcaaaagcagagcggaataacaaatgataatttctgctaaataattcaggctatctgaactctgatattttacagactttaatgagtataatgggtccaattagagactgctttccttcaccatgccaggctcaatgtgccctctcttaattgtgggccccgtttttatttggataactcatctctacaaatttgtcctgaaatcccagtatctggcattaatagctactaactgtatgtcaaagtcagtcactgagtaagttttgatgatgattatcatgaagaaaaagagattgcaccggggccggtcagggggtgggggggctaggggagggatagcattaggagaaatacctaatgtagatgacaggttggtgggtgcagcaaaccaccatggcacatgtatacctatgtaacaaacctgcactttctgcacatgtatcccagaacttaaagtataataaaaaaattttttaaaaaagaagagagtagaaagcaaggcaaaaagagagagagacagcttgcagaacaaaaactagatatttcaatacactagttcgtctgggtaagtctcatttgtaaaagaatggaatgggtttctctcacacgtggcctttctttctccctgcgcagggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacaggtacgtgcaggaacagtgatcgtggggagaccctgaaaaccaagtgctggcctgtcttgcagatcatgctcctccttcagacgcagttgccagaaccagagcctaatggtagacgtcattcaaagcctaaagggatgagtggctgacctcagcagacctggctgtcctaagacccctaaataccatttcaggtgctcattctatcaccctagttcctttcgatgaagtaatgcagcagcttgcatctgctgaagagctgtgtgcattgtctatcattcctactgtgtattatataagatgtgatatctattctgttttctagattccgtctgcaattagtgtggatcatgcatgctgtgtcatgtgtaatagagaggtcccctaccaatgtctataatgcaggacatcatccttttttttaccttggcaggggagagtgggaggaaaagaaaggaaaactataatctttaaaagtactttagtgtgccaagaactgatttatttatttttttttctgagatgacattctcatcatctttgcaggggatcctgtgattcatcttgcaggagatcctgtgattcaagcctattaactttcacaagtaaaaccttaaatattgataaccgatgatttgaccttctaattgcttaactaaaataaattcttcagaggtctatcacatcatgaaactaaaacactgttataatttaatcaagataaactatttggacaagatttatgttgtggcagaaatgtgaccaaacaggttagaatccagagaagttgggggcgtatttcatggtgcctactctttccatgcgattaaaatttagcagtacattttatctgctgtctaatgaatcatgcataaactgtaggtgtaattattttgtaaatggcattttgcaaactggagagagcctaaaacaatgcttggcttttatccttaccactgtttttcttaagaaaaaatgtattcttttacctagagaatcacaaggaatcattttactgtatttttctatttagtttaactaaacaacattgtttttgtaaaggtggctgtgacattcaggcataggatgaggttgcaaaacacatgaaatctggagacaagctcagtatgtttgggggcacaggttgtgtttcagcctttgacaagcagccagtcaattgaaactcctgattcttgctcccttaaatgttgcatattcaccttgtaacctactccccatcaaatctcttaaaatagacacctcaaaaaaacagtcactggaaaatttttacctgttttccatgaattaataaccagtccatttgttctctctgctgaagcagaatattactgttaaattaaattttggaggtaatgatggaagaggagaaggtgtgtgtttgcttatcacatcaattagcaaatgggagagttattctttctgcaaaaaaaaaaaaaaaaaaaaaaaaaaaaaaaaaaattgccacatggcaaaaccagttctttgtgaatttaaatacagcttcaagacaaccaagcatccaattgttttcctgaattcaaacaccctcagatctgggaaatagaactcgagtgtaatttgttagccatcatcaatacattccaaaggaaaaggaaaaagcgaagtacagcctttacttaatggcttagtcttggctgttcatgggactagctcagccctccctgttgcagaaaccaggttgctggataggcaagaagggaacgaatagggtgtggtgcaccgaaagctatggctcaggttgggcctgccttgcgccagctcccccttcacacccagcttatacccccttctgcagcttgccctcccatccattcccctctgtcactgctttgagcagaaaggatcttggaaagtggcagcaccagacagatcagagggcctaggaagctaaactggctcctggcttgggttggtgtcaacccagctgttggcagggagcagagaaagcaaggcctcctactagagggagcaagtagtcagacatgaggcagtttggtcaataggagaaaagacatgcaaatgtatgcaatgtgtgtacacgagcgccttcagaatgaagacccaaatgcagtagaaattggccatttttatggttacttcaacaaagtaagggcagccttgtagaaatatgattgcacaaaaagggaacgatctaatgctgttggacagagtggggacacctagcaaagcctgtctgtctagattcttcttggcctctctgagcagcactccttccttctgggtgtggggcaggaccctctctggaaagggggtctcatgtcctactctccagcaaggtcaaacagataatttctttatggtcagtttttacacagaaaggtgaggggagtgaggggaagttagatcaatagtttttaggttttatggctggctttggggaaaaggcggttctggtttctaagatctgccttggagaagcaggtttccaggctatccttgggggagaatgggactgggagacaggagggtaggagaatgtcagagaaaaacttcacttctgaggctgctgctcaggtcttcattttgagatattgttttgagtcccaacagcagaagtaggcattgtgggggtgtcccaggttaagggttgaaggcctgataggaggatggcaccagcatcggaggctctgggcccagggagcatgcaaatgaaccagcagtgtgccggtgttgggaaagcctggcagatggtagcaaggcctgctgcagtcctgggttctaggaaaggataggctgagaagaccatggcaggacaccaccatttaatacaagcatgctgggctggagaccacgcgtagaaaacaaaacaggaacctgaattctagccttagagtataaggtggaggcttgttctcaagttactgcaagtacaggagaaagaccaggaggcactggaaaagaaaacccacactatggcctcctgaattatcaagtacagctccctgaatggagtccggatggccatcctcccttactgcctgcagccacacccagcagcagcttctccagggcttcaccttccacgtggtggctgccttgtgctcctctaggaaccgctctgcctaattaaccaagctggcttgaaattgcttctataataaaaacaaaaggaaaaaaaaaggaacacagaaaatccagtcaactgaatcaagatgtaagagaaacaattttgctcaggtatgctgcccccacccccgtgaataacaggctcttgaactggggtgatttctgtgttggaataattgaaccacaactcattgcttctgccagctacttcgtctgatgagggtgagcagttgggatctgtgaatcactacctttccaccccctccagctgccctttgatcaagcatcttctgggtctcctgcagaatgagttgcaacttgagtcgccttctccagatgggtgcatgtttactagaatttctgaaatgcttggcagagccgctggaataacactcattcatttacatattgtctgtggctgcttttatgctgcaatggcagaagtgagttgttataacagggatgatccaggtcacaaagcctaaaatatttgctatgtggttctttacatacaaagtttgactcttgatctagagactggatgatcttgaggaacatgcatcaaggaggcaaagggttttttatacagaaactcacaacgggtgctagggtgagtgtctgtataaaatggaagcagtcttcccaggctgtgcaccagtcaggagctggggaggtgcctgggatagagattgatgaaaaggatgtgactgagagcaggctcatacctgtaattccaacactctgggaggctgaggctggaggattgcttgagcccaggaatttgataccagcctgggcaatgtagtgagaccctttccctacaaaaaaataaaaattagccaggcatgatggcacatgcctatagtccaagctccttgggaggctgaggtgggaggattgatttagcctgggaggttgatgctgcagtgagctgaggttgcaccactgcactccagcctgggtgacagagtgaaaccctgtcttagggaaaacaagaaaaaagaccccagtcattgggtttagggcacactttaatccaatatgatctcattttagcttaactagttacagttgcaaaaaacctatttccaaaaacattgacattctgagcttctagggggacataaatttgaggggacactaacccggtatatgagcaaactccagttaactgctggcagctggcaaagatcataggccctgattctgtgcctgcccccaacctctttttttttatgataaatccatatcagcaagatctcattcaaaatcctgaagaaaacatcatttaactcttctctttagaaacttacttttggagaaaatatgaatgagaggaaatctgatgtatggaagaaaatccttaaactatagttattctccattttccaccattcatcaaagtgatttttaagattatgcataattggaatggttaggttctatccagcattaataagaacattcatctgtgtctgtagcagagactttgcttatcagacacccatttgctttttatctgccccagacttgcaattgattgtgtgttaagacctggctacaagatggaagagagccattcaactgcgttagactttgcacgaacaagaaataagcctttattgtgatactttgcggttgtatggtattacaggagagtctaatctatcctggtggctacattatcccttaaagttattgtttcagttataagcttttatgaacacatctatcattcacagtaaaaatggatatgagtgcaatctttcatataattcccagacatcattagtttgacaggtaatgacatcaaatttagcaataacctttctttcatttttgacccttcagagtttgaagtggccctagggttatgtgtgtcttcagtaacaaggctggatggatagagaaccattctgaggtgtgctctgcagggaccacagttattactgcctctgttcatgactgtacctctgggcacatagtaggtatttaattaatacttgttcgatgtgtaaaaattggaagcatacattagaataataataggcagttaagtgtctatagttttattttcaaatttagttaccttggttatttaaattttagtcaagtatgatggtaaaaaacagtggttttccaatttaacaggaatgtatcatccctgtccacttgcttgatcttacaaaactcctttctttgtaaaataggtgatataccaaataccagaggccacaaacagaggctgtgaagtcagacccagttttaaattctgcttatatccatgggaacattcacaggtggttttaactgttcagccctcaatttgttaaaggtaaagtgacggaaacacattacagaattactatagtaaggcagaagatataagtaaaatacttactatagtgtctgccacacaattcagtgtggaatggatatattattgtatgtaaatacatacaagtgtaagcatacacacaactgatcctcattgtttgaggattctgtatttatgaatccactgtgatttatttgtaactccaaattaattctcctggcacttttggggttattcccagacatgtgtggaattgtgaaaaatgtgagtcatgccaagtgcacattcccagctgaggttgaacacggtgacattctgccttcttgtttcagctctcattctgtaaacaagtctctctctctttttttttttttttgcagtctatttagtgtcacgtgttttgcacattttgtgtcttttgttggtgactttgccatttaaaatggcccccaagagcagtgctgaagtgctatctaatattcctaagtacaataaggctgtgatgaaccttactgagaaaataagctttgctcagacatgagttacagtgccattggtggtgagtttaaagttaatgaatcaaacatttatattaaatcagacacatttaagcagaaacacacatacatcaaggttgtatattgattgatcaaaaccttgtaaccacaagttcctaggaacctaaccctgaatttctcctaggagcaaagtgatttactggtatttgctggtctactgaatagaacatttcaaaatccaaggctctcactaagtggattggtagcaacaaagacagatatttatacactttaaatcaagtatttcttatttgcaggaacagtaaacaatgtaagaaaagcaacggataagcaatgatctcattcattgcatgtattgtaagtgtgtttattgtatattcctcttctaaaatcttattggttctcttctttttttccttatttcctgttgaaaattagagagacagagcttcagaacttttacataaatttccatgccagacacagaattgcttatttaagttctctgttgaataagtaaagatcagggtagtctatatctgcttgaaagttacataaattcaaattttgaataatacatgcactctaggttcaatcagcacctcatatttgcatataagatttcatacaccatagcagttatttcatctgaatcaggttatttggtttgtgtggcataatctgtctagatgcttgctttaatagatgcaaacaatagtttgtcaaacaagcagatcttaatagtggtgcatcttcttttaaattaggaaagctggcatgttctgaggcatcatctctagatcagtgcatttgttccagttgatgttttggcttttctaagctcataaatgtaagtaatagattcacagatttgcagagctggaaggggcttagtgatcgttattttagccatctcagataccttgtgagaaaactgaagcccagaggggtgaaaccatttacccaaggtgatacaagtggctgacagcaaagacacttctcttgcagtaatgcttccctggtgtcactggtgggagaaaccatgcctgttagtccatgcctatcctacagcgagtaggatttaaatccattagcaatgtgaggtaagctgaattcttttggccataatttttctgcgctgggtcatagcaagcttggggcaatgattagattaagactgctgtgttttttgttttatagttgatgactaatgaaacaagagatcagtgattggataaaactaaagattttaacaaggagcctactgcctaggtgattttcacaatccttttcaataccgtaaactcgattttctcttttaagtgatcacatagtggtataagacagttgatgatctcagcatcttttatgatgttgttatacctttgtttcagaaaatattctttgacatacttttataaaggaaaatagtagaacaataaaataatcaatttcctgtgcatactctgaaactgtcaacaggagacatggtcaggacttgaaatccatacgcaaaacacattactattcaaaaaaaaactacaagcagaagattttctggcaacaactcctgaatcatctattaaagataagaaccctaaaagtgtctagtctatgaaattgagaagacactcataaagtaagcatcacacctgaaataatgggtagtaaatgtcccaaactatattcccattctttgaaatatctatacattttaaatatcagcctcaaaattctcacttaatgctcagattggtttctttaagaatcagatgcaataggtgcaaattactgcatggcatttgagtgcgattaacataacattttaaaatattttctaaattcatgtaaattacttctgttctctgaccctgaaggttagtgagaagaccggccccagccattcactggagtatcctccctctccctctttagtgccactcacagggctcagagaagtctccacctgtggactctggctacttgatgatctcacccaggatgctgttgtgttctcagcgtccacaagctggaggtccagccctggggctccctcagaagtgtattttaatcatctgttttcttcatgggccaagtctcctccgtttcaacctagaccatggaaaagaagaccaaggacccatgggaggcattcctagggaggtcccaccaccttggacacactgtttttaagctgctccggtctctatcaacagttacaactcccttttttcctagtccccaagaagccaattactttcttgacaccaggcatactcctctttgacattcagatccctttgcctctcagacaactcaacacaaatccatttgctcatcctctcccagaggtggggaaaaccagacttcagagcctagctacgtttttggaatggaatgcaaaatttcctctcattttaatgaagtgagcctataagaaaataatttctaatttctcgataggttactctgctatgtaaattgtcacatgacacagacacctagcatgttcacttactgaaaacagaaatatgaaatttaatatattttcctcactttaccagccttcagagaagttgtttctcttgtgtaggatttcctgctaagtgattttcttctattgtttgttgagcactcagtagtttatggctctaatcataaatccacctaaggtttgtaagtgtattttggccatcttgaggtaccatgaattgcaaatgggagattaaaggggcccaacaaagtttattttattttattttgtttttatttttatttttacttttgagatggagtcttgccctgtcacccaggctggagtgcagtggtgccatctcagttctctgcaacctctgcttcctgggttcaagcaattctcctgcctcagcctcccgagcagctgggattacaggtgcatgccaatacactcagctaatttttgtatttttagtagagatgggatttcaccatgttggtcaggctggtcttgaactcctgaccttgtgatccacctgtctgggcctctcaaagtgctgggattacaggcatgagccaccgccccccggcctattttattttattaaatttgttgtggtggtggtgttgttgctcagttgcattgaaggactaagcaatgaagtttttgcaactctttttggaggcagcagtttgtctcggtcgtggtactggctgaagagatgatctgggcattctgagtgcaatcctcaagacttagaaatcagtaagtctttggaagctaagggtcctcagtcatctgaaggaaggattgctgctctcttgccacttgttgagatcacttaactgagaagcaggagatgggttgaaggcctacccgtgaattcttgctgtgattatttcctgattagtggaaactgctaatcattagcatcttcattttgcatttcactctgcagagcagatgaaatcttaatgcctggcctttcattttcagttagcaaaactaatatatcaagaatgctgatgagaaggtgagggaaggattcactgtagtatatgtggtaaatgaacatttagtccatcctttttgatacaaagggaggttttatttgtagtcaaagtaagtcagagagaaagaggtccatacaattgatgaaacctgatgatttaatattcaaaaattgtgctttaaaaaaaatgtttcatccagagtgtagggtatagaatgacttctacctagaagttcatgaatcttgaatcaccaacatgttttctgtttccaataagattctatttaactctttctcattggctggtatgctttacccaatatctctccctcccccatcaggtattaataatccttaattctaccaacctcccagaaccgccctccccgggacagtcagcatggcttcacatcagggatcagctcccttaagctccctctcttctgtgtttcaaagctatttttcagcagctttgggaaacagctggccatcagcccaaattctgtcaccttctatgtgtctcaagtgtcattaagttgtacttcagtgccccgtcttctggctaagtaattccacatcctttatcctgcatcatatacttttcttcctcatatcatctctctgcctcttatatatactttctattattctgtaaaacatcgtagatagctttgaaggaatctctgactgctggagtgtcagcaaacttacgaccagctacaggaacatgccaccaccattgcactaacttttctgactcactcttaccaaccacttttcccgcctcatgttcttcacagcccagcaatgtgggattgaggaaagaacacagggcagcagttaggggctctgggttctagtcttagttttctctgtggtcaagatgcctgcaaagtaacttttgtcaaacagacacttttaatcctcacaacaaggttgtgaaattgaaccactggccccattttattttaggaaacattctcactgtaggtaaaataacccaccagagttgtgatttgaaactggttttggttttatttcaaaatgatatttcatgatattattttctttgtacctgttgctcttatgatttttaaaaattgttattacttttttttaatttgtagagacagggactcactctgttgcccaagctggaatgcagtggcacaaccacggctcactgcagcttcctggggtcaaaggaatctctcacctcagactcccgagtagcagggactacagacgtgcatcactatgccaggctaattttcaattttttttcgttgagacaggggtctcactctgttacccaggttggagtacagtggagtgatcatagcttactcaagctttgaattcctgggctcaagatttcctcctacctcagcctcccaattagctgggggtgcagtctcactatgttgtccaggctggtcttgaactcctggtttcaagcaatcttcccacctcagcctcccaaagtgctgggattacaggtgtgagccatcgtgcctcgcctgtgattttttttttaagtacatagacttctgtagaattaatacatcttaataaaatagtcctgtaaaattagttcaaaatatgtctatttcagactttaagctccttgaggtcatggatggctctctatacctaaggcagggcacagtgccagaacatagttgaatgaatgaaacatgactatatgaatatttggtatggctgaggtgcaagtgaagcccatccctacgctgttgctccagtctgagggttcccagtcctgtctgcccattggaggtacctgcaaagctttaacatctatcgtggctgggccccaccccaagccattctgagctcagtggcctaagtgggtctggagtctttgagtgtctaaacatccccaaggtgattctgacaggaacctaatccagtgctttcctaatttaatttgcatatgagtcactcaagcctcttgcaaaatgcagattcttatcctgtggtcgaggttggggcctgagatgggcttctttaatcagctgcctagtgctttgaatggtcttggtgggtggtgcacacttggagcagcaggttttaaagcagctacatcctcactggctattaatgatacacttgtcctaaaaaaaatccctcaaaataaatcattcatattttgtctcatgtgctcccttccatctgtgtctgcatggcaataatgaagtatgcaatttttgaccaagccatagttaaattaataattgtgggtgacacagcagaataattcaggctctaagtaggcttctgctcccctagggactgaatttgcttaaggattttccaacttttgtctgcaagtcttatgtaccctaaaactgacttcctcctttgcagtgctcctttgttcatcagcctcattgctcaattggagaagcagtggtgtaggggtgtggtcttcaagccctcagggactagggtaccttcttgcttttacatttaatactctgaattctttcaatcttggtgatgggagggacttgacatgatggagcagagtagccccatctaccttacatctgatctcaagaattctagagttgcttttgatttcatagactgactcagaacagcagttcccaaatggcagttgagataaagtgctttatttctagattaaattcaaagtgatacatgcaaaatatatgcataactaatattcatcatttaaatacaaaacgcagccaattttcatagcttgcaaaccataggttattaagaccaatgttatttttagggatatatgcttaaggcaactcaaaatggaggttcaatagagaaaccatgaggtcccttttttcaggggtgggggtggtagctgaagagcggttatagacacaggcattccactcacagaatggaacagcaccaacttccgtaaattcattctaaagtcacagctctattctagcccaggacaaaaggccaccctctttgcctctcttcctctaaacttagcctgcactttctctctgctgcgcctctggcactgatcactttcctcatctttgaattctctataaatattcataaggatataagaaatgatccaggaagctggctctctagttgaatagctaatgctgccggataagtaaatcattccccaaccctgagcacggggtatggattaggtgtctggggaagactggtagaattaaaagaaccaaagctggtttcagttcccaggtgtcagtgcaccagtcctgtagctcctataggatactgcctgtgatccagggggtgcctccagctcagtactccaagagcggcacctgcagtgggcattgggagtgccagtggctcaaccagttcctgtcagggaagcccacgttgtccatttggaactccatgttaaatgtggggtttgaggtttacgatgaaaggacgtcatggtttctagcagtgcccagttagcagatcattgattcttgctaagcaatgcgtgaagtcataactcttagagtttctgaaattttaccacagtcttaatgtctctgtacttttctttttcttttgctattcccttaggacgaaagaaatgcctaatacgtaagtttattaaatagctaggtcaaaacaacttcagtacttatgtcccaataatttagtagccatctgatttttttttttttctaagacgggatctcctctggtcccaggctagaatgcagtggcacaaatatggttcactgtagccttgaccttatgggatcaagcaatcctcccatctaagcccctccctgtgtggctgggactacaggcgcgtgccaccatgcccatctaatttttgtattttttgtagagactgggttttgccatgttgcccaggatggttccaaactcctgggctttagtgatccacccatttcagcctcttgaagttctggaattacaagcgtgagccactgtgcctggtctgaaataattatacccataaattgaaaaaaaattcataacatttttgtttccttcttaaataactacactaatgaatgtgtttgcctggtgagtactgcataactttaaaaccaaattggaccttgccacctgtgtttcttgtttctcagtgaatgatttgattgactggtcatacacagcagtatccaaaaacccagtttcacagaaatcaaaataatcaaaaggaatgtagcatctaagttgaaactgtgagctaccttaagctaatggtccctgtggtgtccaacagatgttatgaggctttcctcaaaatgttaaaataccttacagatttcctatgacttagttcattgtgtcatcacaggacagctctgcacagagtttgagaactgtggccataaccggagattttaataatgaactcagggagtgtagcaccttgactgagtagtgtttgaagatttaataccatgagtatactacagggaaataactgattttcagatccgtctggacagagtggatgctatcattgattccggcattcatcgttatacctgcaggatgtcctcaagtacagcagtttatgtaagagaagtgatttcttctcttatgtaagttacactatggagaataagctgctcccttcattcaggaagggtttatttaacacctattatgtgccaagcccagttctaggtacctggaatctatcagtaaacaaaggataaaaatccttgcctcatggaccttagattctggcctcttgatttcaaggcaaagaatgtgcaatattacagcctttggattcttttgccaagcaacacaagaaagtcataaaaggacttttatcccctctaaagttctatttaatggcttattttcaaagattaaaattctgcagaaaccaggcatacttacaatatttagaacttattcaagtgactgaaactagagggaattattctatattaatgaaactcaatggtctatgaatactctcttaacgaagactgacgatatatgaatgcagtgtgggtaaagaagcaacttctgttaataggctgattatacttagaaggttgatgcataattgaattggacagtccccttaagtcatcttcatctttgttcattctcaggaaatgtgaaatggcatgtattttgaaacatcggatatattatagtgctttttaatttcctttgtggtataaaataaatagcatgtggatttttctatctcatggggctgggtagcagaattcgcatccagacatatcatgtgagaagacaggtacttctttttatctaaacaattagagccatatttggatctgtgataacagtgggacaactgcttttctcaggatcttttagagaaatcagggaagctggtactttcacattatattctgactgggccagccttcctccaactcattttacctcaagtctacaataaattaataataaagcattgcaaataaaatcttctgagatttaagactgggttgtggcaccacaaggtccctaagcagtgttttttagactttgtagtaaaacaaggtaacattaaatgtggcctatatataaatggtaaaataaaaatgtcttccatctacatgggggagtatatatccatgagtacaaagcagatcacccatattccacaactcagaaacacctattactaagatttttatctatagccttctagtctatattgttttatacatatatatagtaatagtagtagttatagttatataaagttttgcagctatgtgtataagtgattttgttgatattatacatataaaccacatcttttagtttacatcctgttctgaacatgtccccaggtctctaaatacttttctaaaacatatcttttttttttatttctgcatgtctttcagagtatagatgactaaaatttatttaatctatcatctattaagagtatctaacttgtttctttaaccctgtaaaataagtttaatgaaactatcaaatatttaatgtttagctataatatttatcaaaacatgaaaattcccccaagttgatattaaaagtcaccagtacttttcttcatgtatttatcacatgttcattgagcatctactatctacacaaaaggcccatgcctctgccagagatgcaaaataaatctaagtatgaggcctgactttgtggtgggcacggaggtgaggtgcttccctgaagaggaggctggactgtgtggtgacagcactacagaatgacactgacagctgcctcttaagccactcactgaatgatctaatctaactttactgttggtagcatttgcaaaaaaacagtgatatttgctgaagaaatactgctatcattaatttgatttagggtaggaaaaaaataaaggcagtttatcatagggactggaaatcagaaaaagtgttttttagaaaaaatgcgcatttccaaataatccccactgggagcagatgttgaagcctaggaaatgtgttttgattctagaattaatctgtttgtttatttggcctattgctctgtaggcattattggaaacgagttgacattgaaatatggggctggtcttagagtccagagatctggtctttaccacttcctctgctgcttattaatcaagggactctacactagtgggttcatctccctgggcttcaagctgccttattgaccagacaagatctctgagtaacttaagaaaacacaaggaacagacatagtaaactgcacaatatcacacaactgggaagaattattgttgtggataagaatggcttaggtgagagaaaccacatactttaaaatgaataaattctggctttatttctctatatcaaaagcccccacatcccttgtgagaatgaattaaacttcactatcctaaagcctagaaagcattaagcatgagagaaaagggagataaaagaggagaaaagaaggaaggaagaaaataaagagccaggggcttggggagggagcttgatgggggatgtagagagagagagaaagtatatgtgtgtgtgtgtgtgtgtgtgtgtgtgtgtacattagacatgtagagacagagagagagaggagtgtatgttgtcagcttgaatggcagagaaccctgtggctccttggcaaactggaagggcctagaaggcagacaggcaggtaggaatctatctcactgctgacggtgtcaccctcttccccagctaatgacgcccacctggtggtctgacagagctttgagatctgtccgtggatcttgtcttcttggttgaaacacctgctctcatctctggaacagttgttcccaaagtctttactaatttcccaggatgatgttaaatccagtctgtcctccgaagctggggtgaccaatttcaatttgcctaggactttccttgttttagccccaaaaaccacaggtcctaggaaaccctctcagtcccaggaaagctaggatggttggggccatactgaaagctggagttagggtttggatgccaggataaacaagtcagagtaaaaggtttcctgtttgaaagtaaatttttcagaaggatgtgcactctctgcaacttacagatataggccaccccagaaaatataagtttgggggaataatggcttttaatatatttagttgaatccaaaagaaggagagagactgtgatatgtatgtacactttgacatgttacctttctgcaatttagccaccagggccttgtcagatactggcttatatttatattgactggcacaggacttagctacctaagctctaaatgacacaatctggaagaaacaagaaaactcttggttaccatatttctttagtctctcatagtgtaaagaacattttatttattcgttcattcatttattcatcaaaaggcttggaatttacactatgtgtctgttgcatgcaaagtgctggcaccatgaagagttaggttgtagaatatgttagacaattagacaatgtagacaattacagaatgaggaaattttctgatagagactgatatggtttggctgtgtccccacccaaatctcatcttgaattgtagttctcataatctccatttgtcgtgggaggggggacccagtgggaagtaattgaatcatgagggtggttacccccacactgttgttctagtgatagtgagtgagttctcacaagatctgatggctttataaggggccttcccgtcctttgcttggcatttctccttcctgctgccatgtgaagaaggacgtgttttcttccacttctgccatgattgtaagtttcctgaagcctccccagccctgtggaactatgagttaattaaacctctttcctttgtaaattacccagtctcaggtatgtctttattagtagggtgagaacagactaatatagagacacacacaggagctgcagaaatatttttatccttaaatcaactatgattattatgcatggaataaataaatataagatgaatatacatattattttatagtattactcaagacaacatatccaacaggtgacagcagctgataacatactccttgacaaatcttgcacaaggtactaagagtgatgttgaaattcattccatgatgaggtgattcttagaaatcaagtgttgaaaactgacttgcttcaattagctcaagccttagagggcttgcattgattttatagactctgaatcaaccatagatccatgatcttttgttgaaaatatttggggctgattgtattttgcaaatcagaaattgtaggatttgggatgtataataaggcacagataccatacactgtgtttatatggagataggacagcagtccatgaccaaagatattaataattctattgcaatatgtatgtatgtttataccaaatgtaaagactataaatcatctcatgtgacttcaggtcaggttttggtaataaatgaatctgaaaaaacttgagtttcgggggtttttgcatttttatgaattgaaacagggattgtgaaaatgtactagaagagagccaatgcaaaagtgtctaatgggagcttctgttccaatttcccttacacatacacacagatgcgcattcacacagctaaggttacaaggtggtatttaagaaatgccaaatgaattgtgcagtgagtaaatgctttataagcttagaggagggagaactacttcttgcttaggttgttaaggccccacaaagcatatgggattcagtagcatcttgtgggacaggtgcacggctatgtggagagcctggtacaggtcagcacaccattctggtcatggccttgggcaaaggctggtgggataatagcttaatgttctcttgagtttcttcatggggaaaggaatcagaatttccatctaactttaccaatattaatttataatgttagctactattttagagattcttttatgttatggtgaaatgggaaaattaattggggttttaaaaaggcaagtaattatttctttctgtctcatggatgatatgacattttggctattgcctacagcaaaactagctccattgctgttggatgtattatgcttctttcttttatgtgaagatctaagaaagcttcattttatagttattttcaaagaaaatgtggcaatatttagatcatttgttctcaacattggccatgctttggaaacacgaatcaggctgtgggaggagggaggttttaaaaacatcctgatgcttgcttcccacccccagagtttttgatacaattgatctggggcacagtctggacacagaaacttttaaagcctggtgagtttaatgttgaaattactggtttcgattaattgacttttggttgaatctatataaagggcaggtaaagtaaatatttagttaatattttttgcaattagaataaaaacaaactatgaaatcaaaatagaaattaactacatgtcaactaaagtgttttttaaagcatgtttttaaaccaaaagataatctttgccccattcttcattcattttattggaataatacactctgccaaagcatgtaagtgttagggttcatgtacacacacagatttatcattaaaacctggaaactgctctcctcccacataatttctatatttggtattgaatcaaagctgtagaagggacagagcttccacaatttgttctgtccacaccctatgggttagctgcaaagtatgttaattttaaaagagatggtgtgtctgaatttttaccttgaggaaaccagggacgttagaaatttgccaaaggtcacacagctcactgatagtggagtcccacccaaccagagttctgtctttgattcaaggctgtttttatgctactgcctttgcctgcttttataggcactaaaggaatataagctgggttgaaatgagtgaagacagttacaacagaagcaaaaaaaaaaaaaaaatcctttaaactttcagactatacacaagatagtggaattattcagagggagaagctacatcaaattactttcttatgtgcaagataagattatcttatttgatgaatattctattgtgcctcactcctaccaggatatggtgtagaaggtatcagttgataaaatcgactaaaatgttttatagggcttactttaaagaaaaataaattatgcttcaagagtcaacatttattcatattgtagacatttgatatgttttccattgccatcaaaaacaatagctaattataaatcctcagaaattgataaggatttgggaagctttgaaagtgagattcaattaccttcagaaaagtggatagagatcttttcacatccaggtcaactgcatatttgtagcttttatttctaagtcatagcagaatgatactgggtggctgctggaatggcccacatttgagctttatttctacatggtgataacatgaccaaatcccacaatgagtcttttaaggggcgtactgtttgtgagtccctgtaaaaataacaccattaagtttaatctaaactagctaaaacttctcgatataatgaaatctctggataaagaaaaaagagcttcttagaaatactgttatgatacaggcattacttgaattaaaatgtcacttaacaagtatttgtttctatataagttatttaatcaaaaaaaaagtccacctaaaagttacctgaaagcttggggtgttggttaattggttccttaacttgttattgaggtctcggacctcagcttttccttggaacgacaaccctaatgctcgtggttttgccagctgcatcctacatctcagagaccaagaacacacacaggatgctgctatactgctttaggactaatggcccatgtgagaatttacatactgatttcttctccaaaatatttggatcggaatattttttccaaaatttaatgaaatcctatatgaaatagaaagatgatggatctagaaaaaaagtcccttagcttattaagaagtatgaaaaggatccttgggaaagtattgaagggaacattggctttgggaattccagatttcattttagtcctgtttttcccatcactagatatctcaccttcagtaagccactggcatttctgaaatcaatctctcatctgagaaatgggataaaaggccaagtcatagtccttgtaaggatggaagcaacttgtatgttgtaatacatagaaaagttatttttactttccattagtaagctccttcaagttaggctcttttttgtttgtttgttttctggaccagaaataatcctaagctcacagtaaaatgtgttaatttaataggtggaacaatgcaatctcaaaatagtgatacatgtctattctgtttagataagtacacctgatctatagtatttttcttttgatttttaaaaaaacattgttatttcagcatcaacgtgagcaggtagaggttgaaaacagcctattacaataaactgaagcagctgacaataaaattagcatgacttcctcaattaatgcaacccatgtcaccaaaagatcagtttctaccacttagccaaatcctttatttattggttaattacatttatagcacacaaacgtccaattcattcattcggaatcttttaagtcatgactgtccaatgtttacttcaagtattagctttattttgactgatagatcactcccttacctctaagaatttatttatttagttgcattttatccaatatttatttttagtgttatacacacacaaaaataattgaaggcaattacaataggcttattgcattattagtgatgctagaaaaattaagttattgctcaagttttacctggctcattgagcttgtcccctgtattttactacattttttttctctaaatgccaatgttagagcagaatgcattttaaaagtgagtgggaaaggccttcaataaccgtgttttcaaagctactccaggcagccaaatacttagagctactgtccatagctcctgagagccacagtgggaataactgagaatttatttttaaaaatcttattattcccctaagggatggtctcttgaattatcagattttggtataacgacatgcaaactctgatctcaatacattaagaatttttatttgtgtcccaactcaaaaatgaaagctggcagggctaattttcctgctgtcaatgaactcttggggatgtttaagctctagagtgaacaggagacttttggtcttcgggtattgaggaagagtggactcagtgttggactaacgtggctgtggttctctggttgtttcctttcacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtaagggcagctcttctcacttctgccacaaaactgggctttcagagaaaagatgcggctttcacaaatcggaatgattcttcttcttgctttaattattaaggaaaaagtgaggctcacccaaaagaaatggacaagaaaggaaatgagcagaaggcttgctttagtttaatttttataatctcctttgtttcaaagtgtttattttcatatttttattgactgcttttcagaccaaaggcacattcatgaaccagattgttttccttctgctttatctttaactgccttctttaccaaatgcttttgtagagtagcagtgtttaaaaaagaaaaaaaagatgctgaatgggaggctgaggtgggcagattgcctgaggtcaggagttcaacaccggcctggccaatatggtgaaaccccgtctgtattaaaatacaaaaattaaccaggtgtggcagtgcgcacctataatcccagctacttgggaggctgaggcaggagaatcgcttgaacccaggaggcagaaattgcagtgagccgagattttgccattgcactccagcctgggcaacagagtgagactctgtctcaaaaatttaaaaaaaaaaaaaaaaaaaaaaaagatgataaaaaggccaaatagtattatcttaccttaaacttttgtgcttttataaatttagccaaaacaaagcaacaaattgactcaatttaatgacttgaagcaagcccaagccccttcaataaaatctccgggaaatcacggcaagacagtgctgtgtggcactatgtagtcaacacctgtctcctccgcaccatgcccctgccccagacagggttttcttgacagctagaaaccatgtatcatttgaagttcctgtgaggtttcacagaagctgctgaatttggaaaacatagcgtgaggattacttctgtggattccttaggaagccatcaaccaatttgtgggactaaatagaatattttatcaccagcaaccatttaagcatttttgatcacctacatacttttgatcagcttgatgttggcagcatagaagtacagcaaaattgcatattatattttctgagaaaatgcatttttctcagaaaaataaaaataattctgcaaggggtgctattgatactatacttcagatttggtgtaagtttgatgagcttttgtgggcaggtcattcataatggctgcaagctatagataacaacatttgcaaatcaatttggagacggcaacctcagtttaaacagggttctgcatacagagcctacaattctaattaccgtaatctggctgtgaacctgtaagggggataattataacagaaaatgacttggaacatttctagacaaaataagtaatataaaaggtcatgctacaatgagttgagaggagggacaggtcacttcttaatatgttggttgcagaagatctcaccaagggaatatacttgatttggaactagaaaagtgggtggcattttagaaggtgagaaggcattccatgtgagcagaatcacatacgcatgggcaaaggtcaggaaacaagctagagacagctaagaagtcatcatggaagaatcttatactgcagcatagatttaaagttggagatccatggctaagtatatagagcttgattcgagattgattttttccaaaagacctgattaaaaacaacaaaaaaagagcaaacattaataacactttatttatgtgtatgtgttctagctacagaaaagcaacttggtgcttcctatttcagtatgttggataagctcattgcagaagcttttgagtcaatggtactactgctttttgatggaggatttcatatgttttcagtctatgtcttgttaaagaaaataggcaggatctctccatagctgaaggcctaactgcaatgcctgtgttactggcagataacaagttgtctcagtgactccttcccagctgggcagtgaaggagaaaaataggactttatgtttggtgccagttattatgacttgaagaaaaattattcctacagcacattcttcctgtctattttgaattatcagtgctgtatcttttatgtacaactacatcttaatgactttggtgtctgaattctgtaacatttgagcagcttgtctttcatacagaagacaaaaaggctgctttgactcgataactcaatgtgactgtgactcagtagcccatggaatgcgattagcattgagcacaatgtccttgaaaccaaactttccacacgctccaggtgatatcctgatagatatttattcaagcattaaatattgcaaaagcttaagaataaagcaactatggtaacccagcactttgaaacacacacacacaggccacacacacacccctctattcctggaatgcttctaatgtatgatcaatcaattaataaaggcaaaaatgctaatccataaatataggcatatccatgactttaataaaatggtatcaggcagctgaagcacgatatagcaatataataggatggtaggctttttctctttctctcatagcacttctcacatttttaaacactgtcttgtttacttacttttttttgtattttctttctctctacttactttatagattattagcatcttaaaagcaggcatttatgtctggtttgctcatttatatgttcaaaacacctagagtagtggcagacacataatagttactcaatagtttctgaatgaatgaatgaatgaacagagaatgccctaaaacaaaatcacctgaaatcttacattcttaacatggcaatcattttcatttctagaaggattctgatttaatattttttataagaaactatttctaattttgttttaattttttaaaatgatgcatattatatgtatagtgaaatgcagagatattacatgttacagttctatgagttttgacagtgcaaacacctgtgtaacccacagccctattaagatacgtaacttttccatcatgggaaaattcccatgtcaactccaaccctccattccagagaaccacttttctcattttttcatcatagattagttttgcttgttctaaaactccatataagtggaatcataaaatatgtatttcttgtgtgtctggcttattgtggatcacacattgtttatgaaatttatccatttatagcatataaagcaaagtagtaccttttttattactgagtagtattctatacacaaaaataccacagtttgtctatccactctattcattgatgaactttggattattttggtgctattttagataaagctttcatgaacattacggcacaagacttttttttggtcaacatatgttttacttctcttggtaaataggcataggattgctgggtcataagttgcatgtatttttaactatagaagaaactgccaaaatctaaaatagttgcgttactttgcacttcaaaaagccaacatataaaaattccatagcctcaccaacatctgctcatgtcagtcttttaaattttagccattttagtgcatataggagggtatttcatgatgcctttaattcatatttccatattgactaatgatgtcaagtacttttttttttttttttgagatggagtcttgctctgttgccaggctggagtgcagtggcatgatctcagctcactgcaacctctgcctcccaggttcaagagattctcctgcctcagcctcccaagtagctgagactacaggtgcagtgccaccacgcccagctaattttcgtatttttagtagagacggggtttcaccatgttggtcaggatggtcttgatctcttgacctcatgatctgcccaccttggcctcccaaagtgctgggattacaggtgtgagccaccacaccctgccgtcaagtactttttaaatgtgcttattggtcatttgtgtatcttcctttgtgaagtgtctgtttatgtcatttatctgtttttaaaaatttattttttgccttttatttgagatgaggtagaaggctttcacgtattatggattcacattctttgttgaatatatgcattatgaatattttctcctagtttgtgacttggctattaattttcttaagcccttcaatgagcaggcatttttaaattttgggaggctaacttaacttttttattcttttataatcattgctttttgtgtcttacctaaaaaaatctttgcctgtaccaagatattcttgtatgttttcttctacaaatttcatagttttaacttttacatgtaggattatgatgtatctgaaattaatttttgtgtacagtatgaagtaaaggttaaaatttatttcatttttatatatttacacagttgttacagaaagttgcagaaaatatttacttttcctcatcaaattgctgtgaatgacctttgttgaacatcttttgattgtgtgagcctatatctggacaatttattctgttccatggatctctttgtctttataccagcaccacactgtaatgatttttcagcattctagaagtctcgaaatgaggtagtgcaagttctccaactttcttcttctttctcgagattatttggctgttctaaatcctttaaatgtctatataaattttagaatcaatcttgcataaaagctttgttggaatgttgaatgggattgaattcaggctatagaccaatttgggaataatgtatttaaattcttcaaagtatcgagtcttccaatccatgaacatcctctatctctctattcatttatgtttaggttgtataggcaatgttttgtagttttcagtgtaaaggttttgcacatcatttgttaaatgtgtcgccaagtacaattgactcttgaacaacacaaggatcaggggcaccaaccccctacacggttgaaaatctgcaaataacttttgactcctcaaaaacttaactactaatagcctactgttgactggaagccttaccaataacatagttgattaacacatattttgtgggttatacatactttatactgtaattttacaataaagtaacataaataaaatgttattaagaaaatcatcaggaagagaaaatatatttactatatgttaagtggaagtactcatcatcttcatgttgagtaggtggagtaggatgaagaggaggggttggttctgctactcaggggtggcagaggcaaaagcggtggaaaaggtggaaggagaggcagacagtcaggcactctcggtgtaactttatgaaatacatcatcatttatttgacttttttgcttttttatttctctaaaaatgtttctctacagtaccagtccttccattgcttgcttttatttcagtatctgtatcatataagggcccatgtcataaaagaagtcaaaaagcagtcttgaatcattggaccccttctgccagattgtctaacatcgacttgttttctggcactgcttcttcaatgtcttcttcctcgtcatctggcactggctcagatgcactcacttccatcaagttgtcttctgttaattcctctggtgtagtgtctgttaggccttagattccaaactttcataatgttttctctatcagagttctcttccatagtgtccacagtcctgtccatagagtactgtgtgtaatgagccttaaagttcctgacccccctgacctatgggctaaattaaatacattgtgtttagtcaggggtaaaccactttgacaccttcaatgttgaatttatggtgttctgggtagtcaagggcattgtccaatataaaaaaaaaaaaacactttaaaaggcagttccttactggcaaggtacttcctaatttcagggacaaagcatcgatggagccaatacagaaaaatggttgttgttgtccagggcttcttgtacagccaaaagactggcagctggtgtttatattttcctttcaaagctggtggggaaggtgggtagcagctttatagataagggcagtcctgatcataaacctgactgcatttgcacaaaacagtagagttagcctatcccttcctgccttaaaccctggtgcttgcctctcttccttactaataagtgtccttagtggcattttttttccctagaatagggcaattttttctgcattaaaagcccattcaggaggattattttctttttttttcttttttcttttcttttttttttttttttttgagacaaagtcttgctctgtcaccaagctagagtgcagtggcgctatcttggctcactgcaacctccgcctcctgggttcaagcaattctcctgcctcagcctctggagtagctgggactacaggtgcgtgccaccaagcctggttaatttttgtatttttagtagagatggggtttcccaatgttggccaggctggttccaatcctgacctcaagtgatccgcctgcctcaaacttccaaagtgctgggattgcagacatgagccactgcgcccagccactcctcaatagttttcttaatgatgcctgggaactcttctgctgcttctttgttggcagaagctgctcctcctattatcgaaccttcccttgctggcattaacttctacagctttagatccttcaccttccttttgctttaagttgtcatacaatgaattcactttttctcgaatcatattaggtatgcctttcctatagcaatcctgcactcacataaaagctgcattttcaatatgagggcaaaagtatttctcataaagttcaaggtttttatgcctgctgatgtagctatagcaacaacttcataaatttctttttcttggtttttttttttgttgttttttttttttttaaataatggaccttatgctggattcatttatcttgaagtggcaagcaaccaatctgaagatctccatccataatatatatcaaatcattcaacttgttcttgtagccatgagtttcctgtgcttcttaagagcacttccagcatcacgagttacacttagtatagatcccatggtgttattcaaggtttccagcattgcattaaacatgatgaaaaacacatgagaacctcgagagatcactttctactgcagtacacaatttactggggagacaaactgcttacgtggagatgattagcatcacatggcattgtaagtggatcctcacaatacttgcgctcattgcaacaggagatggttatgaaattattgcaggacagggccgggcacggtggctcacacctgtaatcccagcactttgggaggccaaggtgggtggatcacgaggtcaggagactgagaccatcctgattaacactgtgaaaccctgtctctactaaaaatacaaaaattagccgggcgtggtggcgggcgcctatagtcccagctactcgggaggctgagtcaggagaatggcgtgaacctgggaggcagaacttgcagtgagcagagattgcaccactgcactccagcctaggcgacagagcgagactctgtctcaaagaaaaaaataaaaataaaaaaaataaaaaaaaaagaaattattgcgggccagtgtttactaccttaactttatgcagctatgatttaatactgcatctttacatttctttacatttcttttgactacaaatggcgccatgcgtgcagtctgtgtatatatgtgaaagttttgataactttcaacttttaataatagatttgtgtgtattttataatagtaaatataaaatagactagtatctacatatattttaggcattcatgacatacctaatttttattaattttttgatatttctaggctttgtggttctctgctttctcatattgttgcaaatctccagattttttccgatatattgattgaaaaaaatgtgtgtataaatagacccatgcggttcaaacttgtgtcgtttgaaagtcaactaaattttgtgttgtttaaccctagtatacattgtattgtagttttgaaactttattttgtgtgttttatttttatgtgttgctgatatatagaaaatgaaattgaattttgttcattggccttgattcctgtgacttccacataactttctacttgttattagtatatactttaatagtgcaaataatttcctccttttgtatttttttaattttcacattaatcattgggaaccctgtgaaattgtgttattcttgcctttgcttcaagtagcaaatcaaatttttaaaaataaaattatttttatagattaacaaagaattataaatgaggttggcctagatggttatgaatatgcataacttgattgctgactcaactctagtgttatttgttccagaaaaagatgatacctgtctctacttccaagttttaaattaataagaaaaaagtcttatcttcctgaatatgtaatgtaatgtagaaaacaaaggaagttattgagttatggaattataaatttcgatggtctgaaagtactttagaggttttctttatagattaaattcttcttgccagtataaaacacagatagaaggcagtttcttacttagaaacagtggcaatgtaaattataaaattatggctaggttaagatagaatattcattttgcagacctttatcatttattcttttaaatactttaggatggaaaaatgcacagttattttattgttgcagaggaaacgagactattctattgtaattctcatctgaagacacagaacaaaagaattcattaaaaaatttaataatgtttccaagaaccgtaagctgagctgtgctggaaaagacagtcaatatcattgaattatatcccttctttttacagagaatgattctgaggcccagagacgtgaagtgactgtccccttctaagttcagggtagacccatggctcctcactgagggtgtcacaatttctggtgattcatcattgaccacccagaatcctgagtaattaactcttttgtttaaacagttgagtttgggagacttgaatattttttgtgtagaaaacttgctttgaactgaagtatagaataagcacagccaactctgagttttctgggaatggattatttgcaacacgcattatgtacctttaacaaaggactttcccccacattcatgacttcatctcagctggagtgaacatagccatgcaaagaactgtagtcactattcatgggggcctgggtgagagaggcaaagttctagaaagagaagacatactgctggagaggcccctagaatgtacaatagctccccctgtaatgcagctgctgcctctctgtgtggaaatggggatggattgcaagaggatgcaggcagcttatctaggacttcaaatcatgaaagtagtatgtgcgacagagaaacagatttgccacaagataagcagaacctggtggttgagaggctttacattttttgttttttttgtgtgtgtgtttttttgttgttgtttgtttttttgagacagtcttgctctgtcacccagcctggagtgcagtggcgcaatctcagctcactgcaacctccacctctcaggttcaagtgattctcctgcctcagactcctgagtagttggaattacaggtgcccaccaccacgcctggctagggctttacgttttgaattatttctgctgtgagctttcaagtgacagaggattaactgcttcatattttcttccacttaaccttggcatggcctttgtccacatctcaggcagtggacatcttagtcatgtcaatgtggtgacacttttctaccttcaggtacccaagttacctgtgcatgggcactcaggctgtgggtctgctccaagaccaatcaaaggaaagacattctaggtaaatatcaatagcaataattattttaaaaaagatttataaggtaaccaatgcaactattgctgtgcaatcattacctccaaacttagtggcttacaacgacaaatgacacttctcatctctcacagtttccatgaggggatttgggagtggcttggctcagtgattctgccttgaggttcttcataatattgtaacagagacatcaaccagggctgctgtcatctgaaagcttgaacgaggctggagggtctactcctaaagccagctcattgcattctgggtaataggttagtggttgccaggcattgcagagggcaggacagatggatgataatggggtattggaagcataatggaaattatacttggatcatggtggtggcaacctggttttatggttttgtcaaaatctgaatagctatgcaccaacaagagagcagtgtgtacatttaaaaagctaagtagaagaagagagaaaaggcagctcactcacacacctggcttattggtgagaggcctttgtctccttgtgggcctctccttggggttttgaatgtactggtgttgtgttcgctggcttcctacagagtgagtgacccaaggcagcatctggaggaagctcccctttctattacacttgaaggtctctgagcaccacttccacacattctatttgttagaacttcttcatatcacccacagtacccaaaacaaggtgttgctgatagaagtcctggaggatcggtctccctcctgtcacccagtggaaaaactacactccacattctccactgtctgtggtacagtcagaattatgggtctcaaaccgatgattcaacattttcaagtactgaatacttgacagaaactagtgtcaaataatatgtactttgattacatttaatcaattaaaataaaagcattagttctctttatactaatattttcaatctctgaaagctgtatgtattgtatctagttaagaatcagcagaaaataggacccttaaacacatacgataattatagaacacaattctaaattaaatgttagtgaagaggtgccagagaaaatactcagcttagattacacctggttatttttgcattattatttttaatgtgttttgacacctcagctgttctatgtagactcactctgatcttcagagcccacattttggattagataattaaactgcttaaatggctcatgttcctgtcatattattggggtaggaatgaagtgggaaaatagtgtgatatagaagagataattttggttctcttattttgtcattcattcattcattcacttattcaaacacactaagttcctgttatgtgagaggccctgtgcttgaatttataagggaatgtgactcatcctctaatctcaaagggtttgaagtctgaggaagggagggggagaagataatatctttattgaaataaacgtaacacaaaatgtgaaaaaaaagcttgggagccctccaaccacaatgctttgggaatggagaacacagaaaaaaacgacttccaacttgaagttagcattgagatatgtagaagttggtggctagtttccctagagcggagagatcagcatgactacaggccagatggggaagggtgatcataactagcattcaggtcagatgggaccttgggttagatgaaggtaagagaaggctgagaagacagattggaaccaaattgtaaatggccttgcatgtcaggcaaagcggaactgtatttggtggccactgatgtgtttttgagtagagagatgaatacttgtcagtagaggatgtgatcattggaatgaggagattctgaaagccaggagaccaaatcgaattcatgcagaggcctgctgagggcctggaggagaccaaggcagaggtcaagggggaaaagtggaacgagtgaaagatatatttcttggtgcactattcagagtgctctcccagttagcaaaatgaaaatgagcctgtacattagaattctcaaagacaccttgacaaggtcaacgtttcctattgggaactccaataggaaaaacagaaatgtaatgagtaacatgagtaataatttagatttctgttcagtctcaaatccaacaagaaatgtaattgatgaacattctcagtcgtgtgtttacatactataggggcattcttccttcagctgggatgggttttgcctgttattgttattaatgaagctaataaatggaacactctctaaagacgcttggttaagtcttccatcatcactgactaggttccaaaagagatgagagcttggcttctaaaatgaaatcatttttgcactactgcatccatttatgcactgtgggcaaactcaagcaggaaattagaaacctatccggattttaaacattagagtcagctactacattggaaacagccctatatttgaaatatggaaatactgttctctgttattagatgttgaccaagaaaagggcaaaagcaacaacaaaacacccctactcatatccaaagtacttacctgggccgggtgtggtggcttatgcttagaatcccagcaatttgggaggccaaggtgggaggattgcttgagcacgggaattcgagagcaacctgggcaacatagtaaagccccatctctataaaaaataaaaaaaaaaattagccaagcatggtggtgcacacctgtggtcccagctacacaggaggttgaactgggagaatcacttgagcctgtgaggcagagattacagtgagtcatgactgcaccactgcactccagcctgggtgacagagtgagactctgtctcaaaacaaacaaacaaacaaaaaaattaacctgttctttagttaccaattttgtctacattgaagaagctgacaatatcatgtgaaactgctaaccaattcatttttctcctcagtgctctaagaccctcccttcctgggtgttgactaaatatctctattgtttagtttaagctcaagaacgggtgtagtattttgcaggagctcagcatagtggtttcataaggttctaggaagacgtatccattatgctgcctctgaaaagctgtgggcttttttgtggcccacattcatttgacaaaacaagagatccttgtgaaaagatgcaaaatcaggagaaacctgtcctagaacaaatgggaaactattttgtttgtttctaaaattataactttaactccatagaaaaaagtagccttaagtgtcttttattttaaagctgctgcagatggacttaatcccagtagatgggattctctaagtgattgtgaactgagattatggtataagaaacaaatgtcaggtttactcaaagtagaacatacctattgacgtatttgtttactatctcattttgactaatatttaataaacaccggctgggcatgatggctgatgccggtaatcccagcactttggcagggcaaggcaggtggattgcctggggtcaagagttcaagaccagcctggccaacatggtgaaaccccatttctacaaaaaatacaaaaattagccgggtatagtgtgcatgtctatagtcccagcttgtcaggaggctgagacaaaagaatcgcttgaacctgggaggcggaggttgcagtgagccatgattgtgccactgcactctggcctgggcaacagagcaagactctgtatcaaaaaaacaaaaagccagatttactccaagtagaacatacttattgatgtatctgtttactgtctcattttgagtaatatttaataagcacctactgtttaacaggcatgtgataaaccctggaataccaagatgccattgtcctgatatctaaaaaaagacatgctttctcttttaaaagtccatatcattgtgatttccgaggcaaataaaatactgtgaagagctttttacctgaagatgtctggtatgttttgtgtatataaaagcatagagataaggtaaagaaagaaatgaacaaaagctgagctcattcagtactctacaatttgcttttcaaatagattctgctgctggccattatcatcttatgtaaatgtttccccaagaaaatggggattttatagttgaggttgaggtaagggaggaaacagcagatgtcctgataaattgcatctgaaacctttgtatgactctatacccaggaccaaaactgctacctgaaaatggagaaattaaattctatggtgctttgctacagtggagtcaccttagagaaagagctcttcatttgtccatccatgagtcactcaacaaatgcctattaggtggttattatgtaacgggcactatacccagtactgaagatacaataatgaaaaagggatggttctttccttcaggaaacttctaagctagcaggtaatgcaagcaatctaacattatttgaaggatgctttttagatcttcagatgatttgcatatctttactgtaagaataggaaaacttcctttaaaatcttgaaaaagccacttcaacttaaaaatacacaactaaagatttctttacaaatattgcagctggtggtttgctgccaatagaaatgttacttaccgaaagagatcttttatttagaaggtgagtatgatgtctacattagataagtgggttcctagacccgaataataaacaaaaatatgcaataacttgaatttggaacctatttttacaaagtatgacaaataatatgtttactgaaatagctaatgggccagtggcatggtagcacagcttttcacagatacccgctggcaaactgttaaatgatttgcagtgagttatcaaggattactgttttgtaaataagagtcctgatttcttttgcagttatatgtaaaagaaaggcatctatcactcaatataaaccctactgcaggaagtatagttttacaaagtcctagtgaatcagtaaggttcagcgtagtggattcagggtcataagccctaaatctgagtcctgcttttcctactaagtaactgtgagaccttgatgagttgcttcatctctctgggcctcagtctcctctcagaaacgaaggtgttgggataggtgatctcttttagcattgtagtccatctagtttccttctaggtcagtctgtaccacagaggaacaataaattgtgagtctgtgaacttcgattgtgaataattgcacctccagaatacgtgaaatatcagattgttcaagcttatgtttaatgatgcactgaccctaccctgggaccacaaaaaaaggtttattttgtcccctctccattctgtttgaccacccctggacttctgcatccaggggcaatgcaaggactcaaggcagctatatgttcatagcaaagagctttttattatgatttggcttgagtctggacaaactgtatgttgacttgtggccctaagcaaaacaacatatgaggaactttggaggtgtctcaacgcactccctcatgcctaaaacttgctctctaccctcaaggggcaatgtctactaaatttattgactcctgccctcatctcgtttccgtttcataatctccttcactttaaagtgcacacttaggagttttatattttcagcttttagatgtaaaggttatttagtggagtcgtcagtggtcttggcatctgcagcacatgcacacactcatgtacccacccatgattcctgatcatatatgttgtttctaattgtcactcatattttccaagtgtggttaccatgcgaatggaagtcaccattgctgcaaccacgtcttggggatccatttctactaatgctagagtaatcagaccaacccttctactgataatatttgtaaactctggagaaaatataaaaatcatctacttgaagacaatggggagcaatcaaaaccaggcagaaactggagggaggtgaacatttggaataaggaaagaacattgagtgagttttccagtttttgtggctattttcctcagggctgatccagtcagcagcaagctggctggctggaatataggtaaaaacccacagtcttactggcttgaagaccaaaggagagagctctggggaaccatagcactggaaagtaaagccaaaaattcaagaaaggggaaaatcagagttttgtgtttgtgtgtgtgtgtgtgtgtgtgtgtgtgtgtgtgtgtgtgtgtgtatgtgtctaacgctgcctaaacctgtccttgataactaaacaatgtaccaatggagccaacgccagacatcttagctcaagctaaaagtactgagcagcaatttcagctgcttcacacacacctcccaaccccccatgccccatcccaattcccacaccaccgctaccacacacacatcacaggggaacagaatttggagtttgacttcacctaagtttgctgccggctttcaaaatcgatgttctggaggaatataagagaatccaaagtttatacaatgtatcattcataatattcagatgcagtcttacattaatatgcataggaggaactaggaaatgtgactcatgctcaagagaacaagcaatcaatagagactaatactgagataatccagctaatagaatgcgaggatttaaaagtagctattataattatgctcaaggatataaaggaaagtatactcacagtgagttagggaatagaacattaatcagcaatagaaacaaaaagagccaagagaatctgaaaaataaaatattcaaagtgaaaaatatacatggagtttataacatgaattggatttaaagagagtgaacttgaaattaaataggtactatctaatctcaagaacacagagaaaaatatttttaaaaattaaaacactgtgtgtgggacaatgtcaaaagtctttcatatgtgaaagaaacacatttgcatgtttaagaagctcatgaatcctaagtaagataaatataaagaaaactacacctaaaattattacatacattaattcctcacttaacgtcttcaataagttcttggaaactgagactttaagcgaaagccctacagcaagtccttgaagaagatcattttgttcaactttgttttgttgatgagaaaaaaatcatttctttatacattgtctcattaaagtcacaatttctaagaacatattgacaacattaagtgagaacttactgtacataatggtcaaattgctgaagaccaaggagaaagaggaaatcttgaaagcagtcagagaagaattacacattatatagatgtcagcaacaatatgaatgataactgatttctcattaaaacaaaaaattaaatccaggattgagtgaaactctttaaagtactgcaagaaaaaaaaaagcctgttaatcagtgaaaatattcttcaagaataaaggtgtaataatgacatttttaaatcaacaaaaactaaagaatttgttgccagcacatctgtagtactggaaatgctgaaagaagttcttcaggctatactgaaataccagaagaaaaatcagatcttcaaaaaggatggaaaatgaccaggaatgataaatacgtgtattagcataacacgctttctttgttcttaatttctttaaaatacatacgatttttatgactcctttaagaaactgagacatacccagctacttgggaaactgaggtgggaggatggtttgagcctgggaggtagaagttgcagtgagccgagattgcatcattgcactccagcttgagcgagagagccagaacctgtctcaaaataagtaaataaataataaataaatactgagacataattcacacaccataacatttaccattttgaagtatacatttcactggtttttagtatattcatgagattgtgcaactgtgaacaaaattaattttagggtatttcaccatttcccattattccctcaccatagccccaagcaaccactagtctaggttttatctctgtgggcttgcctattttggacattttatataaatgtaaatgtaaaatatgtgccttttgtgtcccttttttattgatacataatagttgtacatatttatggggtagaggttttttttgatatatgcatgctgcctgtaatgatcaaatcaaggtagtctcgacattcttcacttcagatatttagcataatgtgtttaagggtcatttattttgtagcatgtatcagtacatcattcatttttattatttaatgatattttattatgtaggtacactttttgtttattcattggtggacattaagttgtttctatactttgacttatgaataatactgctaggtacattcatggaaaagtttttgtgtggatatatgctatcagttctcttgaatatatgcctaggagtagaattgctgggtcatatgataaccctatatttaacttattaagtaattgcaaagtgtttgcaaaagtgattgcaccattttacattcccaccagcaatgtataagtgttccaattcgtatacatctttgtcaacacttattatctaccttctttattctgcctatcctagaatatgacatagtaagtcactgtggctttgatttacttttttcctgatggctaatgagattgtgtcttttcatgtgtttattgaacatttgtagttcttctgggagaaatacctattcatatcctttacttggtcttcaattgagttatttgccttttattgttgagttgtaatagatttttatgtagtctggatactggattcttatcagatatatgattttcaattttgtctctcattctgtggacaatctttcaatttaaccatagcatttgaagcacagacattttaaattttaattaagttccatttctatatattttctgttgttgttgtttgcatttttttatcacattgaaggaaatattgcctaatctaattgtcacaaagatttacctcaaaattttattctaagagtttcatagttttacttcttacatttatgtctttgattcattttggcttaatttttgtatgtgatttgaagtaagaatccaactttattcttttgcatgtggaatttagttgtaatggtaccatttgttgaaaagacttctcttattgcattgtcatggcacctttgctgaaactcaatggaccataaatgtatgggtctatttctggcctatcaattctattccattaattcatatgtcttttttttttctgcaacaccgcacaatcttgattactgtagcattgtagtaagttttaaactcaaaaagtgtcagttctccaattttgttctttttttttttccagacttttttggtgttttgggtttttttaaattttcatatgaattttagagccacattgtcaatttctccaaaaaggcagctaggattttggtagggattgtgttgactctgtagataattttgaggaatattgccatttcagcaatattaagccttccaatttatgaacacaaaatgacttttcatttatttaggttttctttcaacaatatgttataggtttcagtgtgtaagtcttgcatgtgttttgttaaacttattcctaatttttttacacaattgcaagtggaattgttatcttaattttatttttggattgctcattgtaaatatgtagaaatataattgtattttaaatataaatcttgtatcttgcaaccttgcagaacatatttcctagctctaatggttttatgtgctgtgtgtgtgtgtgtgtgtgtgtaggtattccttaggattttctaaatacaacatcatgttatctcccaatagagagttttactacttcttttccaatatggatgccttttatttaagtttctttcctaacggtactggccagagcctccagcacaatcttgaatagaagtggcaagcatgggcatacttgtcttatttctgatcttagggaggaagcttttaattatcactatgaagtatgatgtcagctgtggattttttcttaaatactctttatcaggaggaattttctattacagtttgttgagtgttttcagcatgaaagggtgttgtgctgtgtcaaatgccttttctttatccattgagatgatcaggcgatttttatctttaatttattccatgaattacatttattgattttcatacgttaaaccaaccttgcattcctggtgtaacttccacttggttatagtgcattatcatttttaggtttctggatttagtttgctagcattttgttgagaattttgatgtctatttttattagaaatgttggtctgtagttttctttttttgtgtgatgactttatatggtgttggtatcagggtaatacagacctatagtgaatttgtgaaatttcagggttaaacaatgaaaaagatatgaccagcagcacacatgagctttatgtatgtgatgctttgataggcttgtatgcaagggaagtgcctcattgcatgcatttcacaggctacagtgtgaggaccactatccagaacaggaggaggttcaggaaacttctaaaggagaagataatcagagaggggacttgactgtataggtaatggtgctcagcagcatggcagggagtctctgggctagagagccatgaaggcagtggtggctttgcatcttttatagctacaagatttattttgcctatgactagcagatgttgagcacagtttcacaggttatgcaaaacaggcaggctcaatgtgacaaaaatctgcttacctggctctatttaatacaaatgaatgcataaaaaatttgaatttggttctggtggattttgtgctaacagatctcagcctgctatgaaggaggaaccaacccggggccaacatacaggggccatctttggctcatttatatgacagcaacttatagagtgagttgggaagcatttcctcttttcctgtttttagaaagactttgtgaaggattggtgttaacttttcttaaaatagtagaattcaccaatgaagccatccagtctgactctttttttgtatgaaatatttttgatttataagtcagtgtctctacttgttataagtctactcacacattctattttttcctgagtcagttttggtagtttctttcttctatgaatttatctgttttaagtaggttgtcttatttattggcatgcaattttccatagtattaactaacaatcctttctatttctgtaagatcattagtaagatcattagtgatgtcctctctttcattttttagtttagtaatttgtgagttatctctttcttgtcaatttagctagatatttatcagttttgttgatcttttcaaataatcaactttcagttttgttgacttccattattgtttttctataatctatttcatcttcttctattctaatgtattatttccttccttctgctttcattgagttttttcattgagtattttgctctatttctagtttttaagatagaagtttagttattgaattgagatctttcttatgtttttaaatgttttatttatagttataaatatcccttcaagtactccttttgctgcatcctgtaagtttggatatatcgttttcattttcatttatctcagtatattttttgctgtccatttttatttgtaacttgatctattggttatttaagagtgtgtggttcaatttctacttatttttggatttctcaaatttcttttttattattattattatactttaagttttagtgtacatgtgcacattgtgcaggttagttacatatgtatacatgtgccatgctggtgcactgcacccactaactcgtcatctaacattaggtatatctcccaatgctatccctcacccctccccccaccccacaacggtccccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctatcatgaataatgccgctataaacatacgtgtgcatgtgtctttatagcagcatgatttatagtcatttgggtatatacccagtaatgggatggctgggtcaaatggtatttccagttctagatccgtgaggaatcgccacactgacttccacagtggttgaactagtttacagtcccaccaacagtgtaaaagtgttcctatttctccacttcctctccagcacctgttgtttcctgactttttaatgattgccattctaactgctgtgagatggtatctcattgtggttttgatttgcatttctctgatggccagtgatcatgagcattttttcatgtgttttttggctgcataaatgtcttcttttgagaattgtctgttcatgtccttcacccactttttgatggggttgtttgtttttttcttgtaaatttgtttgagttcattgaagattctggatattagccctttgtcaaatgagtaggtagcaaaaattttctcccattttgtaggttgcctgttcactctgatggtagtttcttttgctgtgcagaagctctttagtttaattagatcccatttgtcaattttggcttttgttgtcattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccaaacatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgatttttcctacccatgagcatggaatgttcttccatttgtttgtatcctcttttatttccttgagcagtggtttgtagttctccttgaagaggtccttcacatcccttgtaagttgcattcctaggtattttattctctttaaagcaattgtgaatgagagttcactcatgatttggctctctgtttgtctgttgttggtgtataagaatgcttgtgatttttgtacattgattttgtatcctgagacttggctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctgtccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagttttcagcctgaagggttgttgaattttgtcaaaggttttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggttttggtatcagaatgatgctgtcctcataaaatgagttagggaggattccctctttttctattgattggaataatttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagacgtgtttgtagtattctctgatggtagtttgtatttctgtgggatcggtggtgatatcccctttatcattttttattgcgtctatttgattcttccctctttttttctttattagtcttgctagcggtctatcaatttagttgatcccttcaaaaaaccagctcctggattcattaactttttgaagggttttttgtgtctctatttccttcagttctgctctgattttagttatttcttgccttcttctagcttttgaacgtgtttgcttttgcttttctagttcttttaattgtgatgttagggtgtcaattttggatctttcctgctttctcctgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattattaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatatgggatggagagttctgtagatgtctattaggtctgcttggtgcagagctgagttcaattcctcggtatccttgttgactttctgtctcgttgatctgtctaatgttgacagtggggtgttaaagtctcccattcttaatgtgtgggagtctaagtctctttgtaggtcactcaggacttgctttatgaatcttggtgctcttgtattgggtgcatatatatttatgatagttagctcttcttgttgaattgatccctttaccattatgtaatggccttctttgtctcttttgatctttgttggtttaaagtctgttttatcagagactaggattgcaacccctgcctttttttgttttccgtttgcttggtagatcttcctccatccctttattttgagtctatgtgtgtctctgcacgtgagttgggtttcctgaatacagcacactgatgggtcttgactctttatccaatttgccagtctgtgtcttttaattggagcatttagtccatttacatttaaagttaatattgttatatatgaatttgatcctgtcattatgatgttagctggttattttgctcgttagttgatgcagtttcttcctagtctcgatggtctttacattttggcatgattttgcagcagctggtaccggttgttcctttccatatttagcgcttccttcaggagctgttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagaatctttgtggcgttctctgtatttcctgaatctgaacgttggcctgccttgctagattggggaagttctcctggacaatatcctgcagcgtgttttccaacttggttccattctccccatcactttccggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagctcttgagccttggttttcagctccatcagctcctttaagcacttctctgtattggttattctagttatacgttcttctaaatttttttcaaagttttcaagttctttgcctttggtttgaatgtcctcccatagctcagagtaatttgatcgtctgaagccgccttctctcagctcgtcaaagtcattctccatccagctttgttccgttgctggtgaggaactgcgttcctttggcggaggagaggcactctgctttttagagtttccagtttttctgttctgttttttccccatctttgtggttttatctacttttggtctttgatgatggtgatgtacagatggtttttggtgtggatgtcctttctgtttgttagttttccttctaacagacaggaccctcagctgcaggtctgttggaataccctgcgtgtgaggtgtcagtgtgcccctgcttgggggtgcctcccagttaggctgctcgggggtcaggggtcagggtcccacttgaggaggcagtctgtccgttctcagatctccagctgcgtgctgggagaaccactgctctcttcaaagctgtcagacagggacatttaagtctgcagaagttactgctgtctttttgtttgtctgtgccctgcccccagaggtggagcctacagagacaggcaggcctccttgagctgtggtgggctccacccagttcgagcttcccagctgctttgtttacctaatcaagcctgggcaatggtgggcgcccctcccccagcctcgctgccaccttgcagtttgatctcagactgctgtgctagcaatcagctagactccgtgggtgtaggaccctccgagccaggtgcgggatataatcttgtggtgcgccgtgttttaagcccgtcagaaaagcgcagtattcgggtgggagtgacccgattttccaggtgctgtctgtcacccctttctttgactcggaaagggaactccctgaccctttgcgcttcccaagtgaggcaatgcctcgccctgcttcagctcacgcacggtgggcgcacccactgacctgcgcccactgtctggcactccctagtgagatgaacctggtacctcggatggaaatgcagaaatcacccgtcttctgcgtcgctcacgctgggagctgtagaccggagctgttcctattaggccatcttggctcctccccccagactctcaaatttcttttttttactgatttctaattttgttccattatggttaaagaatatacttatctgattttaatccatttcaatttattaagacatgttttatggccaaacatatgatttgtcctagagaatgattcatgtgcacttgagaagaatatgtatactgttttttacgagtgaagtgttctacagatgtctctaaggtttacttggtttatcatgttgttcaagccttttatttcttgttgatcttttgctaatcgttctatccatattgaaagtggagtagtgaagtctctaactattacagttgaatgatctatttctcctttaaattctatcagcttttgctttatgtacttttggggctctattcttaggtacatatatgtttatagctgatgaattgactgtattatcataatgaaatgtccttatttgcctctagacaaattaaattaaattgacaacaataaatacaatttattaaatggatacttcttattttaaattggttaatataaattacactgtcaactatataatcgactataaagttgattaaatattaataaaattgacaactatcacataaagaataagactgtaaggtttttatactttatggaaagtgatacaatattaattctaagtagaataaaaagttaaagtatgtttacaataatacttagagaaaccaccatgaaatacaaagaaatatagctaaaaaggtaactgataaataaaaatgatagtctaaaaaattaaattacatgaaaaaaagcacgaagagaggaacagagaagcaaaaaatagatgagataaacagaaaacaagtagtgaaaatggaaatcctaaatttaatcatcttagtagttacattaattataagtgaattaaacacttaaaaagcaaaaattttcagaatatataaaattgaaaacacaacaaaaccagtcctcactgatttctatatattaatggtttataatatatattaggacctatatattagtagtttataatggagacacttctttgtgtgaaattattacaaaggagatgcttatctattatggtgtgaataactcacaataaggagattatgattctagtggtaaataagtgtattatctgtgtatcactttgttgtattattgttacattgctatatacattatatatacatattactgtatatggttatatacatacaactgtgaatactatactttatggatgatttaagtttattcaaagataattttggttttaatgcatttgtatctcatatgaaaattgcacctgccatgaattatcactcagttgtatttagctcacctctctgtatgaatctcagccagtgttggagatgttacatccaaacttgaagcatttcagttatatctcaatcaggcatttccttgaatactttcatcctaaggtgctccagtttttaggctaagaattcttttccccaggcaacaatatggctggacataaagtttctcttctatagatattttcttctccatttttacaaatgtttattcaaataaagaccatcactgcaatggacctatattttctgtgtgttctatttagttttatatattcttctctctaatccatcaaacaaaacttccttaaacacaatattgattatgtcatggtttttcctaaaaccttaattctgccctcaaatactgcttgcttagtaaagttaggttctttcttatctcaataacttaaaattttcattcctatccatgtcttatttatcttctaaataaacattttattttagaatagttttagatttactgaaacatggtgaagatagcacagtttttatatatgccacaaccagcttctcctgttattaacatctcacatttgtcacaattaatgagagaatattttacattattattaactaaagtccatagtttattcagatttccttaatttttactgagtgtcctttttctgtttcaggatcccatatagaatactatattaaatttattcatcacctatttttagactcctcctcttggctgtgacagtttcataggctttccttgttgttggcgatttaatagttttgaaagcactggtcagatattttggagaatgctcctcgactggaattttcctgatgtttctctcaggattagactgggatatgtgtttttgagagaaagaccacagagggaaagtcccattttcatcacatcatatcaagtgtgcatactattaccatgatttattgctgctgatgttgactttggtcacctggctgttgatcatcttggtcactcttagtcatcctgtactctttggaaggaattcattatgcacaccccagccttaaggagtggggagttatatttcacctccttgagggtggagtatctacataaattattcaaaataattctgcatgtgaggtttatctatcctctttgtttattcagtcatttatatttgaataaactcatggatatatttattttatagtttatactataatctaattctactgtgattattttattgttcaaattgctctagattttgctattgggaactctttttgttggctcccatgtgcctttgatatactcaaatcactgtgtgtgtgggtgtgtgtggttttttctgtacttccttattttccagcacaacaagatgctcaaggctcattttgtaaatttcctgcctcagtcctagaaataaccatttctgaaaggagttccagtcctttttttctggagaatgatattagaaaccaacatttgggtgctaggttgcttgcttaggttaaatgattttctcttttttattccatctaatcaaattctttcccttcaaatatttttttaaaatggcatctatacctttaagcttatccatttctctactataagcttagagtgtcctaaatggtttccctcttcaacctattttctacttggcaactatagagatttttataaaatacaaatctcattatgccattaccctggtttaaaaaccttcataatctcagtattgtcctcaggagaaagtttaaacttaatattgctggaaatgtttttgggatctggtttctggtttctattttcctctccagcttcacctcttaaaaattatcaaccttggtttaaactgcatccttactaaaattattttcatttcttatgagcctttgcatagtttttttttcctggaacactgaccttactcctttttttttttttgcacacacacaaacacacagacgcacactcttcactttgtagatttctactcaattttcaactttttgcttaaatgggcatcttttggggagttttctatagaatgcttccaggctgggctcgcttcctctctccaccgggctctgtacaactgtagcactcatcgcaatgggcagtaattatcattttactgtctcttccctctggacggagtttgtgatggcagagaccttgtatctttgtttcatcattgtatgattaacatttagcacaatatctgtcacttgatatgcgctaaagaagtatttatttagtgactcaataaattatccatgggatattccccaccatgctagcttcaggatgtactggtcactgacatatttctaaagaaatatggttttccaagtgtcaaatatgtatttatttttgtaggcaaagcatgcttcagtatgagacatctcctccacaatggaaagatgagaacagttactgaagatcatctgtggttactcatagttaggcatagttcccggctttctttgttcttcattgccaccgtggaaacaaaaggcagatgaaagcttctcgactgcttgggatcagttcttatctagtgtgtgggcacagacatgtgcttggttaaacacactgggaaggcagccatggagaaatgtacaggaattctaaagctgcgaaggaatttacacctgcacctcatagctcagaatagaacatggcctccatggtatcttcaaattccaaaacttctccagtttcatcccaagagttatacactcatgaagaatctgacacaggaacaagtagataaggtttgactttgcctcctcataccctttttttactcagagaaaactttggtatcttttaaatatcttccctagggaaactgggacagtcattttggtctcatgaaatatggcttatatgtgaggtttccagagctgctagaatggaaatgatctctgctccttctgagcatatgcacggcagtgctcctcctctaaatctggtagtatattgtacacattccctccaatcctcttgacttagctcacatatcctggggatggagaaatggagagaatattaatagccctcctctagcagatagcttttctagggaagaggctaaacttgccacaactttgccaggttgttcttatgaaggaagaacatacctgtgtattaggtttgaaaacaatctttaccttggtactagatagagttaatgatatattgtcttaaagggatgaccctatttgacccagtgagaaaactgggacagccaaatggtctgaagtatttggcttctctagtctcctgatagccacattgactgtgtatgtgtgatgtccctctcagccacaatgattaggaagactaaatgtttaattatttttcctactctttgcccttgataacctagcataacttttgttggataccctatattattgaatgttcacccgctagaacagtgcgccatttggtgcaggtatgaatttttttatggcctctaagtttaacagataaagtaccagatgactaattgaatttgaatttcagataacaactcttttaacctgcgtacaataagtatgcaggtatttgggacatacttatactaaaaatctgtttgttatttatccaaaattcaaatttaattgagcatcctgtatttttatttggtaaatttgacaaccttaatgacctgccaactttttcaggtttaaatatctttaaaagtttaaatttcaatcaaataaagagtataaggccattttagagagaggaaatgagttcactttatttttatttattttattattatcattattttagacggattctcgctttgttgcccaggctgcttgttcatgatcccaacatttgtaaagtcatttaaaaaaagaataactgaaaccttatatcctttgactaataaatcctagagatctaataggcagagtgcctaaacttaaaaatactgtattgtatacttaaaaatactgtattgtatacttaaaaatttgctaagaaggcagatcttatgttaagtgcttttatcacaattaaaataataagaataaaaaaagagggcagaggaaacacagaggtgatgaatgggtaagagcacagattgtgatgatggtttcaaaggtgtacatttatctccaaatgcatcaagttgtgtacatgaaatatttatagcttttagtatgccaatcctacttcaatacagtagcttaaaaaataaaagaataaaatcactaaaacactgttttttagaataattcttttctgtacaaattcttgagatgtttaaagtgtgcaaaaaaatctgagcttttctttcattcccatttgtctaacaagatttggaaagtcacctaaccaaaataaatgtaaatgttttttccacataaagtttgacttttttttccattatattgtgacatcaaagcctcagccatcttctcttttcttttaaaaggcttttagcggtaattttgctcatttagcaatgtgcccagttagcacctttgctacacttttatccacagatagattattttatctgctgccttgacacagatctctagagatattggacatatttgacacatatttacaaaataattcttactgtgattaagctagctttagtcattcttttaactgtttaggaaatttggtttgtaaagttgatgaattcttatgcaagtcctgtgaaccctgttctattgtagttgctgctgctgtatagtctatcttttttttttcttttttctttctttttttttttttgagatggagtctcccccatcaaccaggctggagtgcagtggtgcaatctcggcccactgcaacttccaccttgcaggttcaagcaattctccttcctcagcctcccaagtagctgggactacaggaatgcaccaccatgcccgctaatttttgtatttttagtagagatggagtttcaccatgttggctaggctgctcttgaactcctgacctcaggtgatccaccacctcgacctcccaaagtgctgggattacaggcatgagccaccatgcctggcctctatactttttttttaagtaaagggagctaagttgacaaaaacctttttttcttttttctggaactatcccaagatcttcccagaactttccagaactatcaaggcaagtttctgatacatctttaaaattacttggcaaaccaaacctagatatcaaaaaatgttttttgttagtctgttcattagcagacactgcttgtgctgcatttgtgatgagaacaatgcagagaggtgacctgtggaatcatgagagtgcctctgtgcaatcaagatggagccactggcaactgtgccttttcaagtatcactaaataaatggacctattggattctgctgagctaccattctagccttcacatcctctgcaaagtcatccagaacattaagacagatataaggggctagttctgtggttcacacctgtaatctcaacattttaggaggctgaggcaggaggattgcttgggcccaggaattcaagaccagcctggacagcttagggagacttcatctctacaaaaaacaagaaaacttagtcaggcttggtgatgcacacctgtagtccaagctatccaggaggctgaggtgggaggattacttgaacccaggggtttgaggctacagtgaactatgatctcaccactgcacagggtgacagagtgagacctatgtctcaaaaaaatacatacatacataaatacatacataaaagtttaaaaaagaaagatggatataatagaatgagagaggaccagacaagggagttatttgggttagtttttttaccctttttaaaaagttatctccacactttgtgttctctcctagatctttccactgtataataatgtacaatagaatatatacaaagaatgtgtgtgtgtgtgtgtgtgtgtgtgtgtgtaacaaaaggacttaattttgttagtttgagacatgtattcacccttaaagatatgagggttagagccagcaggcaggaactcagatacaggttctctgtaacttcattgtgcgtgttcttgagtgtgtgtgtgtgtgtgtgtgtgttcttgccttctgtcacccactttcccttctgccccctttattttttgtagaaaagttattttggaaaaatccaactttactttgaccccaagaaaaatgagatttttgtctttctattctaactttatgaagaattgttaggaaaatatccttcatggccaagagtcgtagtaattccaaagctcaagactctccactaggctggagcgctaggtagctggagatcccgatgttggctaagggtctcggagtctacctgggcacatcagccccagccaggctttgccatttcacagaccatctccaatctcattcaaaaacccctgggaaactttactggagcacagtctttatatccccaattttcataactagattaaaaattgtgcaaagcagtgatagataagaaatttaaaaagctaaaaaaaaccagcaaagctgaatgcaagaattccttctgaagagtggccggtccatgtttctccaggctcctgtctgcagcatatgtccctcccattgccaggtcagcccaagaagcagcagagtcagacacctggccatggacctggccgaaggttggctggaggggcatcctgcagtccgccagcacagagggtagtatgggagtgcagcaaggctactgtgactaagaacacttattccataatggtatcatcatttaacagttatgtattagactgattgcaactatcgtaaactcacaaaagcttttctgttgacttaatatttataatgtgcattctcttcattatccttttttattccccatacttattaccttgtacatttacacaggattctctatttaaaagaaatccaaatagtggatataatcattgcagagcctctggtttgtgttccattttctccataggatcagaaactttttctgaggccttcacatgcaggcacagcctgacagatgtaaaattgagaagtgggtgaaatttgactttcatgaatgcacttgtttcctctgattccttttccagcctcagagtcactcttgtggtacttgtcttcttggttgccattgattctctgaacactgttccttataacaaacacagatagtctcagagtctgataaatgggtgctttattgtagaagagactcagtggatttcctctcctagcagaggtggcttttaacccttacttgaactgtggaatgaaagactctatctctcattaaatgagtataaattaaagacaaatgtaagatgtgtctattgttttaactttatctttaattgacaaatcataattgcatatattttggagtacaaggtgatgttttgatacatgcacccattgtggaatgatcaaatcaggccaattagcatatctattacctcacatatttatcatttccttggggtgggaacattcaaaatctactcttttcaccattttgaaatatacaatacatgattattaactatagtcactatattgtacaatagatcacgagaacctcttcctcctctctaactgaaatggtgtaccctttgaccaacgtctcctctttatccatttactgatcttgcttcgacctctgataaccacgattctactctcttttgctatgaattcaactatttgagattccacatatgagtgacatcatgtggcatttgtctccctgtgtctggcctagttcactttgcataatgttctctagattcatccatgttgttgaaaatgaccatttttctttcttttgaaagactaaatagtattccattttgtaggttggcataaaagtcttcccaatacctcttaaaatatagcacgtgctatatactattgtactcactagcctcctagggatcagtgcttagtagcaaggtgggtccaggaaggacagctccacctgagtcacgtgtgtggttttcccaggtgttcttaaatgcagtcatttgtccaagttgtcatcatggtctgaattgccttagtgcctctttctattctgtagcttctattgcagcaaaagacccacctagtaactattttaatatggcattggggaatttatgtttctaaaattaatctaattgaatccccttaatctccctctctctctttctggggagacaaggagtggtaggtgcacaacttgaaggaattacctattaatgccttggttgaagtcactttgtccagacctgggttgattcagagacttgactttagaaatcccacatttgctgggatgtcagcctcttcaagtttgagtcagcctcactgtcaataattctgatttggtgctcagcaattcccatgttaactgttgacttttattgtgtttctaaaattgcttccattctgagaatgatttgaaaataattttatgttattttattttgattgtattactgtggcattccctcggaccacttctctaacgtttgcaatttgactgagaaatgtggtttcaagacagagaagacatttcaggacttctgtgtgcccacatgggaatgggaatcacagagtttttttttttttaaaatctatttcattattttttatatttaggactcagactctcatcttctttttggaacttttcaaggtgattattttttcccaggaactacaccttcaagtctcagctaaagaagcaattactttttaaagatacctagttttgcattcggcagctctcagatcagaaataggtattgtgactccctctggagggaggtgttctttaaaaagataaaaagttttcattttaaaagttggcaattgtgtctcatgaatttggtggaattaaaattgatcctggggccccagtccctcattaaagattaaagattcctcaatgctccaaatgttccccattaggctgctacttgatcgtctaagacaaactcttccctgcagaggatccattgtcagtggtttctctttggtactcaaagctccaccttttaattacaagctctcctaggctctgtcagtggtgattgtcaccctgtttctctcctctgatagcccctgaggctctagcagcacagcacattatcctccttttctaagttgttatttgttttcctgaaagaataatggaagcagctgtagaaatgtggaggcatttgaagctgaccttctgaacaccaaaaaaactccactgtaaaggctatgttgattgggtttgtcagaataaattgagcactggctaaaaaacatgatggatatgtgcacaacttgaggcaactctttggctcaatgtcagagatgtggatttttccaaactgaaagcttttgtgcgccatacttcaacccctactgctcagcgaagtcagtttttcaattgcagtccattttgtgagtgcaagccagtttctcaagatgaaaagggctgcacactgtgtgtgtgtatgtatatgtgtatgtgtgcttacgcaatctcacatttctaagacattttctcacgtccactgaattaaaaagcaattgaatattgagaggcatgtatgaatcattgcaggctctttgggggaatatcttgaattttgattgctagacttgttcacagttctgcacaacacaccttacaacagtcggataggaaacttactcaaacgtctctaaccttgaaatgaatctgagccactgctactttttcttgaaggtggtaatagaggcccccaaactgttccagaactcagaaatcttttcctctctccaacttttattaattaggttacagtttgacttttaaaagctgtccttttaaaatgttgcctttcagatcacatccacaaagaccatgtctattagtcatttaccctacaatagcaaatattttttaggggccttttcatggctgtgacaccaaagttaaagacaagatcattgcggatgtagagtaatttttcagaggtgcagaattaataaattaaaaagcagcaattcaaacctcggacttctatgtttaagtctggtgctctgtctgagacattgccaccacgccctcactgagaaatacttaaaatacatatttattgtacctctaataccagggaatagaagtcttgattacttgcatcagaggttgggcatcttggaacagaagtatgcctgaggttgggactgaaatgtgtgtgagagtgtatctgcgtatggtggggtcggggtgctctttgcaaagatgcaagtgacagcactttgaggtgtgagtgtatgtctgtgtgtggtggggtgttcttaagaggcaacaggggattgttagggagagaatgagaggcagagaggcagataaaaggtaacaaggacataatttcccctagttatcctacccactcgtattaaggcccctagcggaagcaatgactaagactcactgaaaatcattccctaagccatcttttatatttcgatgccttggctaagtgatcctctcagaaatcacacaaatgaaattgctttgtacaggtttgggagacaaaacctggaacactgttgtttaccagatttttttggaattcagttacctgtactgtagttgaacagtgtactcatagatccccaggaaattgctgtctttgcctttaaaaagatctctcatcacctaaatggggagacagaatggagacatataattggattccagaaatattgctacaaaacccctataaatatgtacaaattaatatactgcaaatgaagtgcaaggtgctgaaggcatgtgtgtaatggcctcatcagagtctgcaggaagctagattgcaaaataaatcacgcatcagtatcttttctgtaactgtatggatggctccattctttagacgcttttatacacaagcgagttgtatgagattattggcgtttgcttgtttttttgtaaagtgataaggtatcatcagtgcaaagaaggtaattggtcttaagatcaccatggtaaatgattcctcaagaaaggaaacctctaccagcaaacagcgcgcattccctgcccagctccttgcatatagacttaaaacttctggagcctcttaattacatgtaggataactgcttgatgcatgacattattgctttggcttacatttaaatttctgggtgaaataaaggatgtggaaataatctttctgtgggattggtgttataggagtgttctgtgttgtaaaaaatgattttttagagttgagtgcaaatagaaaatatttctctctagctcttttatggggacaaactgaagtaataaaagcctcagattcacttacatcatgcttagatacacagaggaatcaggttctttgtctagacttacaaggtctttttcaggaacctctacctacttgtggaccaggaagaaattaacttcattcagtccagtgctgtttaaagctccgttgtgtctgatgtttaaacaatcttttagagaattctccatctcccagatatttgccaatttgcccataccttttgttttgctcctctccataacttttttttaagataatgtttttgcccctttacttttcattcatttctaccttcccaaccacttcttcaaaaatgtgcttgggtgcatgtggacagcagtggttcatgtgacctcagggtccaggggaggtccttggactcagtgtgtccttcatcactgctgacttcccaggagatgtcactcagctgcctggttgctatttcctggtggcatttggagttgtcgctgaggtaactcatagctaagctgctttccgaaaacgggcagagcttcatggtgctcctggcttacatggactcacgtctgcccctgcagatgtagtggacatcttgagactctgcctgtgacaactatttatccttgcctgatgagctgtcctaaagctattcctatagaatcatctcattcccacttagccagtcccctttgagaagctcccagtcagactcaaacatgcttctggtccttctctacactattagggaagcttgaaaaagctcaacctcatggcttgctcacactagcctcacattaccttgatgttgttacattccaggttggtgcagggtagctctgagatggccatggagcgaggacagaccttttatgtgctaccctcactaactgtacttctgcccaaatatctccccatcttctggtcaccccttgtccctcaatacttcacactgccgagggtcccagtggttaaatacctgttttccctacatcatatcctctctctgccatcacatcgcatgtgtcactttcccacttaatgggtttcccacttatcggggacagaagaggtgtttctgccctgggagaactctatgagttgaattgctcaggcttggtttttggtcagctcaaaagtgtagatttgagggatgaatgtggggttaataacaggaaaaacaaagggattttgaaaaatttacattctagacaacagctgagctcccatggctatagcattactgtacaattaggtcttgaaagtcaaaaaattaatgttaattttttcttcgcatttcttctgtaatgaattgtaatcttctcgtcatccaaacctaccctcccagccctggaagattcttgggacaaggaggatgaaaaccatccacagaaaggcaaaagaggacaagtccatgacagtgagtccttgctgtatctgggacattgaacaagctcaataagtagtaatcttcctctcctttaactgaaattaaaatgaaatctaacccacaacaccactacatcacatctgtgtacatgtgagaaatacagaaaggagaatcacagttttgatgagttatggtggtgaggtttcacatggttgcattcttttgctaaggttgccataacaaactgccacagctgcgtagcttaaaacaaaagaaattgattatctcacagtttgtagggcagacttcagaaatccaggtgttggcagggctgtgctccctctgcaggctctagagactcatccttccttgcttctcctggctttccttggctcacagctacaaaactccaatctgtgctcagctttacagggccttcttctctttgtctcagtctttcataaacacgttaatctttggatttagggcccaccctcctccaggatgatctcacctcaagatccctactttaattacatctgaggtcctgaaaggacatatcctctgggagtccctatttaacccacaacaggggcatatgttctctttcactattttcttatttttgagatagcattgttttgcacattaccaactagtaataaggaggggagaaaatggcatggctttccaaaaaaaaatctataaaactattttgctaggattattcccctttttaaaaacattttcttgccctttgctcctgaaaaagttctatgtgcctggccttgtttttatggaaatccttgcatctaaaaacaagctgtgtaaaactggcattccagacttcaggcaccaaatacttcaccccaggaattctcagcccagtctgttcaaccactagacagctataaatagaatcacaaacatttttggctctgtttcaccagttggaccaggcaggaaaggctccctgtggttgtttcacttggaaaaaaaacctggatttgagcagaaacctagctccagagaaagaaatcacttagctcttatgcataggcacaagatgtctgcagggcaatattgacttgagaggtttcgtctgagtatttgaagtgggaggattcatcttgaactgaaaaatggattgccatatctcagggtaagattccagcttagtcttgtgttcagacaccttttacagcatagctctcctaccagaaatcaggtttcccatccaatggcttaagagcgtaaaactctctctaaatgcctaactccatttctctttctcaatttcctgttttgcaaaatgagagtggatatcacatggtaccattatgttgcttctgtgtcaaaaagtattaaagaatgtgatttaacttctatctcccccatctcctgatccctctattaaaacatggaacaataggcaggaacaggccagaacagggaactgcatatatctcgcattagaactgagtagaatttaacaagttgctcagcttttctaagccttagtgtctactctgtaaaataatggcatcaaagtagataattctggcctggtgcggtggctcacgtttgtaatcccagcaccttgggaggccgaggtgggtggatcacctgaggtcaggagtttgagaccagcctggccaacatggtgaaattccatctctactaaaaatacaaaaattagctggatgtggtaatttgcacctgtagtcccaactactcgggaggctgaggcaagagaattgcagaggttgcagtgagccgaaatctcgcctcagcactccagcctgggcgagagagtgagactctgtcaaataaacaaacaaacaaacaaaaaaataaagtagatcatgcctataagccttcccacctcccacctctcatattccattacagtgtggtctaatatgatagccaagagccacatgttgctattgagcacttgaaatgtggctagtctgaatgaaaagaaaccgtaagtgtaaaggacacaccagattttcaacacttgccatgaaaaaaaaatgtgcatttctaattaatattttcatattgattacatgttgaagtgatagtatctggatgcattaggtaaaacatattactaaaattaattttacttattttgttttacttttgactatggcatctagaaaatttaaaattacacatgtggctcttattttgtttctgttgtccagtaccaccctataatggctacgcaatacactttagaaactaaagtccaaatgtgcagagttacatagagtgctcatatgtcatgtatgcataaattcgtgcacatgtatgcattaactgtgactggggttttagcgatgctgttgtaatatggtacagcttacagtatcttttcgtttgtgtacatatgatacatataccacttgtattcccattttcccaccagtcaaccactgccaaatacttcccacttcctaggattgaacacaagactaatcgtcagcatgatgatgtccatgcttaaattctaagttccccacggtttggttgtgtgagtttaggaaagtaaagcgacctctttgaccctcagtttcgtcatttatgaagtggaactgatagcagctatcttccacataggatatatatgaggtctagagaagataatccactaaacgcaccaattctaagcctgctgggaaatgtgtttccaatgaaggtgagttattgttttctaactgtggacacgtctataggcaggagagacatttgaagtatacaaataaaagtactgtggatttcttataccagttaacacatacttctgtttaaagaagaaaagaaaacttgcagaagatggaatttggtccaaacaagagagaatttggataaatactgttgagggttggacatttcaggtagaggaactagcataagtaatatagaacctgccctgtggagcagaaaattactgaatagggattgaaagtaagttttctgaggggagatagaattaaaattgaaaaggaaccattgtgaaagtcagtgtggcgattcctcagggatctacaactagaaataccatttgacccagccatcccattactggatatatacctaaaggattataaatcatgctgctataaagacacatgcacacgtatgtttatagcggcactactcacaatagcaaagacttggaaccaacctaaatgtccaacaacgatagactggattaagaaaatgtggcacatatacaccatggaatactatgcagccataaaaaatgatgagttcatgtcctttgtagggacatggatgaaactagaaaccatcattctcagcaaactatctcaaggacaaaaaaccaaacaccgcatgttctcactcataggtgggaactgaacaatgagaacacttggacacaggaagaggaacatcacacaccggggcctgttgtggggtggggggaggggcgagggatagcattaggagatatacgtaatgctaaatgacgagttaatgggtgcagcacaccaacatggcacatgtatacatatgtaacaaacctgcatgttgtgcacatgtaccctaaaacttaaagtataataataataaaattaaaaaaaaaactccattgcaggcaaagtcaaaaaaaaatttcccaataagaaaggcatggggaaaaaaactcagaagaaaatgagaaaatatgtccaggggatgaaagtaaaaaacaaagcctgaaattaataacctcaaaataaaacaatatcttttatgaaataaaaatccagatgcactaaaaatggacaaatcaattttttactcactaaatacatgtaagggactatcttaaaatgcagaaataaaagaggctgatggaaataaaagaagggaaaaaataagatagaggtcgaatcatggaagtataacattaagtaaactattaggagtcccaaaaagaaaataaagagggcgaagggatgaacaaagaataaagacattaaaaaaaaaaaaagaaaagaaagctcgagggcaggattttcccaagcaaacattaaatatatctacatgtgatgtttcatagaaacgcaatcttcatttccattgtatggtgtctctttacatctatgtagttagattctaatagaagtgattctgtatagtagagatctatgttggcatttttctctagtggatacttcttattttcatcctgtctaagcctaaaaggacccagaagtgatgttggaagtaaaaatccttctactttatgccatttcagaatttccatctctctgctccaagttagtaatcatgtccttagaggatgatgccatccagctaccaacctttacaccatcttgtcaacccctccaccaattcctccttccctcctttccacacaaaatttcacacctcgaccacagctttctacacttacaagtttcttaattccataatagccattctccatgtggtcttataataaaatggatgggagggccgaggcttcctattttcattgtgttattagcagtatgaccttggataatttatttaacttctctgagcctagaatagagataatcataacacacacttcataaggttattacgaagacaaaatgaaagaatgtatattaaatgcttaacgcgatgcttggtgcacagtaagtcttccaaaatattattcagtgttaacaatctttttagtcctttgatccatatattaccgtcttaacgctttcctgtcttcatctcatttcttatttagcctagacatcaatatgtctctctatcttcaataaatctcttctttgtacccttgggtctccagccctcttgagtttataccctctcaggcagactttaactgtgaggcatgctatgatcgagatgttgagactccaatggagaaaatcttgataagttaacaaaatcctcccttaactcttaaattagactctagctcttctgtgtgtccctacagaacacttttttcctcttctctgtgagcagacatttcaaagcttgtttgaagtctctttctaactccaccacattcccttgcagcaggtggcctcccctctcactacagagacaaaatcatgatcttcaagccttaaatccctcaggctcctgccttcacagctatggacttatctttccctcccgccccatcccctcaaaggattctctaagaaatagggctatatcagttggaaagccttattaatatacctatttgttgaacatagggaatgttcattgctatgtaagaaaaaaagatacttctctcaatggatttaaaatctgaataagcaagctgaaataactcaaatatgaaaaaccatctagaaagtatttaaatctcacaggcataagatgttttaattgtattccctgcttatacatggttgaaaaattttaaatggtagaaaaattataattcaaatcataggttgaattatgatattgttaataaatgttattgaatattttaggaatacatatattttcttcatccacaaagacagtaaaacagtaaatattttctctgtgtgtgtatatttatatatatgcacatgaacacatatatgtatatacacgtttgtgtgtatgtgtgtgtttgtgtgtatgtgtctgtttgtgtgtgtgtacttatcttttgcttaagcattagattctcatgcctggctacgctacagatatatttggttctaaaatgttccagttatataatgtgatgatacattcttagtgtgcttagtgcccttgaaaatctcagcctctctaatagaacattccacagcaacattcttagcctgaatacaaatctcagattttcaaggacaaactgacttcaaatatcccaacctactagttgactgaatattgattggttcaataatcatttgctgagtatctgctaggccaggcacagttcagggagggaatgagcaaaggtagatgatggccatgcaattttacaaacagaattatcagggagacccataaagggcgtggatcattcagagcagggttattaggagaagctttagagtcatatgtcctaaatttgggtttggatatttagttcatcaaatgtataatcccatagcttcccattctctccttcttttacccaaactccaaactcagtaaactgtagcttctctgtgtgcagctgtcaatggccacctccagcccccctccccagctccatcataactggtgcctgtccatccaacatctcacattagcaatcccagtgttgctttgccttctctaaagatccatggacatttttatttggtcacagaggcctgacttcacaccagcaggataaagatctagtctgtttctcaatgttatggctacagggggatatcacaaaaagattcctaactaaccaacattgctaagtccccagacatcgtgcgtgtttgctgaccatggcatggaggcaggtgagacaggtccagaatctggggctggcagttagcagcctagagtctgccctgggccctaacacagaagagttttatatgttcaggaatttttcctttattggtttcttcctttaagcatgaggtctaaagtctcttctagtgctgctgtttctagagagtggaaccatgaattcctatgttgtcagaaccctcatcttactaagctagaaacactcttatttcctattggtttctgagatgccacacttagctggttttctcctcactagctgcacttccggggcaccttggcagctcctctttcgtacttgattccagggaaggaagtgcctcagggatttctccttagtcatctgctcttttctttgtatacatctccctcatgctcttatttaccccccaagacttccaatccagtcttttttttttttttttttctgaggcagagttttgctcttgttgcccaggctggagtgcaatggcgcaatctcagctcactgcaacctccacctcccgggttcaaacgattctcctgcctcagcctcccgagtagctgggattacaagcatgtgccaccacaccaggctgattttgtatttttagtagagatgggtttctccatgttggccaggctgatctcaaactcccgacctcaggtgatccacctgccttggcctcccaaagtgctgggattacaggcatgattccaccgcgcccagccccccagtctggtctttatgcagatgactaacaaatttactcacctggctccaacctctcccttaaatgcttgactgaggtacccacctccttgctctacatctgtgcctggtgtctactaaatatctcagccttaactttctcagagtcagtgatctcctccccatctctcccagccctgcctcccaccttgttgctgtaaatggtaccacatccgcacaattacttttgcccaaagctgtgtaagtgatgatcagttcctttctttccctctaatgtcacgtttagtctataaacccagtattctctgctcccaaatagacccacaatttggccatttttcaccacttctatcgcaaccaccctaagccccttcaaccttctccctgactgtggccacagcctcctaaatattcttcctctcctgcctgacagagtcatatttctaaagcataaattagatgatcacatgcctctactcaaatatctccagtggcttcccattataactggaatagaattggaaccggttcttagggtgtgtaagactcacactatctagctccttcctgcctccctgtccctcactgccttccctccgttcttcctctcattttttaagttccagctgctgattttcttgctgtcctctggatgcatcaagctgttctctttcagagccttgggatttgttagtctcagtgcttggcattttcttccccgggccttcatatggctaccacccgctcattgttcaggttgcaactcaaatgtcgctttttcagagagccttctcaacactctggataaggagcactgccccctccttttaccacatcaccttaattccacttcttcatagtccttagcattatttgaaattatccagtattttgacatgttttatgtctggcaccacccatcacatgctaagctccttggggcatgaactctgtccattgtctttaaggcagcattctcagtggctggatcagtgcctggctgtgggaagtgcagagtacgtatttgttgactgactgactgaaaactaggcttgaccagctctttttgctttacctcttcagcaactgtgtagaatattgaagttttccagttaagagggaatcctttagtcctaggcaggaagaggatatgtactgagatctgggaagaatttagaaacactttgaaatatagtcatgactaagcatccaacaaaatattcctttatttaacaaatatttcttaaagattaaagatgtgtcagacactataggctggagcaacaaggcaaacaaattattgtttccatccttaaggagctaataatttggaaaggaaggtggacattatcttagtttgggctgctgtagcaaaatacatagactgagtagcttaaacaactgatctttattttctgacggtcctggaggctggaattccaaagatcagcatgccatcagggtctggttctggtgagagttctcatcctagttgcagaccactgccctctcgctgaccctcacatgatctttcctcagtgtgtgtgcagagagagtgagagagaaatctctttttgtcatcttatagggccaccatttctatccgattgaagctctacccttgcgatctcacttgaccttaattacctcctaaagactatctccaaatatagttgcattagcattggggtttagggcttcaacatatgaattttgggggcacataatccagtccatagcagacacatacacatacccttgcaattcaccagcagaggaaattgcagaatactagaagcacaggcaagaaaaacagtatgacctggaattagtaggcccaggcactcctccacaggtatagaccagtgaagcaagccaagaaaattgatgtttctcataagcttcaaatgcctgtaggatccagggacaaagggccactagtcacagaaagtgtcttctgctagaataaggcaattcagcactgtattggcttaaatggggctgatggacactctgctatttctgtggagaaggaagggatcctttatttcatcttaggcttatgtagcctttcaggggccctgtggtttctaggataactttgtctctcatgccctgtgtgacagatttccaacaaccaagagaactctcaccctctggttgttgctggaacgtttgattcagtttcttgtacacatggtcatttctgatagtcataggcaagacagacttggaggttcacaggctagagatcaccacttcttccagcaaggctaagcaggcccaactaaggtgaaattgcaaaatgtgtcttctcacttcttggcttctcttgtgagtaacttggatatcagtaaaactgaatatagctaccatagttctgctgggcatttgctagtattttctcatgcattctctcttttcaatcttcacacttaccctgcaaggaaaatattattcttgttttccagaatcaaaggagaatgcttacagtgtttgcctagagtaggctccagaatctgcattctgtgccatattctacaccacatcatcctagtgcctgccatgaagccaggaactcggatgaccatgttattctctagctgggcttcttctgttacatctagtgactttccctctgccctcttagcatccacgctgccatttttccatcttcattttgctcagtgctttgcactgtccttattattcctccaataagacagaagccttcttaatgtcttgaatactttttcttgtcttggtgtccccagtacttaatacagactctgacatggaggaaagaggtgataaagctttgccaaatgaagtgtaactactatctaaccttttggactcacaacacttgagttggccttaaattcctgatatactttggatatttgtccctccaaatctcatgttgaaatttgatccccagtgttggaggttggacctggtgggaggtgtttgggtcatgggggtggatccctcatgaatgacatgtactctcttcatggtaatgagtaaggtcttgctcttgttagttccagtgagaattgattcttaaaaagagcctggcatcttgctgtcaccatgtgacacaccagctccccttcctcttccgccatgagtggaagcttcctgaggcctcaccaggagcagatgctgatgccatggttcttgcacagcctgcagaatgatgagccaaataaacctcttttctttataaactacctagcctcaggtattccttgatagcagtgcaaacaaacaaagataatcccctctttagcaaatgaaacataaaacccagaaaagggaagagatttgtgcaacttcacccagttggtaacatggtttagggcagagctaattctgccagtgttcttttttctccgtaactctgtgttatgccaggttcttggaaatacaaaaccctggcctcagaggggcctccccttaagtgttggagaaggcaggcatttggggcaagggtcttttcctgtatcattaagtcacaagccacccacacatattcaagctctctactgttctctttgggcagatacaagtaaagtataaaccccaaatatctggaataagctattttgtttatcttataatttaaacatatgaaacataagccatagtaattggttagtgaaaagaattaccaggtcatttttcaattaaaaatacccttgtactttccgttgtgctttcatgtattgggaatgtgtgatgtaaacatgtaaaatacttggaattgactattactattaagcatataataaatgttcttatagtgaattgaaatggaatgcctatttttactaaaactaagtgaaagactcaatattgatagtgcctttttaataaattccatcaccccataactgctgttagttctgccacaactgaaataggaaaaccataggtgggtaagctttttctaaatgtgatttaacttgccttgaacaattcatagatggtatcaaagaaccactagaatattaaatcttagaccctgagtggctctcacagatctggtccaagtcattcatttcacaaagagaaaaatccaaagaggaaatgtgcaatattttcctgattccccactccatttcccagcgaccttcaaagccaaaaattgtgatactaagcatgcccaaggcagggtctcaggagtcagtgccgttagcttaatgatatcaaatcatgtcagtattgttacttgttccttcaactctaaccttgcgcttgaaattcccagccttgcctgctcccacatttctaccatctctcagctttgccctgcccttattatctgttccaatttcagaacccctggatctttgcaaattatcagctgctcagacatgatcattttgggctcattagcaccagctgatggaactgtatcctactctcagtcatttcctccagatttgagtactagttggggattgtcttcagactcttgcatctgtagtcatccctcagtggtctaagttctggtctcacctaagtatttcaacatcttcccatctgcccacctggtgagttttcctggacaggtggccctgttgtgtgctggcctgtttcacttgcatcagcactgtgtctggcactaagtaactttcccgagatgatccactccctcgctggtagggctgagattttaactacagtgttctgcctccactgagcccatgttcttcatggtactcactcttgttaggctagaagggcagagaccagaaatagtggatgccacttctctaataaagcaactcaagcctcaattttgtggaacagaaatgttgctaatattagaatataaataagtccatcaagactttactagtttcctaagatgcattggaaatgaataagcagtaggggatatataatcaaatgcttctgctgaaaaataaatgtaaagcacagacttgaaaggagcttgagccacaacaaggcttgcctgagaatgccactaaaatataaacagatcttcatcaacatttttgagccagttctcagagaggttgtgttaagcactgtaactgcagaattacaacctaccagggccatttgttatggaatttctcaagtagcagcaataggaaaccaaatgacctgatcaagagcttaataataacatttgtaaaacaagtgatgggagtgaggaattgttaattggataatttctgtcataataacatatgacgaatttttacatcgagagcatctcaaaatctgacaatggtctctcttccctttgaacaaaatatttggtttgctattaaatgggattcctcaggaatgatcctcagctacaaaaatgttcttttacagaggaataaaagtaatattaatcaggttaacagatcactagctctggggaaaaatgatctcactgtgtccttatcctgtggcctgaggtcactagccctgccgcgctttggggaaggatggaagaaagcgtcttctgacatttcccacatcaacctttgctccagcatcaactctctgttgttctaaatgcccatacttttatttctcacattatagttagcctctgttgtgattcttcaggatccacagtggcagaggtaaaattcttacaaggtggtcagtacgcataccctatagcaataacctgctgcattcctaagtaagctgagatactctcctatttcaggatctctgagaaccctacacggctagtgagaaaaatctagatttatttttcatgtcaagcactctgcaaatgctaagattttatttggctgagatccttgcatttatggagctgaatgtttctactgtgcattttccttgttataagtgattcactcaaagaaactaaattgaagtgtcttgggccactgataatgggttgtgctttaagtctgaaaaagacattattgacccacagttaaagggcatgcattttggctctttatggtgggcctggtctgcacgggtcccttcacactctcttcccaggtcacacttccttactcaggggattgtcgaaaagcctgaatcaccttcagagcctctgatttaaatgtcatggtgcatagctgatgctaagaaatgatgaaatacaattgctggctggcatgagctcttccctaaatgctgctgccctctctggtgctctccagtgcctgcctacttggaccttgcccctgcatgcctgtcctgtctccctgttctgtgtcagagaatcaggttctgccgctgctctctgcctgcttgccaacagtgcagtgcagagccctttcctgcatttcccatccggactcaacggtttccccattagtgtccgccttaaagacaatctctgattccagtgtgaatcccaccccagcacagcatatctgatgaaggcaccaagtgtgccctactcatgtatagagatccaaagaatctgtgcctttattattattttttaaacatgaaaaaaaaatctccaagtcatctttctgagctggacagactgcagagagttggaatgggcataaaagaggctgatcctgttggagctccacccatattttctacccacaatcctttagtgcacgtggactcaattcagcattgtggccaccaacgtttctttgtctgagggctttctctggtcactagagcccactttgatgtccctgtggccagctgaaagcatcagggaattaatagtcctgccccttctcctagcaaccaatcaccaatgatgcgtcaggaattggttactgacccactccctcacctctcaggtgggactactccaaaacattaactcctttacactcgctcccagagttcccagtatgattcagctttattcatggactgcaaacccttcactagacacttaaacttacctgtctaatttccccactccccattagtgtttcctggaattgcttctagaagaaagtttttgcactcgattccttgaatccatcgcttctggggaaacccaaaccaagatgccatttgaacaggagcaaggagagggttgggcaggaaactgtgcttttcaggtgcctgcagtgctgtcgtgagggagccagacccttgctctgctcccactttccatcttctgtatggatctgacctgggaaaccagtcatttcttttttttttttttctagtggtagaaaaactgtagtatactgtataaaaatgactacatagtttcaatttttacattaaacaaatgaattggtagcttggatttaaaggtatcaaaagatgattaaaaaccttgtactaaatactacctgattttctgtcaatacaaactgcgtcctcttaaaagatattgaaaccaccgttgtattttttaaatctgcagcatcagttagaaaccatgaaatatatctggtgtcaaggagtattattaatactcactgtttccccagcccctctgacagaattgtttgtgagcatttagttctgtagagcagggatgtggaagataaataccagtgggtcctctgggacaccccattacagaagaacaggctgcctcgtgttgttttgtcctggtcatgccaggacaaagaatttgttttctcgttgttataagtggactgatattttaaagttcctctaaatattgagtctgaaaagtcatattaagatggtgctcttcctagggttggttaccttgttaaaacatgcacaccagtggtggaaatctggtgcctagagattaatgtacagaaagcaatgatgagtccaactcatacatccagctagtttccatcacaccttctaaaggtagagagtgtggtagaatttgagagaatattccagtggtccgatctgtgctgtgtgccttatttattttatttccaatctcacaccaattgtctgtaacaaaactatctgtgggaggaaatttttcattttgaaaaagcaaaacattgcatgtatcttgggctgcctcagcagagagcatattcagtaaaccgtttgtttctgtgggcacagtttattgtacatcatcttgcccttcgtaaaatgctatcatcttttgttatgtggttcttcttctggattttattgtaagctttgatgcagggaccctgcttcaacttttaagcagcctgcatttcatgctctatgctgtttatttaactagggcattgtaaccaaagagggcatttacagatatttgctcaaagaatattcaactgatccataattttctatttcattttagctttatatatattttatgcttcctgaaacccaaacgattgtgtctgcttgcatagcgtttcagcattccaagatgatgtttagaatgctctcttagaagctgcctctgctactaaaattgcaacaactttctgtattacgtttaggtgaaactgttggaaattgctagtgttcaaactttggtgtgcattaggttcttcttgtctaaaatatacctgcataggccctagccttggggcactgattggtaggtctggagggaccccgaaatgtgtatttttaagaaacttcttgtgtacatcaaagttgcaaccaacgttccaacatcttgcttttgcctttccctaaattctagtgcaagaaaaagctacatgggaagtactctgtatttttacactttttgttaacaatatataatataaagaatatgatcctttactttactttaagacccttgtgtaaagatcatcatcacaccatgtcacgatatcacattgtgacatcatgataaattcttctcaaagctcagggtctagtcatagctgagatattttttcttgataaatttacttccaattatttcttcatgagtgagaatgattatgtgtccttcttcactctggctattagaaaacctaaaaccaagttttgtaaaattactgtagttctgctctaacaagcttttttttttttttttatactttaatttctagggtacatgtgcacaacatgcaggcttgttacatatgtgtacatgtgccatgttggtgtgctgcacccattaactcgtcatttagcattaggtatatctcctaatgctatccctcctccctccccccaacccacggcaggccccggtgtgtgatgttccccttcctgtgtccaagtgttctcattgttcaattcccacatatgagtgagaacatgcagtgtttggttttctgtccttgtgatagtttgctcagaatgatgatttccagcttcatccatgtccctccaaaggacatgaactcatccttttttatggctgcatagtattccatggtgtatatgtgccacattttcttaatccagtctatcattgatgggcatttgggttggttccaattctttgctattgtaaatagtgccacaataaacatacatgtgcatgtatctttatagcagcatgatttataatcctttgcgtatatacccagtaatgggatggctgggtcaaatggtatttctagttctagatccttgaggaatcaccacactctcttccacaatggttgaactagtttacagtcccaccaacagtgtaaaagtgttcctatttctccacatcctctccagcactgttgtttcctgactttttaatgatcgccattctaactggtgtgagatggtatctcattgtggttttgatttgcatttctctgatggccagtgatgatgagcattttttcatgcgtctgttgactgcataaatgtcttcttttggaaagtgtctgttcatatcctttgcccactttttgatggggttgtttgcttttttcttgtaaatttgtttgagttcattgtagattctggatattagccctttttcagatgagtagattgcaaaaattttctcccattttgtaggttgcctgttcactctgatggtagtttcttttgctgtgcagaagctctttagtttaattagatcccatttgtcaattttagcttttgttgccattgctttctaaaaacattgaaaaaagattagacgaatagctaactagaataatcagtgtagagaagtccttaaatgacctgatggagctgaaaaccatggcacgagaactacttgatgaatgcacaagtttcagtatccgattcgatcaactggaagaaagggtatcagtgattgaagatcaaatgaatgaaatgaagcgagaagagaagtttagagaaaaaaagagtaaaaagaaacaaagaaagcctccaggaaatatgggattatgtgaaaagaccaaatctatgtctgattggtgtacttgacagtgacggggagaatggaaccaagttggaaaacactctgcaggatatcatccaggagaacttccctaacatagcaagtcaggccaacattcaaattcaggaaatacggagaatgccacaaagatacttctcgagaagagcaactccaagacacataattgtcagattcaccaaagttgaaatgaggtaaaaaatcttaagggcagccagagagaaaggtcgggttactcacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaaacactaaacatggaaaggaacaactggtaccagccactgcaaaaacatgccaaaatgtaaagaccatcaatgctgggaagaaactgcatcaactaaagagcaaaataaccgtctaacatcataatgacaggatcaaactcacacataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacataaaacagcacgggttgcaatcctagtctctgataaaacagtctttaaacaaacaaagatcaaaagagacaaacaaggccattacataatggtaaagggagcaattcaacaagaagagctaactatcctaaatatatatgcacccagtacaggagcacccagattcataaaacaagtgcttggagacttacaaagagacttagactcccacacaataataatgggagactttaacaccccactgtcaacattagacagatcaacgagacagaaagttaacaaggatatccaggaattgaactcagctctgcaccaagcagacctaatagacatctacagaactctccaccccaaatcaacagaatatacattcttctgacaagcttttaaactaataactatttattttttattttcccttcatacttgaaaaagaaaaaggtaaatgagccaaggattttatgttattgtaaagaggattttatttaacgttgcattcaatcctttttagaattgttcttagtcctgggcttcctagaaaagagagcttgaggcaaagattaaaatgctgacacttcctttgcaaggtgcaaacccagggcagcaaaagtgaggaaaaaacatagggggttcaaagaaagacgcaaagcaataaaaagtgacccatgactgtgctggctacagcttcatgatgagctgcaagatgacacagaaggtgacccagcaaggttgtcactcagtatgtgggacacttatggactctccatgtcaaggacagttgcttcaaagcagcccataggagggaggaatcaggggcattcttttgttcaggcttatctcagcccttatgattttctttggggcaaaattggccacatggaaagccaactctcccacacttccagcttgagtcatccaagtcctttggaggctggcttggatgctaattccacgccctccagtgcagtgattccctcaagttcagaaactgtggaaggagctggaaactcagggcatgcgcctggcctggcactttcagggcaagtgacttactgtcctctggtggtgtcattaagtccatgaagcaggctagctaaggaaatccaagatgacagataagatttacatttaatacagaagcagataagaagtagggagcatgtgtgagctgggaagaagacaggagggaaggaaaatccaaacctgaataaagtagtaaatatacaaatgttggacaaagggcaaagtgtatttcaccaatttgaatgggcaggtgaggctgggcaaggtggctcacgcttgcaatcccagcactttaggaggccgagatgggcagatcacttgaagtcaggagtttgagaacagccagaccaacatggtgaaaccccatctactaaaaatacaaaaaatattagccgggcatggtggcaggcacctgtaatcccagctactcaaacgactgagtcaggaggattgcttgaacccaggaggtggaagtttcagtgagctgagatcccactgctgtactccagcctgagtgacagagtgagactccatctcaaaaaaaaaaaaaaaaaaaagaaagaaagtaagaaagaaagaaagaaagggtaggtgaaagatttcaagtttagagaatgactggatagaggccggtcacggtggctcacacctgtaatctcagcactttgggaggctgaggtgggcggatcacgaggtcaggagtttgagaccagcctagccaacatggtgaaaccccgtgtctactaaaaatacaaaaattagccggccctggtggcgggcacctgtaatcccagctacttaggaggctgaggcaggagaatcacttgaacctggcaggcggaggttgcagtgagccaagatcacgtcattgcactccagcctgggggacaagagcaagacttcgtctcaaaaaaaaaaaaaaaaaacaaaaaccaaaatacagagaatgactgggtagaaacccattgaataaagtatacaaaatataaggaacatgtttttagggaggtaggggaggggattgagtagaatgaggtagcacagatgctttggtcatgttgagtttgaggtcactcaggtgaagatatcaggtattcgttggatatatgagtctggaacttagcaggaaaaccgggacaaacatatggacttcagatcataaacacaaggtcatgacagaagtctatgagtggaaaaaatcagtgacaagataagagcaagaagaaaagcaaacaaagcacaggaacttgaggaatacacacttttaaggaatggatactgtgtgtgcatgggaagccagggtccataaaggaaatttggatgggttgccagtgctatggacaacttagaaattttctgtggttgtcactagtagcttatatggcatagaacctgcatttcctgctcattatttgtattgacacacaaaatggtcctggggtctgtactattgccccagagcagtagcagatatgatttagcatgcacacagttctaagagaaagaagacagaggatatgaatgagcattgattgagtgttcataatatataatgaactgtgctgggtaccttatgtacatggcctcctttgttgatcctgtataactctgtgaagtgaaaggtattatcttcattcttacaaagcaggaaaatgggcctcagtgtcatgacagtaggtaatgctgctgcaactggagtctcaggtttgtcccatcccaatgcccatgctcctcccatgtgctggactactccagcctttcaacaatgacagtgggggtctgatcacaaaaattcttgatggaaaatgagttctgtagtttccagaccctaaatctttcagtttggtactacattttttctgtgaaatgaaaatagatgatagtaaaatttatttttcacctctgttgagaaactatttgaacattcaaaactttacttttcatttttaccgatctcccttactagtgttcagaataatgaatatgagacaaacattttctccagaaggaaatcctacattgatatgatgtaggacagggtaatgtttttctaaatgtgattacatgcaccagacaataaattaaaatgtgagtttctggctgggtgcgatggctcacgcctgtaatcccagcactttgggaggctgaggtgggtggatcaccaggtcaggagatcgagaccatcctggctaacacagtgaaaccccatctctactaaaaatacaaaaaattagcctggcgtggtggcgtgcgcctatattcccagctgctggggaggctgaggcaggagaatggtgtgaacctgggaggcggagcttgcagtgagcagagatcgcgccactgggtgacagagcgagactccatcttaaaaaaaaaaaaagtgagtttctgatatcagatatattctacagataatatgtaaaagttccaggcagaaacaattaatgatgacacatcgatgtagtttaaatggaccacaacctaaataatgctgtagctgatatgctaggcctgtatttttgccctgaatagattttccacatttgaatggaatacttatgcttttatgctaaaatgaaagagcaaagtcaaataagctattgcatagtccattaaaactactttcaagtgactctcaataggcgaaatttccacaacttttgcatttgcaaaaggaacttttcaattaagcacagaccactgttctcagaactcgcagatgccactcgggtctttttggagatgataattgtgtattagttatgtagtgatgagctaagacaaaccaaaaaaaaaaaaatgcaaaagggcaaatctggtttttaagtctgagaataggagaaaatttagtctaggactaccccaggtttcacatatagccttttttttttcattttttctatggcctatctcttattcccctttttgctgtttatagagcacatcggaatcaaagatatgcccaaagaatcaagagggcatgaggcatcatctctttttttttacagtctcaaggaaaacatgacaaatgtacaaacatcaaatgcctatttctatgtgaaaccccggcacttttcccaagcagagaagataaccgaattaaattgtattcatgctatttatgaaagaaattgttcctgctttcatccaaatgaagcagatgactcattttcccttaagtggttccatgacaatcacgcttcccagacaaatgaaatgaaaatatatatatatatagaatttggttgatcatccacttgattaggaaatttttgttagattgtctttggatatctcctcatggaatgaattgccaaccctgcatagctccctcacacaacccatatttgctttgtaatattgtgtctacctaaggcatgatatgcttgcaaagttttattggtttgatctatgataaaaggtaagtatacacccaggtgttctttgtgcatacaaaaaatttgtttgggtcttctttaagttgattgatgggtgtctctacaaatgatttatctatttcctggatgtattatataaacgaaagcttttcacattccggatttggtaatcagtggggacctatttgtggattctttgtagttttgtttgttttcaaagactggaattattagaggatatttttatttgtttatattattgaaataaactatgtagcattcaccaattagaatctgttacaattgcaggacatttatttaatcttctaacaattgtaaagatcaaagatgctgtcttaccttggcactgttttatatcaggacagaataaagggctgagacctgaatctggtgcaatgtgcattcactgacagcaaattctgtgacttgcatccttgctgcactgcggttgtgtgggctcaggtggaacacagagtatctcctcaaaagaaactaagtaaacaacagaacttaaaactgggggaaagccaaggttcaaagctataagaatttacagcagtgatacagcaaagagccctggatcagttttccatcaagaaatcaagaaagtgagaataggtaagaagaaaattgagaagaatccagaaaaaaaaaatcttaccttactattttgtcatatgaggcatatatgggctttggctaagttcaaatgactgatggtaagacagcttggccaatattagagcctaactgtgggtttgacaagtaaattcttattgaaagggagaaaatggagagccttcaggcactagtcagcatgttgctatccagaaaaacatactgccagccctcaggatgctcaaggtgaagtggtggagtgcaccaggggacaatgggtagagggagcctgcttttgaagtctgcaggcaatgaagaaactccagtggattgaaacagtagctcatagaccaatgctggtctgagaactgattttcactcatctgcaaagacacaagtacagacatcaagagtaatcattcagagactttttcccatactttatagagtaatattaattctgttgaatctgacgataaaatttgggtcttacattttataagcttttgtttttattatattttcctactaatttactttttatagaattttgctaaagtatggtctgcaatgtattgaaaattaaaagttgctgatgacagaaaatggcagataggaggcaggactaacttgcagctcccactcggacagacaaagcagtgtgtggacactcacattgtgaattttcactccaagaactaccgcaggaacataccaggaaagccaagagaatccacagaccctttgaaggtaacaacttgccactgtgagacagctgtaaaactgtgagtgcctgaagtgtgaaagggggaaagtctgcccctgaacacacatccttactggggaaactgatggtccagatcatgggaggatttaatcttacctggagctgagacaaattgagagagccgagtgaaatataggggtaaaggaagcagcagaaagaacgctgtgggcactctcagtccccagggaggccatttctgactttgtctcacagggatccttggggaggactgccagtggagctgaggaaggacatcagggagaaggaaacttccagccgaactctgtaacaattctgactgaacacgaagtttcctggacagaatctgggggatggagcaaagataccagcacaaaaaccgtggcaggtggggaggcatgaaacctgaaaaccccacctgctttctcagcagggaggcttgtagcatgggacttattctcagccctgctcactagctgcctggaaataaactcaatgctgttgggaggccacagtgggaatgagactggcctttctggctgtgtggaagctgagtgaggcctgtcactgccagctttcccccattttccattgacctagatgatgcagcagaggcagccatatttcccctaggaacataactcccatgggcttgagaaacacacctcatctccaacagcagctacagcaaggcttgcccaagaagagtctgagctcagacatgcctaatcctgcccccatctgatggtctttctttaccctccctgatagccaaagacaaaggacataatctcttgggaacttcatggccctgcccactgcctgagaaacctgaatacttacccagacaaccctaggacaagcttgtatcctccctatactaccacaactgatgctctcttgaaagagtcacctcctggctgaaggccaaccaacataagaccaacacattaaaaaaaaacacaaccaaggacccccacagaatccacttcactcccctgctgcctccactggagcgggtgctggtatccatggctgagagacctgaagagaaatcacatcccaggactctttgcagacacaccccagtactagcccagagcccagtagctctgctgggtgactagatctaggagagaaataacaatcactgcagtttggctctcagaaagtcacatcactaggggaatggggagagcaccacatcaagggagcactctgtgggcaaaaggaatctgaatagcaccccttgaactggagatcttcccttggacatagtctacccaaatgagaaggaaccagaaaaacaattctggtaatatgactaaacaaggtgctttaacatccccaagaaatcacatttggcttggatccaagccaagaaaaaaatctccaaattgccagaaaaatgattcagaaggtcaattattaagatactcagggaggcaccagagaaaggtgaataccaactcaaagaaataattttaaaaaggatacaagatataggccaggcaccgtggctcatgcctgtaatcccagtactttgggaggctgagtgggcagatcacgaggtcaggagatcgagaccatcctggctaacacggtgaaaccccgtctcaccgtgtatttaaaaatacaaaaaattagccaggggtggtggcgggcacctgtagtcccagctactcaggaggctgaggcaggagaatggcgtgaacccaggaggcggagcttgcagtgagccgagatcgtgccactgcactccagcctgggcaacagagtgagactccatctcaaaaaaaaaaaaaaaaaaaaaaaaagatacaagatatgaaagaaaaaatcttcagagaaatagaaagcataaataaaaaacaatcacaccttctggaaataaaggacatgttggaaaaatgtaaaatacactggaaactctcaacaatagaattgaacaagtagaagaaagaacttctgagcttgaagacaaagttttcaaattaacccaatccaacaaagacaaagaaaaaaggatttttaaaaaaatgaacaaagcctccaagaagtctgggattatgttagatgaccaaacataagaattattggtgttccctatgaagaagagaaatctaaaagtttgggaaacatatttgagggaataatcaagcaacaattccctggaataatcaaggaacacttccctggccttgctggaggtctagacattcaaatacaagaagctcaaacaacacccgggaaattcactgcaaaaagataatcacttaggcacatagtcatcaggttatctaaagtcaagacgaatgaaagaatcctaagagccatgaggcaaaaacatcaggtaacctgtaaaggaaaacctaatagattaacagcagatttttcagcagaaaccctgcatgccagaaggcactggggtcctatctttagcctccttaaacaaaataattatcagccaagaattttatatccagtgaaactaagcttcataaatgaagaggagatacattttttttcagacaaacaaatactgaaagaattcaccactaccaagccagctctacaagaactgctaaaaggagctttaaatcttgaaagaaatcctcaaaatacaccagaatagaacctccttacaacataaatttcacaagacctataaaacaataaaacaataaaggaaaaaacaaagtattcaggaaacaactagcatgatgaagagaatagtacctctcatctcaatactaatgttgaatgtaaatggcctaaatgctccactaaaaaatacagaatggtggaatgagtaagaattcaccaaccaagtatccactgtcttcaagagactaatcgaacacacataaggactcacataaactgaaggtaaaggggtggaaaaagatattccatgcaaatggacaccaaaagtgacagaagtagttattcttatatcagacaaaacagactttaaagcaaaaacagtttaaaaagacaaagagggacattgtataatgataaaagtactagtccaacaggaaaatatcacaatccttaatatgtatgctatatatgcacctaacactggagctcctaaatctacaaaacaattactactagatctaagaaatgagatagacagcaacacaataataatgggaaatttcaatactccactgacagcacttgacaggttatcaagacagaaagtcaacaaagaaacagtggatttaaactataccctagaacaaatggacttaacagatatttacagaacattctacccaacaactgtagaatatacattctattcatcagcacatggaacattctccaagatacaccatacaagtctaaataaattgaggaaaatcaaaattataagtactctctcaggccactgtggaataaaattggaaattaattccaaaaggaactctcaaaaccatacaaatacatgaaaattaaatagcctgctcctgaatgatcattgagttcacaatgaaatcaagataaaaattaaataattttttaaactgagtgataatagtgacacaacatatcaaaacctctgggatacagcaaaagtggtgctaagaggaaagtttctagcattaactgcctacatcaaaaagtctgaaagagcacaaatagacaatctaaggtcacacctcaaggaactagagaaacaagaacaaaccagacccaaacccagcaaagaaaagaaataacaaaggtcagcacagaactaaatgaaattgaaacaaacggaaaacaatacaaaagataaatgaaacaaaaagctggttgtttgaaaagacaaaattgataaagcattagtgagattaaccaagaaaataagagagaagttccaaataagcttaattagaaacaaaacgggagatatcacaactgataccacagaaatacaaaagattattcagggctactatgagcacatttatgcatacaaatgtgccctcctagattaaacaagtaagaaattaaactctgaacagaccaatgacaagcagtgagcctgaagtggtaataaacaaatagccaacaaagatatgtccaagaccagatggattcacagctgaattctattagacattcatagaagaattgataccaaccttactgacactactccaaaagatagagaaggaggaaatcctttctaaatcgttctatgaggccagtatcaccctgatagcaaagccaagaaaggacataacaacaacaacaaaaactacggattaatatctctgttgaaaatagatgcaaaaatcctcaaaaaaataccagctaaccaaatccaacagcatatcaaaaaaattatccaccatgatcaagtgagtttcatacctggaatgcagggatggttcgacatatgcaagctaataaatgtgatacagcagataaacagaagtaaaaacaaaaatcatatgatcatctcaatagatacagaaaaagcatttgacaaaatccagcatcactttatgatcaaaaccctcagcaaaatcagcatagaagggacataccttaaggtaataaaagttgtccatgacaaacccacagccaacattatactgaatggggaaaagttgaaagcattctccctgggaactggaacaagacaaggatgcccactttcaccacttctatttaacatagtactagaagtcctagccagagcagtgagacaagataaagaaataaagggcaaccaaattagtaaagaggaagtcaaactgtcactgttcactgacgataggattgtatacctagaaaaccctaaagactcatccaaaagctcctagatctgataaatgaattcagtaaagtttcaggatacaaaatcaatgtacacaaatcagtagcactgctatacgccaaaagcaaccaagctgagaatcaaatcaataactcaatgcctttcacaatagctgcaaaaaaattaattaaaatacttagaaatagacctaatcaaggagatgaaagacatctacaaggaaaactacaaaacactgctgattgagaggccaaggtgggcagatcacgagatcaggagattgagaccatcctggctaacacagtaaaaccccatctctactaaaaatacaaaaaaaattagctggacatggtggcaggcacctgtagtcccagctacttgggaggctgaggcaggagaatggcgtgaactctggaggtggagctagcagtgagccaagattgcaccactgcactccagcctgggcaacagagtgagactccatctcaaaacaaaacaaaacaaacaaataaacaaacaaaacactgctgaaagaaattatagacaacacaaacaaatggaaacacctatcccatgctcacgaataggtagaatcagtattgtgaaaatgacattactgacaaaagcaatctacaaattcaatgtaatttccttcaaaataccatcatcattcttcacagaactggaaaaagcaatcctaaaactcatacagaaccaaaaaaagagtccgcatagccaaagcaagactaagcaaaaagaacaaatctggagacatcacattacctgacttcaaagtataatataagactatggtcaccaaaacagaatggtactggtgtaaaaataggcacatagaccaatggaacagaatagagaactcagaaataaagccaaatattcacagccaactgatctttgccaaagcaaacaaaaacatgaagtgggaaaaggacactctattcaacaaatggtgctgggataattggcaagacatgtgtggaagaataaaactggatcctcatctctcacaattttgtacttgagtagtacaaaatttcactcaagatggatcaaagacttaaatctaagacctgaaaccataacaattctagaagataacatgagataaactcttccagacattggcttggacaaagagttcatgaccaagaacccaaaagcaaatgtgacaaaaacaaagataaatggatgggacttaattaaactaaaaacttctgcacagctaaagaaataatcagcagagtaaacagacaacccacagagtgagagaaaatcttcgcacactatgcatctgacgaaggactaatgtccagaatctacaaggaactcaaacaaatcagcaaaaaacaaaacaaagcataacaaaaacaaaaacacaaaaatccccaaataatcccatcatcaaaaagtgggctaaggacataaatagacaattctcaaaagaagacataaaaatggccaaaaaacatatgaaaaatgctcaacatcactaattatcagggaaatgcaaatcaaaactacaaagcaatatcactttactcctgtaagaatggccataatcaaaaaataaaaaaaatatagtgattggcatggatgtggtgaaaagggaacacttttacaccctttggtgtgaatgtaaactaatacaaccattatggagcaacagtgtggagattccttaaagaattaaaagtagatctaccatttgatccagccagcattcccactacttgggaatctacccagaggaaaagaagttattatacgaaaaagattcttgcacatgcatgtttatagtagcacaattcacacttgcaaaaatacggaaccagcccaagtgcctatcaatcgagtggataaagaaaacgtgatatatatgtatacacacacataatactactcagccataaaaacgaacaaaataatggcattcgcgcaacctggatggaattgcaggacattattctaagtgaagtaattcaggaatggaaaaccaagcatcatatgttctcactcctaagtgagagctaggctatgaggacacaaaggcataagaatgatacaatgtactttggagactcaagggaaagggcagaagggggagaaggagaatacacattgggtagagtgtacacttattgggtgatgggtgcaccaaaatttcagaaaccaccactaaagaatttattcatgtaaccaaacaccacctgttctccaaaaccctactgaaaaaattaaaagtcaataaaaacaaaaacatctgttgcctgtaccaaagatattttgagaagcattgacgatgtaagaggaataaaacacaccttatagggtccctagtctctcccttgccttctacctttgcctgcctgcctgcctgctttctctttctttctttctttctttcttttctttctttctttctttctttctttctttctttctttctttctttctttctttctttctttctttctttctctttctttctttctttctttctttctttctttctttctttctttctttctttctttctttctttctttcttctttctttctttctcactcccccttcccctttctccctctttctttctctttctctttctttctttctctctttctttctttctttctttctttcctttcttcctcccttccttccttccttccttccttccttccttccttccttccttccttcctttctttcctccttccttccttccttcttttggctatcagcctctttacctgtgaactttgaagaccttttaaaccaaaataaatcacttatttcaaaagattattttgatgggtattagtaccctggactgcagtttctgttaaagtggaaaaaaaaatgctgcctaggtcaaaattacaaagacacatactggactttcccctaccctgtaaaatcctgaccctgtttccactaccaggagtcacctggtctccagtgttcctgatgatgcatcaactgaataaagtttttcatttctatttgaatctcttacattgtattctttcaacagctgaaaatattcaagcaatggggtgctaaaagtgagtctcattttcaagttgatgggatggaggtgagtcttatactgcttgctatcagtctatgacatatgcctggcagttaagagttcaggtgtggatggaacagcagatgtttttcctaacccattgggctagagggacaaaagttgcttattttctgcccagtgggttcctattaattaagagtaggatgcagcagcttgctagtctgtctgtggacagctgggaagggatggggatggcagtgtgggctgacatgaggaaatgagtgcttctcctggacaaaggccctggtatcaggactaagtcaggaatctgatctgcatactcatggaggaactggagtttggcactctagaccgttggagcccttcagaaggcctgttattaggactgtgacaccctagcaagatcagattatagcaagtgtgactcactgctctgtcctggggcatagaattagaacttcctcacttcctcttcttgagattaggacagcccagagactgtcaaaggcgaggctgagcatgtggtgaagggaaggttggctcagcagagaaggagtaagaaggctatgtgggctggaatccaggcaggagcctggccacaccctgtatgaagtggtgtaggaatgctttagtttgcccatttttatcttggtagagtcagcatggctcatgccagaatggaggtcagaataacagaatatctgattgcaagagatattttgctttgcttatctgttgacttttgtcctgggaggaataatgggtgttggagaagttgcagattgggatatccagtttatggaagtaaagcaaaaacaaacaaacaaacaaaaaaacacctttctccctcctctgcagtccactaaatagccccaatacatgtatacacacacatgtttaattaaacagccatttagtgagcagcacagggagcagcgctcttgcatgtggggttagatagaaagatgcctgtcttgagatgacattgttgtttgaagcagtttttagttcgaacagggacatgcaagcatggcaacacatgagactgtgctagctcgagtagatcaggaccaaggggagtcccacactctgcttgatgaaaggagataatcagtctaaggaacccaaagggtgactcaggcactgtgcgtggtaaggaaagataacagaagggaccggtgctgggaccgaggactcactgggaggaggggcgggggcccccctatgcctcccaccactctccttacacagcatatgttcaggcagacccctccctcgtgtgtctcccatccagatgtcttcagcccactctcccacctgcctttaggcatagccgtggggaagaaagccacacgtaggacagcaaggccatctgcttccgcagctcttgttaaactttagctgtcaggttgaagggaagctgacatttccttaagatggtatttcatcaggtaatgtgttcctctatttttaccaaggggaggagaaacttaacttttcatggagaagaccccttaaatactaaaaaaacccttctttggtcaagttttccaattttatctgggaaatatagctcttcaactttctggaagtcagtatggaaaaacgtttatgtctacacacacacacacatatatatacacacacacatatatatgtgctgtgtatacatatgtatgtgtgtgtacatatgtgtgatgtatttgacaatgagattcctactaattaacctaaattatagatcaaaattgaatacctactatgtgtcagatcctatgttggaactatataaatgaatcagacatttcttattccccaggggcctataaccaagtagtataggagggcagagtgttagatgactaaagtgtaatgaggaaaacagagagatggaggagagagaaattacaataagggaatgtgtagtaccttaagatttcaattgtgaagtattttagaataggggtcaatgtcaggcattagactaaaggtcaatgtcaggcatttaagagttcagaaaatcttatatttaaaacttatgattgatttttctgtgtctatttctcttattgaattaactattttgcagtcaaactcctcctccaccaccccaaattgtaataattcattaaatagcagacattcgtactggctgatcaggaaaaccccgtaacaatccaaatctatggtgataactacatctaaaaactgcatttggaacattaaggaagtactttctagctgttgggactttatctcattgaattctaggactaatattttatttattttcttatgcatgttgacatagaattccaaaataaattcattataccctttaaaaatatacattgtgcaacgtatgtttattgcagcactattcacaagagcaaagacttggaaccaacccaaatacccatcaatgatagattggataaagaaaatatggcacacatacaccatggaatactatgcagctatataaaaagaatgagatcatgtcctttgcagggaaatggatgaaactggaaaccatcattctcagcaaactaacacaggaacagaagaccaaacaccacatgttctcactcataagtgacagttgaacaatgagaatacagggacacagggtggggaacaacacacactggggcctgtcagggggtgggggtgagggaagcgagagcattaggacaaatatctaatgcatgtggggcttaaacctagatggtggattgataggtgcagtaaaccaccatggcatatgcatacctatgtaacaaacctgcacattctgcacatgtatcctggaacttaaagtaaaaagcaaacaaacaaacaaaatatatatatacacattgtgcattactttcatgttcaaagaaagcatatcactcacatattgacgtatgaaaaagaaacattaaattaagtgtgctcttttttctgaattgtggtataatcctataaaaaaaattcagggagctttaaaaatgcacatagtctttgccccttcaaacatccccttttggaaaaggcatattactgtcttgatgggatgaagagacacattatagttactcttaaatgttcctctctcatccataagcattggttttaaattgtcatgaaattcaaataatagcttgataaatttttccatccaggttaaagaaaaagaatcatttggatacttctctaaagattaagcattccttcagagttcagtttatccacattaccttttaatgtttatataatttcatttgttcatctattcatccatgaaaacattttttgagcacctatatgtatcaagcactcctctgaactcagagatatgagttaccaaaagacaaaagaaaaatctgccttttgaatgttaggttcaatgcagcatttcagaaaaaaattaaaaagtaaaatatgtaatatattacctattgctaaatgctgtggagaaggataagataaaacagggcctggggttgaggtttgcagtttagctggagcactcaagaaaggcttcacaaaggtgacattcaaggaatcccggaaggagctgagggcgacccccacacagatccaggatcagacaggggaagcagcaagcccaggcccaattttccaatctgagttattgcaagtggcctgcacaccagtctctctccttctgctcttctcacctccactagacaattgtcaacacaagagttagagtaatcctattcataatattccagtccaatgactctgatcaaaagccaaagtcatcaagtggcctgcaagtcctcacattgtcttgacctttcgtattgagtgtatacatgcactaaattctccttattcatagtagttatcttctatagtcatcttgccctgagacactgaataagccaatactgaaaacattgctcctacaagaaatatgtacatctatttatccatccatccatccatccccatatctcacatagattataatcttaaatcctaaaaacaactcattctggattttctttatttacaaaagagaaaatgaggctcagaagccataagtgagttgcctggagccaccttattagcaggagccggagttgagattcaaatcccagtcaactggccccagagctagaactttatgcactgccctatgctgtgcctatggccttcgtcctctctgtgggagagttggaacagggagacggaggttgtctcattcagcctcaactggctacttgcacatgggcaactctattgatttgggggttacaaatacattttagcaagtagacaaattcacaaatatgaatctgtagataatagtgagaactgaatgaatatagacatatacagtcatgcaccacataacaaggttttgtcaacaatgaatcacatatatgatggtgttctcacaaaattataatggagctgaaaaattcctgtcacctagtgatgtcctgatgatcctgacctcatgtaggccgaggctgatgtgcgtgtttatgtcctcatttttcacaaaaaaagtttataaattttttaaaaatcaaaaatttcaaaaatagaaaatcttatagaataagaatataaggaaataaaatgtttttgtacagctgtgcaatgcatttgtgttttaagctgttattacaaaagagtcaaaaaataaagtttatgaagaaaattaaagtaagctgaagttgatttattattgaagcaaaaatagtttttataaatttagcgtagcctaagcgtacagtgtttataaagtctgcagtagtgtacagttatgttctaggccttcccattcactcatcactcacttactgactcacccagagcaacttctagacctgcaagcttcaattacagtaggtgccccatacaatgtactatttcttatcttatattgtggggttttttttgttttgttttgtttttttgagacagagttttggtcttgtcacccagactggactgcaatggcacgatcttggctcactgcaacactgcaacctccctctcctgggttcaagtgattctcctgcctcaacctccttagtagctgggattacaggcgcccaccaccatgcctggctaatttttgtatttttagtagagatggggtttcaccatgttgaccaggctggtcttgaactcctgaccttaggtgatctgcctgcctcggcctcccaaagtgctgggattacaggagtgagccaccgtgcccagccttacattgcggttttatagtactttttacataaatacttaccactcagtcactgactcaccctaagcaacttccagtcttgtaagctccattcatgagaagtgccctatacaagtgtaccattcttatttttatgctatatttttactgtaccttttctgtgcttaggtatgtttagatacacaaatacttaccattgcataataatggcctacagaattcactacagtagcatctgtatatttttgtagcctaagagcaataggccataccttatagcctaagtgtgtaggtaagctataccatgtaggtttatgtaagtacactctgatgttcacacaacaaaattcccttatcatgcatttctcagaacatatccctatcataaagcaacatatcactgtgtggtgtgtatacatatatacacacatatatatatgtgtgtgtgtttgtatacatttatacacgtgtatgtatgtgtgtatactttttctatttgggtgcatcagagtctactgggagatcagtctgaacagttggaaaggtattgctactctccccaaagccactgcctcctcagagttcaaaacaaccctagagcacaaatggcattgttcgcagaggttgttgatagaaaggaaaagcaaggcttcagatggatcctggagtgctctccttaaaaataaaaaacgtgcaattacacgattttcaatatatccttttgctttttctttttatctggtttatgaacttaactaattacccatttaataacctcaatcactcaatttaagaacaaagcagggaaaatatattgagatccactgtgtcaacagctttcttagaagatgttcgtgtaatgttgtatcttccatgttttcaaaaaatgtttaagaacgaagactcgagataattttccattcaaatatatgccaagaaaatataggatgattagtatataaggaagcatttgacctgtcaaaaaagatgggtataaatagcatctgtagagaaggcagcctgccagaataatttgaacatgcctgaggatgccaaaaatgagtgttccttccagaatattaaattgttacaaaatgtcccactcacgagttaggtctttatttttgtccaaagcaaagaaccatcttgattaaaaataatcatagtttacactgattgagctgtttgggctttttcaaagttgtttgcctatattaactcatttaattttcatattaactctttgagtaggtacaattattatctccattttaggaaacagagacacataagggttacaaacacatatagaatgaaaaaggagaaattagggagctcctctcaatgaaaatgatctgtaggtatgttattccttcatttcttctgtctcttcaggcctcaatatatttggaaatttttgagttagagtcatttctaggctttatagaatgtttttgttttctacatatcaacactttctcttatctataatttgtgagttctgttattctctgttaccttgtaaatcaaatgaggtcaggtatgtttctataaatagataaggccactgagataactgtattaaactgggaggccccgtcatgtgtcccacgaaaatcttccatgaaagtggcagtggggctgtcaggtgtcagggtgtcagtgtcaggctggcggaggggaaaggagaagcaagcagccatctggctttggtgcctcgggggccactgtctatgaaactctctccaacctaactggccacacctgaaatttcatctttaaaggtgttttcttctggtgttgaagactttctaatttaaaaggccaatactgcagagatgcagcagacaaccaggacttaacccaacatttggcagtctggctgctgaaaaaagataaagacctgctgtaagcgatgtgtctccaagcaggggagaatgaagatctaagagctagaaggacaccgaagattagacgcaggtacccaacagctggcttgtatgtgaatggcagagagggtaagagagaaagagtgtaatctggttttaataaaacatgttaacaggagatattgacaattagcatcttcttttaacgactcaacgtcgagtcctagttgagtctggaaaatcaccaccaatgctgcatccacttccctgggccctttcattggccaggtggcaggtaaagctctaaagtggaggttggtgaagacacattaggactttcagctgatgtagctaaaaggcaagtatcacaatccttcgacagttgtcacctatcactattgatgcttactcagggaaatcatagaggccaacaatccccaacatttgggaagaaatgagaaatagcctggaagagatgccactgcaaagcagagggaagggaagaagcgtgcctctagacttgttcattgtgccctgcatacataccgctttctaccaccccagatagtaacaagcaactgtttgagctttaatccaacccactgtgtatcttgataccataatccacaaatccatgttagaagcccaatccacttcaggcataaaggaagctgaattaacaattgtgttctagaaaaaatgaattttatgaaaacactttacataaaaaattgccctgctgtgttagtgcttccctatatccgacgagatctatggcaccggcatgggaaggaaagaaaaaacacatttcgtatctatgaattttcatttgcatcacatcaaaacccagaccaacaaaaagatatttctcccatgtattgttatttaatatgtggttaaaagtcactttgagtacacttcaaaggaatagattgcttcagagtagatctatttatttatgttttcttaacgttcaattcagagcacaaaaaacaaaacaaaaaaacagcttaattccttaggtttcttgcagtttgccatagtgaccacgtccaagaccaaaatcaaggttgtctgaagatgatttgctcaaatgttaaaatctatcatcttccctctgctgtatagaatacatctaaaccatcttccaataaacaagctctttaaatatttagaatgatctactgtgtcccatctgaatcttcactgtagggtgacaattttccagccctttcttgggtcaggcatccaatatggctaaaattgtcttttaatgactgagaataaatttattccctagctttagatttcgtttgtttggaaacaacttttgaagatgcaaagccatttgcttcccaattaaattttcaaagctttgcatatatactatttaaatagagaaataattgttttagaaattgtgtgttctttgtttaatcgactgtttggtaccctgcagtccatgcctgcaggcagtgagatgaattcagaaggctaaacatttaaacatcctgtactttggaatgacggtagtatggagtaatagagtaatacaggctctttaactagggctgtgtcaaaccctgatattggtgagttttcttagattgaactcagagggaagagctgttttcactgtgcaagtgtaagattggatgcgcccccattcctaatattatccttatgggaatggcatggcaaactgttgtgatttcccaatgggtttgtccctgaggttccttacttgggacaccctaagagctgtgcttaaaatttgatgggaaactaactgatgttccacacccctaccccccatttcaactagagcagccatgcttcatctatttcacataacagtttcaaaattaggtgttttaaaacaaacaaacaaaagaaacagggttcttctattttccctccctctatttttttttttccataaaagacctagtgcagtaattaaggtaattaattttgaaataggaaataaatattttcagatctggcttttctgcttactagttctgactttaatgtctttgaaccatggttttctcatctgtaaaaagagctcatagtattcgtaaggtggttttgaggattaactgtgataataacaaccctttcatcctcttaggaaagctttcttctcttggcttccttgataccaccaaattccataccagggtttgatgagaagaataaaccactacgaatgatacagaataagacctttatgataaggattagacctcatgcaattatgggagctggtgaggcagtctttgtaaggctgttttttctgcatcttttgatgggcctgctagaagaataagggaggtgaggcaggaaggagcaaagagaaatggtactggggtggggagggggaaactggagcccaggaggacaaactggaggctgtgactctgtcttagtgtccccagcctcagtcacatgggtgaccgacctgcaggatagattgggtccttgcacctggttcctgcacacacatctggcccaggattcagcaaccttgagggtggagatgcagtgggagctggaggtacctatgggcttggccttgccccatgcatgaaggtgagacagcagattagcaatgattccacaccaagtgtcactgtactaactgctctttcacactctggaacttccttctctttacctacaccaccttcatacatgatctgaccatccctgcggttttagacgccacctaagtgttaatgactccctggtccaccagcaccttccttgccctgaattttctacaatatatgttgataggctggagcttgaaagacacagacatgaagagtcagccactagcaccccactcctcaccacaaacagatgaggctaatagatgatagaaacctctccctatcagctggggtgaagcctcatagtgttttcagagcactctagacagttacaaccaaccaatcataattgacacatgagctgaattatatttgctatccctagaggaataggtagaactcattgagatggaacctaatggggacaaacgttaatatctaagtaatcaaacagaaagagaaaataaagatgtggcttagcagaaatgtgtgtagaaaagtcttaagggaattgattgatagcaggttcaatatgactgttgattcgtgtctcaagactcacacacacacacacacacacttatactgaaagctttaaaagtattgatagaagtaatagtgcacaagatctgtgactgtccttctctactttgcactgatgagaccatagtagggacttggccctcagtttgacagttgtagtttaagaaaattatcaacaaagaggacgtgctgtctaaaatggcctggaggtgatgcaggaagcttgaatgcatattccaatgagaacactgtaaaagagccgtttgattttcagcctggtaaacaaaaccttaggggagatgataactctcaagtatttgatgtatttaaagagatgagaatacacttatgctagggacccacacaagcagaatttaggccagtggatagaattcagctgtatttaagaaagtatttaggccagatatggtggctcacatctgtaatcccagcactttgggaggctaaggtggaaggattgcttgagcccaggagtttgagaactgcctggacaacatagaaagactctgtttcaacaaaaataaaaaataaaaaaaaattagcaaggcatggtagtgcatgcctgtggtcccagcagaatactaaggaggctgagggaggagtcatgcttgagccctggagttcgaggctgcagtgaactacaatcatgccactgtattctatcctgggtgcagagcaagtcctcatctaaaaaggaagggagggaaggaaggaaggaaggaaggaaggaaggaaggaaggaaggaaggaaggaagggagggagggaaggagggaagaaggaaggaaggaagggagtgagggagggagggagggaggaagaagggaagagaagggaagggaaggggaaggggaagaggacgggagagagaggaagaaaggaaagaaagaagaaaggaagggaaggaaataaaaaagaaaggaaagacaaagaaaaagaaaagaaagaaaggaaagaaagaaagaaaaagaaagaaagaaagaaagaaagaaagaaaggaaaggaagaaggaagaaggaagaaggaaggaaggtctctaagtgtaagatgtttcatgtcaccaatggtattagcgcagttacaaagatcaattctgcttgtcaacgatttaacaaattcctacaaaccctatggagtctggagggaccaatggtttcttcaaacctttaagctttaaaaatatatagatttctaggtcccaatgtagatttactgaatcataatcatctaggataaggctagaatttgtgtttttaacaactcctacatgattctcacttgtcaggtgggcagatatgagaataccagaccagatgatattgaaagagcttttcatacttccttgattctacttctagtccatgtcataggaggcaatattcacagtgggaggagtatagactctacagccagaatgtgtgggttcaaaacccaactctgtctcccactagctagatggttttgagtaagtctgcatacctcagtttcctctctgttaaatcggtataacaatagtatctaccccagagtgttgcaaagagtaaatgagtaaatgggaaaatggggtaaagtaagcacatcagtgcttatatatggcatatatcagtattagctattttccttctgctcaaagataacaaatccatgtacaagacagtttgattaatggatgtatcagaagtggaagagaaagaaattacacaaaaacaaagaccttattgtttctacctttgtattattaatcatctttcaaaatagttccagctttagtgaacattataatgcagaacatatgtaaatatttctttgagtgttacgatcaattcttgtgttgatgggcattggggttgttttgaggttttggctattgtgaataaagttgctagaaacattcttgtaaaaatctttttttaacactaagtatttgctccttttaggtaaatatctaggagtagaatttctactgctagacatttcttgtcataaggtagatatatgtttaactttattaagtactatcaatccattttccaaattatttgttccattttgcaatcccctcaagaatgtgtcaaattctagttgttccatatggtcatttacatctggtattgttttaatttgatgttagcattcatggtgggtatgcaatagtatttaattgttcttttaatttgtatttccctgatgacacatgatgttgagaaacttttcatgtgcttattggtcatttttatgtcttcttttatgatacatgtaataaattattttgccctttaaaaaaattagattgtatttttattattgagttgtaggagttaattatatattctggatacaagttctgtatcagatacatgtgttacaaatatttttcccccagcactgtcttatctttttgttttcctaatggtctcttttacagacagaagcttttgctttttataaaatctaatttgtcactttgtaagagtcaatactttttgtttcctaagaaatctgtgcctgttctaatttcatgaagatattattttatatttttctagaagatatttcttgtttttatgtttttatagttttggtttttacatttaaatatatagtcaatgttattattgatgtgcattggaaggcactcttaagctttgttattggctaaattgtatttagaactattaggttctcctgatgaatttcttcttttatcattataaaatattttcttaatctctggtaaaaacatcttgtcatgacatctattttgtctaatattaatacagacacttctactttcttgaacttattttcataggatgtctttttctatccttttactttcaacctataagtgtttgaagtgcatcctttgaattcagtgtatatttgatcttcctttttgtctagtctgatagttttggccttttgactatttaattcatttatatgtaatgtaaatattaatatggttgactttagctccataattttgctatctgttttctatttgtttcttccattttctgttttgctattccttcttttctgccttattttggcttaatctaatactttttattattccattttattttctctatattttttagctttctttctttgtatttgcttatttgttgctctaagagattacagtgtacaaccttaaattatcactgctccatttcatataaaatataatagtctttcaacaatattgttctactccgagccattcttgtgctgctattgtcatagattttacatgcctgtacattataaacagcataatacacaatacagtgttttaatttttgcttaaattgtttgcttctttcaaataaatcaagaggaattttaaaagatagatacccacatattaataatttctgagatttttcttttttttccccatagtctgagtctggttgcatttcccctccaccagaagacctctatatagcatttctgtagtactggtttgctgacaaactattcattttatttttgttccttgagaatattcttagcctaccttcaattttgacagaaatttttgctagaaatagaattctgagtgaacaggtgttttctgtttgtttttccttttttttttttcttttatcactttttgttccttgagcagttcaggcccatttccactctgggcctctatgcttgctgcttgctacccctggatagctctttaccctcctcttcacgtctcaggctaatcagcattgtctggttccatttcacacttctccgagaactctgttgaccatactatcccaaatcactcttcttcccacttactttcttcctcatgatcctgcttatatactgtgcaacactttcacaacctttaattatattttttaatttgtttacttgtttcttgtctttttccctgattagctctataagaaaatgtactctgtcttattctctcccatattcatagcattcagcaaaatatctcacacagtaataaaggctcaatgatatgtctctaatgtagaatggatacaattgaagtcatagggacttctagctttgctagacttgaaaagacatattgagtagtcatgtgctgctgaagtctccaggaccatatgtttaacaaacactgtgctaggaaatataaatacaaaagtgatgcatcttcaaggagcttttccagatcctctgagttagaaacaatctcctctcctctagctcctgtaacatttcacttcatcctcattgtaatacttttaatggtctaccttgaattgttgctacttctatatctgttttctgtctccaactggattgtctgacaggtccttgcaggtaggaactatgtttttctaacacatattaggcaatcctgcagaaatagcctttaggtcggcagaaattttaggatactcttaatatggtgttgcgctgaaaatgaattgaacaaggaagttagcattttttggtttaataagatgttctggttctctaaggaaaagaagactcatataataccaaagtaattaggatttcaactgtgcattaataaagcacagttcccaccaaggacactgtgtcatgcgtgggggaggactcctctgccccttctctgtctttgttcttgtttatatgcactgcctttccaatttataatccctgtagtttgcatcgcaataaagtgccaaatatttcctgcccacgcctctggctgcagagcgtgagaactgttatggaaagcaacagatcagaatatgttttagatttgttggagttcttaaaaatgcccatttttaaacataaatatttatgcctattgcaagctgaacctctatttgttatgagaactttgattagcctgtagcctgaagaagacccatataaatagtagttaatatttattatgacaagattaatggagaactctggaagaaataaaccctgaagctggttttagtattctgattccatgcttagaagaggagaatgggtcagacctggataagcatttaaaaactcacacactggtagtgataagttatagcctctgggtttggggaccgtaataatcttactgaatcatgaatccctgtgaaatggaaagtcagtataactatagcacttttttatggaatagctttttttttaaaggtccagtattgttctgacaaatttaagttcccaaaaggagtatgatttttatgggagtattctttgtaaagtgcaggtgtatggtgagattgggggttatgatctgaaacttcttgtacatttccaagccccaaaccaaagcttagagtatcagaatctcccgaagttttgcctgggaatctagattttatcatgatcactggaggatgcatccacactctgacgtttgggagtcactgcttgagaaaataggtttcaagatttgtctgttttatctctgaactggcagtttgtacctgaaaagttgtcagtctcttaggctgcttcctaagaacatcccagatatttgtggtttcattgttcttttctcataattaaatggactcttaattgaacaatcaggtgagtcagtacctgattatgtgattgaaacaaaaacaaaaacaaagctagctctcatgccaacccacctagcttactatatacatttcaaagaggtctctctgaaatgctcactgggccataataatgtgaacgcctccaggaaactctactctttgttcagattgtagatgtgggcagttctaaggacactgacattcagggagcaggactcattggatttgatgcaatcggaaagtaactttaggcctggtgcagtggctcacgcctgtaatcccagcactttgggaggccaaggtgggtggatcacttgagatctggcgtttgagaccagcctggccaacatggtgaaactccgtctctactaaaaatataaaaattagccgggcatggtgacacttgcctgtaatcccagctacttgggaggctgaggcaggagaattgcttgaactcgggaggcggaggttgcagtgagctgacatcatgtcactcgcactccagcctgggtgacagggcgagactccatgtcaaaaaaaaataaaaaactttatttctttcctccattagttcattcaaattgtctttgtggggttattttttccaaacttttagatagaaactagggcaagtttcacgaattttcacttatttttaagtagtagagtcctttgctacttgtaaatacataaattctgtattccttaattaatacatccatgatagagcagtaatttttaaatatttccaaaatttattaaaagttaattgtcccctcctccagctcagtcctgcttggcgctgtccacttaacacgggaaaagagggtgtgggaggcttctctctttgttctgcctggagcttttgcttttcttctttgccctcagtacattgctctggctcctccagggctgagggacacaggtggaagactagcaagggaaatggaagtttacttggtaggtcctgtgcaaagctagcatggatactgcttgactgggcaggaagtgcgaattgattctcctcaggatgcttttgtgaaaggaaaataaactcaggaccccaaaatcactaagccaagcgaaatgtcaagctgggaaacctgcctcccattttcttcctaaatatgatagctacaaatttcaaaagctacacacctccctcacaatttgccttcaaggaaattcctcgtggacaaagggcagacagaattcaaagtcatccatctgaggctcacctgagacaaatgcatatatgattgtttcctctaccctactgttgatgtaaaaatgcacatttgctgagccagactaaattctgtatttagtgggaggccgatcaaggactcaaaagaatgcagccttttgtctcttgtctactcatgacctggaagtccccgcctcaagttgtcccaccttaccaaaccaaacaaggtacatcttacacatattgattgatgcctcgtggctccctaaaatgcataggagcaagctgtaccctgaccactttgggcacatgtcctcaggacctcctgaggctgtgtcagagatgcgtgcttaaatttggcaaaataaactatctaaattgaaattgattgagacctgtctcagatactttttggtttacaatttcatgactttttcacagacttgtcattacttaatacgggctaagtagctcctctggtatcactttaagcacctagattagccaggtgaacactttcagcatctttttgctgaagtatcattgccctcaacttcaggcagcccttttgggtagtatctaagaagtcatcaaatcagcttctttcatacagggtacacacagtctgtgagaagctttcacatatcctttcttctgacaagctctgagaacacaggccatgcccaattctgtcaccttttatactttgccaccagggaagataacaaaccacagtctctagccatttggatcttgcaggtgatgacagagtccaatctaccacttcccaagcaacaagaaggtactcctcaagccctctaggtagttctgtgcaatcccttctccacaggcttaaggtgagggagaactccacggtcccacatggaactcacggtacaatatagctctctcttaagaaagtctctacccatttctttctttcttcttcagtctcttcttcgtactggtggtgagtggtcagcacgggttcgtgaccacttcccctggacgttctgcactgatgctctcttacctcattttggtaatgtgggtatagttatcatctgtgtctaggacttcccagtagggcttcaactggacactcaaacagaaagtgtttccatgttaacatctcttcaaaatagtaaaaatagcaagcccgtattgatcacttgttatgtgctgggcactctcacatacatgccagatctcactcagccctccccacaatactgtaagaaaacagaagtccagaagggtcaaataatttgcataaagttacccaggtagcaagttgcaaagctatcccagcatagtgcattattttcttttcaggaaaagaggaataactttgcctgttaaaattaaatactatgcattgataaaaacaaatgctacagctttcagtcctggcatttacaatgctagaacagaattttgtactcatttgctaaacattgttgtatatatatgtcactttttttttttgagacaaggcctcactctgtcatccaggctgtcatccaggcaggcagtagcactgtcatacctcactgtgatcttgaactgggctctcagcctcctgagtagctaggactacaggtgtgtgccaccatgcctgacttttaaaaatattttttttgagaccagatattgccatgtggctcaggttggtcttgaactcctggctttaagctatcctcctgcctcggcctcccaaatcattgggattacgggccattgtaatatcttattcacctagttcttacaacacctggtgatgtgatcagccttgtcttcgtcttgtagatggagaaactgaggctagaaatttcatgacttcctccagatcacaaaactagaaatgaccggagtcagaattaaaatccaaagtttcagatcatgaccaactttacttttctctctattctgaagggacatactagctgaaggaatatgtttcattatgggtctcagctctgcggcaaatgtttaaggctatttggttaaagctgttttctaacataaattggctctagatcagtcaagatttttactaaacttctgaaagcaaagagcatcttatccatcttggaatccctagtacctggcccaaagttgatactgtattagtgaattaattaaatgaatgaaaaagtgaatgaatagattgccttctaaattctggtggaacgtaagacttcacatgaaccagattgatgtattattctcctcctggtatttacattttataaaataatcctagaagaaacacctaaatgagtgatgtctaaagttgaattttcaatgctgtcattggagtagagtggaaaggaattaggatagagtttttctctggagtctcaaatttcactgcagagatgacagtgtattatgtctatatgatctagagaaaaatagaatgcatctctgtttgagtataaaatgcccaggaacaccttacctcaattcaaagaaggatgctctaataatttaagccttccagaaatgaaataagctgcttctaacatattcataattacacttctgctaagagacctgttggctgtgctctgcaaggaagggttgaagtgttggtggggtagatcaggagttatctccgacactgtgtccctgaacttctggagatgctaggattcatttcaggtggttgacgactggatgcagctaaccaggtctgtctgttgtccacaggtctgaggcgcaattacagatgtaccatctgcagtgtctccctaaactcaatagaacagtatcatgcccatctgaaaggatctaaacaccagaccaagtaggtacttttgtgctttcactcttcagtttcttcgatgtaatttttagtaagatgactaaaggctcaacatttcatctatttctaaataagtagagtggaaattacatctcttttgcttcaaagttcacatgatatttatgcttacttgaagaatggcttcttccctttatttggcatgagtaataagaatctctttttttcattttttcaaggacagtttagcatacttttatgaaattaggacatattaaaatctatgctaagtgttttaaaatcaataatattattcttatttgtaggatgtaccaaactttgatgacaaattctatgaatgtcttctaccactttccctttctggatgaatattgttgattattatagaaacataacaaatcccccaggatattaagtcatttatatacaatgactattcactattatacaatgacatttatatacaatgacattcactatttccaagtgaatggaaacttattccatttttttcaaatattctcataattttaaactgagaaagtctcaccaggcaccatttcacctatatttatactatgcagctctttaaaaaccactggacatttttaaaccagctgctaggactgttaataaaatgctaataaaatatgaaaaaagcaaagaatgtctcaaaaagttgtaattttcctgagcataattgttttcatttctgtaatattcattaggaggatcatttaacatattggactgtatcaagacctcatgaattatgaatgttaatttaacaaacatttgtcgagagcccactatgtctcatactccaagctgtgcactagggaagaaaagatgaataggccgggtgcggtggctcatgcctgtagtcccagcattttgggaggctgaggtgggcggatcaggaggtcagcagatagagaccatcctggccaacacggtgaaaccccgtctctactaaaaatacaaaaaatgagccaggcgtggtggcacgtgcctgtagtcctagctactcaggaggctgaggcaggagaatctcttgaacctgggaggtggagattgcagtgaaccaagatcaggccactgcactccagcctgggtgacaaagcaggacttcgtctcaaaaaaaaaaaaaaaaaaaagatgaatacattgagtccttcctcttccccctgccaggctgaggaaacagctgtgtaaacccatagattgttctctaatgccacgtgtgcacccggagctttaagcatgggggagggagcaatccagggcaagctttaggggacactagtgcagaggctggtgcataaggatgaggttatggtctgattttgctcaacacaatatccttgtttcctagcacagcatcagatatgttattgggtctttatacacttttttgattaaatgaatatgtgatttcaaaagatgagtaacagttttctaagcaggagtatgaaatggagcattacaagcaaagaaattgttttgcaaagatattgcaaagatgtacatcacagggagtctagctcaggtgagaaaatttaaacccaaagttagttactgactctcagttttcttctcaatattctgccttgtgagtcaaagccagttccatggcttgcattactctggtccgcccagaggactcttactggaataattcttcaaaaagaagattttccttgatttgttatggaatactagagttcttgtattaattatcggatactgctcatccccccaagctgttttcatcatttctctaagtaacattttgttacaggcaccatacacatttgaattaacctgtatctgatgtgcagacagacacacaaatacctgcaacaataaaagataactttttgggagcatgtattcatcactcaatacatagaaaaagataaacaatgactttaaatggtatgaattatttaaataactaatacagatagtacctccagattcagaaaaatgtctctcttctctattctgtacatatataacttcatgggctagaatctgtgctaggtattttcacatctattatctcatttaattcccttaactacccttgagataaatattaatattattgacctgttatcttacatgagaaaactaatgcttagagaggtaaagtgacttgcccactatcaccctgaaagcagatggcagagccagcactgatcacagtggtgtctgacttatgtctccacttactccatgtcattcagttaacacgaacttaggcttggaatgggagccaatagagagtagtatgtgcattttgaaaagagggttccacttccttgaagtgatttaaatacacaagacttcagaagggaacatctcttatagtgctgccttctttcctataaataagatgttattcatttctaactcaaaagaacaaagctgctctctttgtgaagaaaataattacactgtcctgtttcacatgcctgttttatctgccattagacctaatttgcatatcatgtgcgggcatgcttgtgatcaagattgagattgaaagagagagagagaggagagagagaataaatgataaatgtttgttcaattcttttgtctgtttataaaaatcaatttttttttagtaagttgtagaagtgtctaatttttaaggaagtctaatttatcagtctttttttatggttaaatttttttgagtgctatttaagaattctctgcttatcctgaggtcgataagataatctcctatgatattatgttgtttttccttacaaatataggtctttgatccacctagtgttaattttatgcatagtgtgagggagagattgagtttcatgatttttttccatacagataccaattaatccaatactatttactgaaaagaccatcatagacattttttgtaaatcaggtgatttacatacatgtgtacgtgtgtgtctgtctctatattctgtctcagtgttatatttctttttttatgctaatgtcacattacttatttcctataattttatagtgtcttgatatctgatagtgtaaatcttctaattgtatcttcttattcaagactgtcttcactgttctttcctctttgcgtttccctataatttttaaaatcagcttgtcaacttcctcaaaaaatccttcaaaatactgagttttctaatccataatcatggtatataccagcgtttgtttatatcttctttaattctttcaatagtgttttctagagttctttgtagaggtcttaaacatctttatttagatttattcctaagaatttattgttttgggatactagaataaatttgattatttaataatttcattgttaaaattaattactaaattaaataataattaaaatctattattgtttataattgatacataattgtacatatttatgggacctagtgtgatattttgatatatatttataattagcaaattcatcacttcaaaaatttatcatttctttatattgagaacatttacaatcctctcttctagctatttgcaaatatgcaatacatttttgtagaacactaaaacttgtttcttttatctaggtggaattttgtatctattaaccaatattttcctctcccctctcccactattcttctcagcctctagtaaccacgatttgactctacttctatgagatcagctcttttagctttcatatgagtgagaagatgtggatcttctttttgtgccaggctatttcacttaacataatgtcctcctggcttatccatgcttccatgaatagaaagagttcattctttttaatggctaaatagtattatatgtctttatatagatgacattttccctatccattcatctattgatggacacttaggttgattccatattttggctcttgtgaatactgctacaacagaaatgggagcacagacatcttttttttttcttttttgagatggagtttcactcttgttccccaggctggagtgcaatggcacagtctcggctcactgcaacttctgcctcctgtgttcaagcgattctcctgtctcagcctcccaggtagctgagattacaggcatccaccataatgcctggctaatttttgtatttttagtagatacagggtttcaccatgttggccaggctggtcttgaactcctgacctcaggtgatctgcccgcctcagcctcccaaagtgctgggattacaggtgtgagccaccacacccagccaccatttcttaaatacactgactttctttcctttggatacatacccagtagtggaattactggaacatatggtagttatatttttaggttttggatttattgtttatctttgcagtttggtggtttttcgtagtgataaggtttgattcctttacctttctcttttgtttatctgtcccaccagtgagatactttcacatatttttataatggtagttattcttcttttatttctagatgtaggacttccttaaacattttttgtaaggctggtctggtgatgattaatttcttcagtttttgcttgtttgggaacttcatttctgaagaatagccttccagggtatagtattcttgactgacagtttttttttttttttcctttcagcccttaaatatgtcatcccattctctcctggcctgtgaggtttctgctaataaatcggttgttagtctgatggagattcccttacatgtgacctgatgcttttctcttgttgtttttagaattctctctttgtctttgacttttgacagtttgaccgtaatatgcctcagggaggacctttttgggtttaatctacttgggaacttttgagctgtgtttatgtggttgtttatgtatctcggtaggtttgataaatttttagctgttatttcactaaataagttttctacacattttcccatctctactccttcttgaactcccatagcacaaatatttgtgttatggtttcccatatgttttcaggctttcttcatcttttttattctttattatttttctattttgtctgcctaagttatttcaaaaggtgtatattcaagcttagaaattatttcttctgcttgagctagtctggtttttttatgttcttgatggtactttttattttattcattgaatttgtcattgccaagatttgtttggttatcttttttgagatatctaactttttgttgaatttctcattctgataatgaattgtttttccaattttgttgaattgtctatctgtattctcttgtatctcactgaatttccttaatatttttattttgaattccttttctggcattttgtaatttccttttttatgcctttattactgaggaattatgatcctttggaggtgtcatgtttccttcacttttcatgttttttatgtctctacattgataactgtgcattcagtagaatagtcacctcttccaattttatggaatagctttcatagaaaagactttttcctgtagatggatcccagagtctcagtagaatagagtgtactgactttgattctaggtaaacacagtagtatggtctctgtatagtttctccagctgtaattaacagtagtgatgttgtaaatgcctcagtggcctcagctgtgggagtttgtgggggcagtggtgtggctttgctgaaggtgagcttagtgaactggttctcagtctggggacatggccatacacttggtgggtcagctggctctgagactgattctcttgggatgaagctttcaagctgtttctctagcccaaggcataggggtttggtggcttgggcttctcagggctgtatcttcttggggtgggtccacaattgtgtttctctggctgggcgcatagcatacagtggctcagcaattcagggacatgtctgacaggctgtttctccagccagtggtgctagggaagactatctgggggcaggtttgctgagctgtttggcttggacagcctggggttgacttccctgctctcaaaattagagtcatggccatttctgagcctcagccttgagcagccagggtggtcatgttgcagccactcatgtgagcttggtgaaacaacagcagagtcccaagtctagaaaggcacagtggctatcagctccccagaacaggtcacactccagcagtgactttgatttcaaaataatgccatgctgcagcagcttagatcatggggttatgatcagtaaacaatgtgggctcctacttttggagtaatgtagccacaagaattctaagcatctcctcaaactgggctcaggacttgtgaggactttgggattcccctgtagtaagaactacaggtgtctgcagtgacaatgtgggctggcgagggtacttctgcctatcttttctccacatgggaaagtccttcttggctctgagtcaaacgtgatggagaagacagggtagcagaggtgggtgcctcattcccctctctatgctggacttttgtgctccacaaggattttgccaattttttgctgtacatcaacactctctttcagacactccaatcaaattttagttgtttattttttattttggttctttttttgtgggaggaacaaatgccaggcaccactagtcagccatcttgctgttgtctccttacttatattctgtctgcatattctacccaggagaaacaggcgttgaaaacctttaactataaatatggatttgcctatgtatccctttttctgtatattttttggttttatatagtcaaagtatattattagatacttacaaatataaattttaaaaatttatttccattcatttggccctttgtatcaacttttattcattatcaaatgtttttctttttccctagtattattttttccttaaagtataccctttctgatattagtgtacaccaacatcaactacactaactcttcaaagcttttaaggatttcaaatattttttcctttaaatttaataatatccagaatttattttgttttcagatggaaggttagtgtgataatacttaactctaccatagttgaaaatgtaagtcagccaaatgtacttaactattgcaatctgaccaattaaataaacataagtattcaggtgccagtgattatagaggtatcagatttatatttttactaataatatctaaagaagtgttggtaagaaaaaagattattaaactgtgtggtgtaaagagcactgaattgtgagtcaggagattttaatcctcttgtgactttgccactcagtggccttgtacactgacaaatcttttctcaatcttaagttccttcatggattagtgattagtgatgacaagaacacaacaaatatgggtccactttccatgcccttgctcatgatcctggcactctttccagctcatcctaactatagctttaaaattgttctcaaaacagatttccagatagcctttgccattttattggagctagcactttgtatgtatagtgggttgaataatgtctttccaaaattcaggatcccctcagagcctcagaatatggccttatatgtaaatagggtctttgcagatgttatcagttaagattctcaagatgaaatcatccgaaatctacagtaagccttaaatccaatgcctggtgactttaaaagagaaaggaaagggagatttggatacacagagaagaaggctaagtgcagatgaaggcagaaattggagttatgtttccacaaaccaaggaatcaccaggaactggaagagtcaaggaaggattcactcctagagcctttggagagagagtgatgaagctgacaccttgatttcacacttctggactccagaggttgtgactaattcttctcttatggagagaatgaatttctgctgtaaactacccacattatgatacattttaggcaaccctttagacacattttactaagccactgcttacaatgcctgccctggtgatgatgatgatagagatgatgccaccatggataactggagtgtaacttgtgagcctctggagtaaagcaacaaattttattgttctgaaagtactaacatatctaaaatgcacagcattcttgtagttggccagatgttcttatcttcaggttataggttagaaaattgagtctcagagaagttaaatgacttttccaaggccctaaaagtaattgttagcagaggcaaaagtcaggtcatatgcctttattactactactattatgataactaatcaaactgtaattgtcagattgctctttgctggtagtaaccagacacggtcttttacattttggggcaaaagctgtaaacagcataatggcagtcaaatttctctccattgttaaacaacaggagaaatattaactatctgatgagattaaaggtttggaaatgcaaatgctcatggcaatatttaaagcaattgcctattagtagacttttcagagcttccaggggatatagtttgtcaattagtacaaatgattaaaataaaatgtaaacgcactgtgagtatgtaccatagattaatgaacaattccccattaatatacttaaatttgagcttagggaacactccaggcctcaggacatgatgttacctagaaataaaggatatgaaagttgtcattacttactttgatacttcagttggttgaaaatgagatacaagtgtctaagataataaattagactgaccaaaaattagtagtaatttctaaatctgcttcttcctttgagaagaggccttaacacgtgatatccatttgtttctctgaggtttttttctaactggtatgaatcctcatgacaaaagcctcgtattatttatttccccattatactcatttatttgggaagtacttgaatgaatgttcagactcattttcagggatggagtatctttgttttcaatattttggaattcgcttcccacattcagcatactagttagttagctgagggtcgcacagtaataaataagacacttttgtaagatacatgaaccacaaagaaccttctatatttaataaaagaataaaagcagcttaaaatcctgagaagatgttctctttgaaaacaatcaaacaaatcataagtcatgcatggatttcaaaagctaaacatattaatattctttgtagaattttcaatgtagtttactgatattaaccaagaaacccaataaccaagaaacctgagacttcgatattgtgcttttcatgagaaagcatttttttctgaaaaatacaaaatatgtatcaccagtaaaattttgagataacaggccataagaaaatattgaaaatagagctatccttttccaaagaatgtaaagttatttctcttcagctgataatcatttgtaagctgatagtaaagctctgaataaagggtgaaatctggaacccatggctaattctttgcttgccccattttataattctgaatgtaaaaaatagctcttctccctgaaagtaagacttgtggtgtgtcatcaagtctttctagctaaggactatctggataatcagcatcactgtgacaacgacaggaatgaggctgtgtcacagcctttgggccaaaggctgctttctacctagccctgtctttaattggtagaacattgaaatccactattgttaagagccctccattctatgaggaaggcctcagaagaaacaggctctaacttctcacatggaaaaggcagtagctttcagagagaatttcagagatgccgaaaaagactgtatatgtatctctatatctacagcactaatacataggcaattttagcagctctatttttctaagttgcacttgcatgcttttgctatacaggctgtacctagggatacattataattacagtatgtgactagatgaggtgttttgccgacttgaaaagaactaaatggggagcatgttcattctttcatatcacctctagaattaccgatgacacttaatattgtttagctcattcatttcctccctgcttccttcttgggggacctataatcattattttgtcttgcttgaaatttgcatgagtcatgattgcctccagaatggttccgagctgatgatttaatgtctcagctttaattgtgaaccccacagaatacctctcatgttcttacgatgctgcttcagattagtcctccagtaccaatctccaggggtgcaaggtcattacccgatgtggttctgagaagtttatttgcatcaagaaagaaaagaactggaaggagagtggtggagccttatagacctggcctgggaagcagatggccagagtcccagggtcagccctgtctctcaaatcctgagatcctgagtggctttaaaaacttcacaaggtttttttgtttgtttgtttgtttgttttctgtcgttgttgttctttgttgttttggagacaaggttgctctctgttgcccaggctagagtgcagtggttccatctcagctcactgcaacctccacttcctggacttaaatgatcctcccacctcagcctctggagtagctgggacttcaggcgcacatcagcacacctggctaactttttgtatttttagtagagacggggttttgctgtgtggcccgggctggtctcaaactccttgtctcaagcaatcctcctgcctcgacctcccacagtgctggaattataggcatgagccactgcacgtggccccacaagttacttttaaataaaccgattaagctgcagttgaatacagtgctatgcacagatttcagttatacaatttgatgggttttgacagtcatctacaccatgcaaccatcagcccaatcaagatgtagaacattttcataaccaccaaaggttctcttggacccctttttgcccaatttcctacccccatcacagctaaccattatctgatttctatcactgtagtctagtcttgtctattctagaacttaatggaataatatggcatgctttcttttttgtctggctgcttctgctcaacataatgtttttgagagttgttcacattaattacacgtgtcattagttctttcttttcctttgtggatttgaacaaaacaagttccctcactgagttttactgtcttcatttgaaatgtgaggggttggaatacagagtagtcaaggttccaatcaattccaacaatctctaatattatgaccttaaagtttaaccgacgtttctttagtgtttttctattttccagctggcagaaggttgtctgtaaaatcttttttctccagtgctttcttctttactgcacggtggcctagaagctgacccaccctgcagttgggtccagctaggcctactacaaagaacaacattgtggaggcctctttttcctgttcttacgttaaaggcaatagggctgttcaggtggctatgacttggggcagaagggataaagtcggttttacagggagaaagtgaagaaaggagcttattttcactttatttcctgctatgaatacagagcataaactctaatgacttctcaggcaaacagggatgggtaagagggagtcaagaaggttctaaaggagatcctggcttctcctctgagcagcccaggctgctggacttaccctcattctgggtcttctgtaagttagtgtagtgccttctcatacatttcaccaaattttataagaaattaaaatatgtccatttgtaaactatctatagctgacgttgatttttacaaaaactttagtagaattttgagtttagccaacatttctctgatctcttagaagttgtggattgtggaatacccggcaattgaattaagtaaatgagaaatgtcactttatttaattagattttgctggggaagtagggagagaaggtaagttgggaatggacatgtccttgattgtgttcctgaatcagttatttatcacttctctttggggtggaggataagagctcattttggctgggattttcattttgtagctggagtggtggtgtgaattattggacaaatcagctcccccatcccatttaatttaatcccataatcaaaatccgttgagtactgactgtgtttgggacattaaaacaggccctaggggcaatgcaaagtgattatagagatgattgtaccttttaacaattaataatctagttgaggggatgcaacaagtagtgattacagttaacgtcaacatatgatatggtgagtaaaagaggtgcaaaacatgggtagaattcaggggaagaagtaactgcatctgcctggagccatcaagaaaggttattgtggactgggtgcagtaatgtgtattgggaatgagactggctgggttcagtcctgaacctatctactaattctgtgaccttgaacagatacttaaatacctcattatggcttagtttccatatctgtgaaatgtaatagttataaaaagtacctacccaaactgactatagtgaggattgagttttaagaacaaaagcaacaacaataataataataagtactaaatgggccccgaggaacgggtagatgaatgttgaggtgtaaccctcaatacttctatcccaaaattatgaaaatgcccagaatttttccttgcatggctagtttcttgcccaaggttggggtttctggattctcacaaagttccggcctgctcagggtttagaaccccagtggatctcagtgaagctgcgggatagaagaagtgatccaggaaaggtctcgaaagacgattctcattctgagtttcttgtggtcttctgcctcgttttatacaacagtttcaagcttgatattcagtcctgcactctcggaagaaatgtttgctgaatgctctcaattatatgtggccattacaccctaatttctcactcagactcccacttcctctagctctttgacaaaatgaccaagttcattttgtcagtcatgtacaattagcacattattctctggagaccatggagtattaaccttgacaataaataaaataaatgaaactattttcctggatgaatttcctaaatcattctcccagtggtctgtgggattctctacgtggaatttctttaccattttgattttaggaaggttatttttcttcccatttgcatttttcattttattattaaacatatatacactgcctactcaggaatctttatgctaccactgatagtatattctggctaatctcaatattcactgattaaatctgagtgatgacatttgataaatgctatattttccagagttggaaggattttttcaaaaaacaaatgatgtctatgcatgacagagacatctctttaagtgttaaacactgttatttaggtaattatttagtgataaacattttaaagagttttggggtttttttttgttctttcttttttttttttttgagacagtcttgctctgtcccccaggctggagtgcagtggcatgatcttggctcactgcaacctccgcctcccaggggggttcaagtgattcccctgcctcagcctctggagtagctaatttttgtatttttagtagggacagggtttcaccatgttggtgaggttggtcttgaactcctgacctcaggtgacctgcccgcttgagcctcccagagtgctgggattacaggagtgagccaccatgcctggcttttcttcttttttgagttaatgttatctagaccattctatattgtgttaagaatagccagatgtaaccagaatctatacctcattcagaatataaacttatataaatatcaatagtaatatgtattacctgcaatagtccttaacagcaaataggaaccatgtatttttctttagcttttagagtaacagaaaaatctcagtccatttcatgccgagtagtcaaatacaaatcaaaatctataaagttcgctttcagaaatgttggtgttatttcaagctctaggacacaattagttcaaagttctatctacggcctctggtgctattgtactctccagagatatatctgtcttttctcttccttatgtaagtgcctttccttctaaagacacccaacaggataacatgtgcactttactctttttgatttctaaaaccatcaccactgaactgatttatattctaacaaaaagatcttataaatgccttaaatagatgagtttcagacctctggttttatttcctgggacatggataaagttcaaataatacattctgttttctgacaactttccactgctaaatcacataagcttactagataactcagatgtcatggccagatagcttactaaattagcacctagttgtcccttagtatctgtattggaatggacactttaagtctctgtgtaggtgggtctaactgggtatgttaaagtttctcattttaaatctagcttttggtcagtataattcctattcaaggcaactgagtaggggggagcttcagatttttcagtatcctccataccagaaggtttggaagtcatacaggtttctatttcttagtcttggaaccagatgtcatcatttctgtattccacatcccgtgagagtcctgaaagtaaaaatgcacctcccatggaaaggagagatcaggtcacagtgtaatttgagaaagtcatcccagcctggaaattgaatgaccaccctctgctgcaccccttctaaaggtaataggaaggaggtcaggttctctcacacccacatgtccggaaaacatcagcacaagttaaaaaaagatctgggcaatgctcttcattctatgtgcacattggagaggcagctttcatttccaagttactctaaagaaacccagtataaaataactagtcaaccttttggagcatgcaagtgatatttctggagtgaatctagagagtttatttctgtggatgaaatctggttcactcacgatctggaggttttcagtgagatagtgtgtcacggcggaggaacatcagaactttccttgatttggtcaatagtttagcaaatatttattaagtgacccacccactctgtgctaggctctgaatcacatagtaaatgacaagtaaataaattgatttcttgtccttaaaatgctcaggtaatttttaaaacgcctaaaccctaaagcgctatgattccagaaaagtcacccaaattcttgaactcattgaaatcacaggagagagtgctgggggccttcacagtggtgaaggtcctggagtcctattagcagctgtcaggagtgtggtgttgggtgactgggcaccaacatggacctgcagttcttccaagcccaagttatcactggcaatgtaggttctctgaggagctcttattaaaaaaaaaaaaaaaggtagcctggaacctgagttgggaaagaaggcaggcttaggatctaggagggatgtcagatatgaaaaagatggtggcaatgaccaggcgtggtggttcacacatgtaatcccagcactttggtaggccgaggagtgtagatcacctgaagacaggagttcgagaccagcctggccaacatggtgaaatcccatctgtactaaaaatacaaaaaattagctgggcgtggtggcggatgtctgtaaccccagttactcatgagccttaggcaggagaattgcttgaatctgggaggcgggggttgcagtgatcgccccactgcactccagccagggcaacaagaacaaaacttcatctcaaaaaaaaaaaaaaaaaaaaaaagatggtggcaccaaaccagcacttgctgttgtgttgaatgagttgatatagaagctttgacttctaaggacttacccaaggaaattacttttgtcacttagaaactcatattttctgggcattctctgaaaagccctcatcacttatatatgaggatttgaattttgtaacacctgatagaatatttcattgctattaagtaagggaagaaaccagggtttaaaacttatgttaagagcaaatgacatttgtgatcaaagaatgatgattagagacatcaatctgtccaatctctgttgaaaattactttgattattctttctccctaataacacttgctctagtgtcatttaaggaattggtagcaaatgagcagctccaataagacagtgtacagataaaagagtaagactggatgtcagattttgttaacaagaactgctttaatgttctaaagcagattttttactatccgtgcaggtaatttttcttttaaccttgaagtaagattattcctgtgtcttctgattaaaatatctcatcctgtgcccacaatggatgctcaacaattaatggtctttcttttctcaactgtttaattagggttgaagccaacacataatttgaatgactaaaatcaatgaatatcatgaatatcattccaaaatgtactctactaatgtgagtaatttctccattcccatgagacagtggaacaggctgcaacagtggccctgccttatgatgtgatttcaataaattgcttccttttctcaaagtgatatgttctcccctatacacacctgctaggtaactgtcaacattttttccacagaggaaaactttacttttgtctactttgcaggcagggataattgcacagtgagatgtgcaaatgacaaatactaaaatcttatctgtgagtttagaggggggtggcccgagactgaaatatagagtgtcattgacagggggagagaaggcagaaagaggaagctggcatcagcaatgaaaatcttggccttttagggtccagggttgggcaatcctgtagaaataacacctgcttcaatatactctcgacttataaaaagagaagtgatcaatacaaaactcagtgagttaaatattgtctcctacatgaacacattcctggactcccttaccatggtaagtttgtccatgaggatttctttgcgttctccagcttagtgttcataaagcaaatatttcaagtattctggaactacttgacctcattcacgtattttctctttttggaggacagaccaaaaataagtaatttcatgatcatatttattcagaaaaggctggtggagattagatgtgtggtctctgacaatccgagggagcctgggatgagaaagtgaaaggacatccctttcctcagccactgggtggaaactcattggtttcccctgtaggagacctgccatggggagcaagggtaggggctggaggaaactaagaggccctcctgctccctcacagcctaccagcatcaccccagtttctggactagttttcagagtcaaggaacagctgcctttaaggacagagccactgtggtcaaataaatcatatcctttaccctctgtcacaaaattcatgggtctaaaaagagagttggaggtggagagagataccttatcaagtcaagcagaatcatgcatgtggaataatttcataagatatcattgtaattcaaattttaaagtctagttcagaacatttcatgttcttatctgttttttcatttcaaaattgtttcttctactagtagtgctcaaagaagatgaattgcatctgttacctttggatttagacagcagatatatttatggtttcctagcatgttccacttttgctagagacctaatacttgagagagattcagttctgctctgtgtatttactctgtgtctagctaagtgtcagataccgcaaggatatagcaccagcaaacagtgtggttcctgcctgcaataaacctattgtttaactgaggagaccaaattaatagacgaaaataatcaaagaacatttaaatgctaatatatttgagactgactttatataccatttaaggacttgagagaagggagagatgatgcagacatgagtaatgagagaaagctgcctggatgagatgaacctgggctggggaatgagaatgatttcagtttgaggtggaatgagtttgaggggcctaagaacattcagatgaagatgccggtgggcattgaggtttatggctctggagttcaagaaacaaatgagggctgaagattcagattcaggatgcttagggtcacaggagctggttgaagtgtctgatatgggagtagatgagttcactcaaggtgagtgtgtacagtaagaggaacttgaggaataaacacacatatgtttacactgcacacatgtgtgcacacacacgtcgtgacaaaggaagagaagtcaacactttttctcataatgatatattttgtatttcttttctaagtaggagaacaggacagattagtgcttcagaagtcaagggagaaaaaaacatttcaagaaggaaggtgtagaacaaactgattaaatgccagaaagagtcaagtagaaagaggattgacagatggcttgtcaatcaggaggggttgtcattgtttgcctggggagttttgtagaagtttctagaccatgattaccacaatggctggggtagaaagaaagagggggagttccttaccagtgtgcccctgtatgagggagagtgccccagcagccccattgatgacagcacccaggaggatggagggtgatgtgtagctgtttgctatgcataggggaaggggtttgcataagaactcaaattataacagcagaaccctcttttaaaataagtagcaggtggaatttcataaaagtagtcttttttggaattagacatgttgggtcaaaagtgctacccagtgaacttcctccctggcccctgctgatccctagaactctgaggaaccactgataatcattgatgatgggatttctgagaggatggcctaaggtgcctacctgtcttcagcttaggagatgggagaaattctgacagaatctggccgggagtgagggagttaagttttagacacagtgcttttgatggaatggtgttttgcctgagcaggaatgtcctacaggttcttggaaagcagacctgatatgaagacttgaaccagactttgaatggacattttgaagtcagctaaatgggtacaagttaaagccagggagaagacgtatcgtccaaagtagagaaaggtgcagagagaaagaaccgtgccctaggcattgcacctgactgacttcagtcagagaagcaagaccactaggaggtgtgtgtctgtctctccctctctttttctctcttacacacagacatacactcacacatggatttataacagggattagaccttaccaagggtgtccaatcttttagcttccctgggccatattggaagaagaaaaattgtcttgggccatacataaaatacacgaacactaatgatagctgatgagctaaaaaaattgcaaaaaactctcataatgttttgagaaagtttacgaatttgtattgggccacattcaaagccatcctgagccgcatgcagcctgtgggctgggggttgaacaagcttgcactgagcctttgtgagagctggttcagcaccctctctaatgctggtgcttggagcctggaagacagactgttggaggagagattttgggtggggaagagaaagtgctactcagaccctgagcaccagctgggacctctaaggacagactgaaacccgagttagttctctccaccttcaacctcaataaagtggtagttctgcaggagaacctggtgcttacatgtggaagctgtgagccctgaccttctgagagtgaaaaccagaaacatatagctaagggaattataagaaacgctgtgcaggctggccatgttagtacactgtaaaaccaccagagtaccctctaaagctgccaagtaacactacacagcaggatagttaaatgtcaaatgaaagaccacagcattaaaagtgctgagttttcttgtccttctttgaaaaaaaaaattaaagatatagtaacttaagatgtttccatttttgtcagaaaaatgagcttattttattaacaaatgacactgaatctctttgcacagaagtctctttgcacagtacacagaaaagcttataaatcaaagacgatcttttctttaaacagaactgtatgattttaatgaaaatattctagaatcatatgtgtagtgccaacatagaaaatatggagaggtaaatctctactaagtaaaagggttttttggggactaatatacaagaaataggattgcaatgcgagacatacataaagaccagggtggcctcctgcatgtccagagaacagaggaaaaggttagggtttaattggggaaagagtagattatacaggttattttgaaagttcattggctggcgatgtctttcaggatctggcaagctctgatgagtgacagtgggggcatttctaggtaaaacttgtagtctcgaagtcatagcagctgtttctttggattgagtttgtgaaatagtgtgtcaggcaagtgtttttgcataagtggctggctgtccttgtgatcattcatattatcaggcaaatctattaggacagccctcccaccatgatcttctctgtctttattttgccggagtttgacaagtgacacaagacacaagtgactccattttgaatctcaaaactttcacagtaaatgtttaatatatatctaggatgacttgtacccaggaggctaaagcattgaaatatcacctggagaattcatagcttcatctgcattctgagattactttgaggggaaagatatgattatttgttttccaagaaaaagcattgatgaataaaatgaaaaaatatatttctgctggtactgtggcataggaatttactacagagctttaatggaaaatagactgtctataattggcggtgttattatttacataatttgttcaggacaatgagttaagataaaatgtacaatttcccttggtcaaattttatatatatatatatatataaagtttgacaagattatggaagataattcaaaaggaaatcacttggcactgtgtgactagcttgagctagaagtgtattagaggcacaggtattgacagtggcaggaagccatggacaaactgtcattaggacaggaattagtgggagagtggaacagacctcagggagcaaaaatgcacaaaaattacacctgacatggagtctttgcccagccccagtatctcctctgcggtttctgcctgaggaagattattgcataagtttgatcccaaaggggccatagggattatttctgggtcatctatttttttctattaacatactcaggaaaagctctaatctaatttcacaaacgtgtgtttgtatttgtgtgtacttatgtggttgtgtatatctgtgtgtttctgtaattatgtgtattcgcatgtgtgtgtgtttttgtgtttgtttgtgtggttgtgtgtatttgtgtgtgtgtgccttcagttctatatctacaactctgccctatccactgagtcaactgaaaaattatatcatttataaattttgaagggagactttattttttataaagggttacaacctacaagatgggcattctgacaggttgggaagcattgcctctagcagaggccaaaaagcaggcagttcacaggaggggagggaggcacaaggatttgtgctaaacaagttggccaagtacacatatttaacaggttataggaggaggtatgaatattcatgaaggggttaggttatgttaggaggaggaatgcatattcatgaaggggttcagtatgatgcatgcatactgaacaaacatgcatgttacatgtgtcccatgttcgctttgaggtggagacttaacatttaagtattataattaggccctgtatgtgaagaggtgaagcagggacatgaaggcactcagtgcacagcctctgtaaagccagccagaaccagttcacagtcagtggtcttttatcaggagaaagttacagaaatcattctattgtgcaatcaaagctatagttatggttgtagaacaggaggactcagttagtcagtgtctggtggtgggcgagctgcaattgtttcaacactgcttgtctcaaagccagtgcttgttagctgctgaagaaaaagacaaacctgtggcagttaaaacatagtttattagtttattctttaagtgcaggggtgcgaggcttaacccttttctggcatggccttaggtcctgtttatgatttggtatcttattgccacaaagagtctgttctgtcagtcttatggcccctctgttctgtcagtcttatgttggttggctgtcgtgtctaaaacacaaaagggcgtgggcctaatgaggcatatctgacctctcatcctgtcgtggctgggatctctggggtcccctcggccaagaagcgggagcccgttcagtcagttgggggccttaggattttatttttagttctcacatgggactcaagactctcaatttagatgtgcagcaggcatctcaaacttcacatggtcataaagagaatacttgatgtcagccaatgatcttctacctccttctccccaaatctccccttatttctaaatagcactatttttatccagtttctcaaggcagaaatcttgaagataatggcagttccttccttcccctccatttccacatctgtccataagccagttctgtgactccacctccacacgcctcaaatctgcccccttttctccctttcccctgctagtcccttgtccaagcctccagtctctctctttgatgggctgcccacgacagcttcctaactagctccctgtggggacatttgcctttctatgtgccattcctcacagcagccagagtgaacattggaaaatatcatccagatcatagtcccctccgctggcaatccactgacagcttcccattgtactcagaagaggattcggactcttcgtgctggctcccagagccctgtgtaatccaatatcaacctacctccctgccttggctcaggcaaatctctcctccccaccacacccatggcagcctggccggccttctttctgattttcaggtagccacactttttcctgcctaactggcgtttcctgctctaggtggaattgctttctgatgtgcactgcccccagtcatcacatgactagccccttcttgtcaacccaagctcagctcaaatttcacctcagtgttctctgtcacatcatcctattttgtctctacctagcagttaacccccattatattcccatctttttatcatatcaatctatcaatcaatcagtctatccatccatccattcatctatccatctatcatctatctcttcttttacaaatagagtaaaagctgcagaggtgtatggcttttctgggtcttgttcacagctgcatctccagggtttagaagggaccagcacacagagggcaggcactgcactctaatgttgggaagagacagccagagagaggggatgttattataaggtgggaaatgccttgttaagaaaaagcagagagtgctatgggaatataaaagaggggctaccaacctcacctgtgaggagaacttgaagagctggtacttgacttgagttgttgaagaatggacagatatacaggaagagtaaagaggttggttcaggaccataagtaaaggctgatttatatgtttaagacggacacttgcatgatatcttcagggaactacaaatctttaaaatagtactagaaaaaaccctggaatgcagagaggaaagacataagcctgagacattagcaggaggtaggagctagagtaggagtaggagctagattaagaacctaaatggtattttaaattaactattatattctttttatggctgaagagtattctattgtgtatatataccatatattcattggtcaatggacatttaggttgattccatatcattgctattgtaaatagtgttgcaataaacatgagagtgcaggtatccttttgaaatatacatttcttttcctttgggtgaaacttgaggtcattatgttaagtgagatcagacaggcacagaaatactgatgcctcatgttctcactcatgtatgggagctaaaaaaaattgatctcatggaggtagagggtagaatgataggtatcagtgtctgagaagagtttgtaggtgggagtgggggttaaagagagttgcttagtgggtactaacatccagttagataaaacaaataagccctaatactcattagcaaaggagagtgactacagttagcaacaatgtgttctatatttcaaagcagctagaagaaaggacttaagtagtcctaacaaatagaaatgataaaaactcaaggtgatagatatcccaagtactctgacctgatcattacacattttacacatctaacaaaatactcacatgtaccccatagatacgtaaaatattttgtatcaattaaagtattctacatgtggtgcagtcacatggaagtgattttaattcagcaggtgggaagttggtttaagaaggaaaaatctaggaacagaaataacatttaagaaactatttaggtagtccaggcaggatgtgatgtgcttcttactcaggagagtggttgtaggactgggtggagaacgggacaagagatttatctaagacattaacaacactgttaagttggagagagggatgagtaaaagacagttgtataaaacaatcccagatttcatattgaaaaattggattgatgatggaggtatcactccaataaaggaggaaatgctcgtttgagagaatgagaaaaatcatgagttgaattgtattcatgttaaatttgagaagtctatgaattattaagaagaactttttaagtaaaaaactgaacaagagtgttgggagaagcacacaataagttaagggtggaaatacaagatttgagaattctcatctagcggtagttaaaaccatgagcatgggtgctaggtagaaaaaaggatatagggtaaggagagaggcaagcaaggataaaccctaaaaaacaacaaaatgtaagtgtgggaggaaggagatgaaaaaggaattgctatagaagtaggagaaccatgtgactggtatctcagaatagagggcagagttttaaggtgggggaccattggcagtcaaacgcaaaggagaaatatggtaagataaagtccaaataccatctgcatagtctagaagtgggctgttttgatgaccttagccaaggcagtcggttgagtggttgggagagaaaacaaattgcagtgtgttaagtgttaaatagaatgggagaatcctgtctgtgagtaggaggagggacccactctgagatttggggaagaatagaagagaccatagtctattattcatctagtgaaggaggctgggggaattcatgctgtaaatgatcaatctcatcagtgatgaaggaatgatcagtcacaagaggagtagagaccgtaaaagagacagtatggactctgacattgtagttatgtgttgccactacaactcattagctgtgtgacattgagaaagtagcttatcctctgtgagtttcagtttctttatttacaaaatgggaattccacttcctgtttcatgggactatgagaattgaagatcattatcacaaatctgaggacaagtgcttagcctgagccagcttttactaaatgttacctgctattttcgtgatggtggttgttaatcttgaagactgtggagtatatctgagatggtgattaagaagtatttgtaaactaaaaatagaactaccatatgatctagaaatctcactactgagtgttcatccaaaggaaaatacatcagtatatccaagggatacctgcactcacatgtttattgtggcagtattcgcaatcgcaaatatatggaattaacctaagtgtccatcaatggatgaaaggataaagaaaatgtagtatatacacaatggaatattatttggccatataaaaagaaagaaatcatgccatttgcagcaacattgatggaactcattatgttaagtaaaataagccaggcacagaaaggcaaacatcacatgttctcactcatgtgtaggaggtataaaagttaatctcatggagatagagagtagaatgatagataccagaggctgggaaggatgtgtgggtgtgggtataggtgaggaggtggaattaagagaaattgattaatggacacaaaatacagtcagatggaagaaataaattctggtatctgataacagtaaggtgactatagttagcaacaatgtgttgtttatttcaaagtggctagaatagaggactttaaatattaccaacacatagaaatgataaatactcaaggtgatagatatcccaaatatgctggcttgatcttcacacattctatgtgtgtaacaatatatcacttatactccataaatatgtaaaatactatgcatcaattaaatttagaaatgagaaaagaagtatttgagaagtagttgatgaaagaccaatacggatattttaaatattttattcatagataaaaatgctattgatgacccaactgggatgaatgagaaagtggtatgagacagaatgacatttttcccaaaggtttttgcttgatttccacatgtttatgattgcttaacattttcagacaaattctgtgaggacagaagtttatatctagttttttcgcagtgtattcccagtacttagttaattaagtacttagttaattaaccaattagtagttaattaactaattaacttagttaattaactctttagttaatttttgtttgtcttaaaaaaacaatggttggtttgtagttatcaaaagcagaagcagaagttggtggtaatcttgaaggtggtggtttgattgaggttgtatttgaaatctgttctatccttgctttttacccaaacacaaaaaactttaagtgacccccaaaaaagtatttagggataatgtcaccttataacgtgtcagcttataactacaaaaactaaaaagggacagaaatactaaaaccagactgtggtgactttgatatgctatgatatgatatgatatgacatgacaagacatgtatatgtataatacctgtacccttaagtggcatgagtggccatgaaaatgctcttgttaatttctttcacccttgagagtcctcatctgtaaactgatgttatcaagagctgtatcattggatgtgatgattaaatgaaataaatataaagtacctggtgtgctccttggcacagaatgaataattggtaaatttctttctttcctctccctatcatctaacagtctttggtttaggaagagattgatctagaaagtgtaatagagatggaatcatgttggtttgaaattcaggaattctgaattctcatgccatccatatcattcattatctatgcaaccttaggtgatcacttagtatcatctatacaatggagaatagtaatttttcctacttctccagtggaattattgtaaggatgaaatgatatcaggcatgaaattctgtctggatgccaggtgcgactattttggtcctcacagccacctgttgcccagatagacattcctatcctgggatgacagtcaaccatagtgttgaaaaatttttttggcatttttaggtctcaaagctgatggcacaagaaattcagaagctagctgaaatgcagtatgccaccctctacttttaatgaacttcaaaacatcagaatgttcaagttttctattagccatccagggctgtataagaaattacccgaaaactcggtagcttgaaacaacaaatatttattgcctcatagttactgtgaatcaggaatgatgtcagaatgtagtctggggctacagtcatctgaaggtttgagtggggctgcaggatttgcttccaaggtgttgcactcacacggctgtgggcaggaggcctctgttccatggctctttcctcctaggatggaagctaacattttccagggtggccagtccaagagaaagaataaggagcggacacagttcattttatgaccatatctccaaagtcacacacctttaacccatttatgcctgaggttacaattttttgaatttttacaatcagtccttggcgatgaccttgagcagcaggatataaataactcccacgtgcttagctttccaataatggaacactaggcataagtggctactacatttttttctatttgttagaagcaagttaagttcagccacagcgacgggaggtggggtgaagattaggctcctcctcttgaagggaagagtgtgaaataatctgtggatgtatttttaacactactacattgcgctatagtcaaagttaaagaggccccgtgtggccttttggtcatctgcagagtgtgtagttgcctgtgctgatgacacacttaatataggagactcatccttctccactcatctccctgggtctcaagttctcccagtagagtttggcttatgtttatatatgtgttttcatacactgtctcctttaaaatataatgtctctggcaaaacagaacacaatgcctggcacaagtaggagttcagtaaatgttagttaaatgtattgaagtctccttaacacaaatggcttatccagtcctttgcagtacacagagtttggtatgagaaagagggagaggacataaagacttggatagtaggaataagggaaggggaccaactggggaaaagatgcagaatttggtgctcagagcatagctttatgactgcgtgtgtttagggagggctaactgtgagacctgaaggtggactaagccctgtgaaaagcaatagtagcagcttgattggtggcaagatgacctaaagggtgtacattgggtacatttctcaaaacctgcaaaagagagctcactcagaactggagttgggaatagtgcccaaagagtaaatggatccagcaagagaagagagggctattatgagaaatctttccaagtagattttaatcctgaagacataccatgttgtaaattcatctcagacatttaaaatgcattagatgccattatggccctggctgctgattcagccggcatttgttgagcagcgattttgtgtcagacacagttcttaaggcgtgcacatttatgatctcattcaatcctcacacacgctgtatgggaagttttagtactcttcttctttgataagaaattagtgctctgggagcttatgtgtctcactgcaaggagaaaaactgagatttgaatctaagttttcaaactttatcatgccacaactttcatttctgaaaatgagaaattacaagtgcagatatatcatggattaaatcacatttcttaaaatatagcatctacctaagtgagagactagtattaggtaagcagcgagcccatcttgtttcatgaaaaataccttggtctcgacgacagaggtttattgtaacaatgcttaaagtaagagtggtgattttctttttggagtttgtcctgcaaattcagatctgtcccgctcagaggtatggttgaatcttccccaacacaaatcatctacctttcttgatcatccagactacactaatacatcgtctactatatgaaaactaataaccatgtaaccactacagtagtcaagcataacacaattgcaaaatgttaaagccttgattgatgatgatatatttaattgaaagtttaatagaacaacgtgatatctttctcatgatccttactgattagaatttactcattttctgttcttccttcaaggaaagaaaatattttctcttttgcccttatgtttttctgggttctttgatttctacccctgtcccccaggcttgtgtgccattcattcatccatgtattcagtaaacattaattcattcattaattctataaacattaactcttttagcatgtatttattatctactatgtgctaagtactttcctagtcactaaagaaccattatggattgtaggccagccactctgctcacttttgtggatacagagatgttgtatgagacaacatcactataataaacaaatgaagcataatagatacaatggcatttcaggtgggatatagtagggacatgaaaatgtacaaacctaatattagtggttctgttatatagttaaagtctatatgatattctcctattatatattgttttacctgcaggaaataagctattttccagaggagaaacctgtcgactaaaaagtaggtatattagtctgttctcatgctgctgtgaagaaatacttgaaactgggtaatttataaaggaaagaggttgaattgactcataattctgcattgctggggaggcctcaggaaacttacaatcatggtggaaggcaaaggggaagcaggcaccttcctcacagggcagcaggatggagtgaccccaagcaggggaaatgccagatgcttataaaaccatcagatctcgtgagactcactcactgtcacgagaacagcatgagggaaaccaccctcatgatccaattaccttcagctggtcccacccttgacatgtggggaatatgaggattacaattcaaggtgagatttgggtggagacacagagccaaaccatatcagtaggccttgacagatggtcattgtgttagtgtgtgacctgttcctctgagaagcagattccaagacagaattaaacatgcaggaattttattatggaaaacacctgtgagagaaatgtggaaggatctaggaggaactgggagagctgttagaccactattctaagccttagtggaagacagagggaaggatggtcaggtggaagcatcctggacactgtgcaatctcagaaagcagggcctttgggaggtggagccaatgtttctcttcagaggagccctctggtttccagaaggggtctgctttaaaatccctgctgcattcatggtctgggagtggcccaagagaacccatcacaactcaggagttggaaccttgattgactactccccatagggaaagtactgtgagacacactctcagggctaccacagtcaccctgagttgatactccaggctgagagggaaattggcaaagaatttgtttaaagcagtttggtgagttttaggagaatgacaagctcaatatggcaggattataaggtgccctttggttggagaaacaagaagacaaaaagggagaatattgagaaataatgtcaaagaaattctcagtacattagactctgatatgatcagtagtcagatcagagtctagtgtataaatctaaggaatttaggcaatgaagagaaattggcaaattttaagtagggaaggactcaattagtttttttttccttcaaataaatcagttagtggacatattagaagatgtgataagaagcagggagatgagttggaacagagtatgttttgaactatagcagtgacagtggaaatgtggaagctaaaaaagtatttgaaaagtagaattaacatcactggatcaccagttgtgtgtgaggaatctctgattacctggtttctggcttggacactagataggagccattctctcatcaaaagattgcatgaagcgacactggtttgggggaaaactagttaagatttggacagtgaagcattttaggcctctcagatactgatttatccagcagccaaaagataattcaaggcttgaaatgcaaacttgggagttgtaagcctttctttctcaggagctgtttttagcacccctagtggagtcagtcaacaacctcaaatcttgtaaagggagggtgtcttagtctgttctagctgccataacaaaatacctcagactgggtaatttataaagaacagaaatgtatctctcatggttctggaggctgggaagtccaagttcaaggtggcaacaggttcagtgtctggtgagggcccattccttatagatggcagcttcttgttgggtccttacatggcagaaggggcaaaagggttcctttaagcctggtttataaggcctccatattcatgagggtggaggcctcatgacctcatcacctcccaaaggctccacctcttaatattattcagctggggattacgtttcaacatatgaattctgtgggtgggagtacagacatttagaccatagcaaatggtattggttagcttgcttctcttgaatcttggcatctcctttgacctttgtcagcttagcagaagtcagtaaagagaagaacggccataaattgatgtaatgcctacaagatcacaagattccaaaacaagtttttcaccaaatggacaaagaattctatcagcctcattcctgtctttgtctttctctcttttattgttttgttttgttttgttttaagactctattactgcatttcaagcagatgtgtggagtgaatctgcacacattgttcaagaacccccttatctctggacctcttatgagcgatggtgagacattatctgactttcttgactcagccatgcagaactcacccacagaaatcatcagaatctctaagaaaataacatactttggctttaaatttcatttctattgtttaaatttcatgacattaattcaggcaacataaacatttccaacaaaacttctatgcataaatcacagtcttgggggaatgaagaagagaatgaaagattgttgtgattctgtggaatgtgaagaagctttcaaaatagcattttaaaaatcacctatctatgccaggagatagctatatgctttatatccttcctcttcttcctcctccttctctgtttttttttaatcttcttttaatgcactaaatctttaatgatcaaaccacccactctgtggttcaaaataaacaaatggttttccatcttgttcagcataaaagtgtgatcttgtgtcatggcctgaagggtccttcctacacctaaatgtttgattatctctttgcattccttccaacttctcacccttcttccctgggctccagccacatggatttcttaggtgccccttgaagacctccgtggaactctggcttcagagctttgcacttgctagtccttctgccagctcttcccctgacaaccacatgccaaatggtcatttcccagtgaggccgtcccagatcaccctacttaaaattgcaaattcctgcttccgcatccttcataacacttctcctgctttgtttttcttcacagcccttatcattttccaatgtcctatataatgtatttattttcattcatcgtgagtctctccatattaaatataaagtgtgggtttttgccactttgattttctgctgtattttcggcacattaaaagtgattaagagaaatacctaatgtagatgacaggttgatgggtgcagcaaaccaccgtggcatgtgtaaggtaacaaacctgcacgttctgcacatgcacccagaacttaaagtataatttttaaaaaataaaataaaagagtgcccagctctaaatctgtgtgaggggtaaatattaacattcccattcatgtgtaaagggattgggctgagaaagcttaagtaatttgcccaagtcacatgattcataaattgcaaggttaaaattcaaattcaaatctgtctggccccaaggtccacgccctatccttcatgctgtggcttccttcatttccaaacagtgaaatgctttcatagaatgaagatgaggcttcttaacagcgagctgctgctttcaaaactctggattttagatcagggagtcagattgtgagagacccatgtcagaggtctagagaggaaacaaacaccatcaacaaaacagcgggatttgcaggctaaccccagcagccgttcatgagatcactgaacaccttcttcctggctcccaggctgggttgcccgcacacagactgtgggaaaactggtgacacacgcaagcccgctaagagttccatttagattgcatgcacagatgtctaattggagttctatgtttattaacataagctgctttgccattccgaaatgggagttaatcaaaatattgcaaatgatgcaccttaagaaatgtcactctttatcatgattgcatttccatattgttgccatgaaagtttgctgtgtgtgtgtgcgtgagtgtgtgtgtttatgttcaattcttctaaaaatctactctactaagatcaggcgctggtggtgggatgtgtctgaatctatgttcagaggaactggcagaggcagtaggagccacaatccatcgcagctttatgtaccacacataaactacatttctacagcaactggttaggagcagagtgatttcctggcatttgcagctcacaccgagctctggagggcctttctcccttccctttctgtgtctgtcaccagggaggaaaggtcatcagctggaagcagataattatgctgcctcaggaactggcactttcctgtgaggaccattggaatgtaattcatttcttctgtctttcttcttgagtattaacaaagtcaacaaaaaggattttcttcccaccaggacttgcctgcattggatgagagcagtcagcatgaattttaatcagagtgactgtttttcagccccaaattttccataatcaatttctttttgtctattaattgaaagtgaacatagagtttgagaaatgatggatcctaacacctcgaatcccactcagtcacattcagagttgagctctggtacgtctccatagaacctagagttatgtaagggatgcatttgaagatgattttcttttttttttttttttgttcaagtgattcaccctgtggtttctttaaataggtcagctagtgctgtaaattaatttacacaggagggagtcaaattttccttcctcttttttaaaaagaaaattcatattgaagatgagattcatgtggattttcttaaatttgcttttctttttactgtgccttgtggtttgctttgcgttgttttcctccagctactcttacttttgtgggctgtgtgaaggagagacctgcccacctgggacactcattacactggctccgtaacttcctttgtgatcagaacagcctgatgctgatggtgtttgaatagggataaacatatagactttttttttttttttttactgggcttcagggtgagggggtcagcatttcagaggactgctaggattagagcaaattgttccttggttacttttttcctgcttggtatcacacctttcttcctttttattgactgtctcaattcctagggctgccataacaaagtaccaaaaatgagtgacgtaaacaacagaaatggattctctcgcaattctggaagctagaagttcaagatcaaggcatatgcaaggttgtgctccctctgaaggtgcaagagaagggtctgttgaggcctttctcctgacttctggtagacctttggcttgtggcagcagaactccagtcttcacatggctttcttcttgtacatgctcttctatgcccaaatttgtccttttcataaggacaccagtcatattgggttaggagtcaccctactctagtaccattcatcttaactaattatatctacaatgattatttccaaataaggttgcattctgagacactgagtgttaggacttcaacatataatttttggggggagcataattctaccataacactgactattagttatcaattgttgcttaacaaatcactcaaaaacttagtggcttcaaacaacaacatttattatctcacagttcctatgggtccagaattcaggaatggcctagcatagtgtaactgggttctggtctctagttctgagcttctcctgaggcttcaatcaaggccatcatcatcttaaggctcaactaggggggagtctgctctcaacctcactcgcgcagttgcttgaaaaaatccacaaagatttggttccttgtgggttgttggaatgagggtctcagttcctgttgaactccaggccaggggcatctctaggcatgagaagctcacaacatacagcaactcacaatgatcacagtaaacaagcaagagggcaaaagaggaacaagatggaaaacacagtattttataacctaatcttggaaataataatacgattcatatgctatttgttagaaactggtcatcagacccagcctacactcaaggagaggggattataccaggacatggatcccaggattcagggacctttgaaggcaatttcagaagctgctaccttggtccatcctctgagtcatcctttttcatgaaaactagagcttgtttgtaactgattagtttacttgacttgctacttcccattagaattcctggggtctactaaccttttttttcattttgcactgtctctgctacttttggtacaaaacgacagtgtttctgctggtgacattaactaaaaaatattgtgggatttctgtgaatcttatttgagtttactgtactagaaaaaaagttatacccacaattctctccaagaaaagcccttctccacctttggggtctgctcagaagcctgagagatcatgtcttgatgcttcctagtcgtccgactgttccattgagacaatcggtaagacacacctttcatctctttaaaaggctctttgtgagacagaataacacgctgatcctttgatctttttgaagtcttaaccagtagttatgtagtcttacctgtggctatatgtctataccatgttttcctgaaagtactcaaaagccatttcttaattctagcatattttgctgtccagagagattgagacttttcaaaattatcaggtcttggttccttcatgtttaacaattcttccttcaatttatcactcttacagtttactataagcagcacaaaaaagccagatggcaccttcagccctttgcttgaaaatcccagctcaatcactaagttcattagtgctggccagggcagagttgtgaggttgaaaatagactcagttggcccctcccacacatgtgcacctccctgtggcatccccttccctgactgcccttccctctccaccactggcttcaacattttttgcagtttttgactgcatagggtgaaatttccaacacccagcttgacatgtcttgtttccagtagcttcaatatattaaattcaattccctggacacttggaagtccatgatgatagtattcatcatataagcaaatcatcgataatgctttggttggctaatgttgttccctctaccttatctcagttaaaatgtataaaatagtctttaaggggtggtaaggtcatatgatgatataaagttataattctaatgatttctacctgaatagctttacgactactttaccatttataaagggcttcctttcactcatttattcctcaccaaaggcctatacggccagtgtcttcttaatttagagattagggaactgaggctcatagaggtgaagtcatctgctctaggttccatgatttagacggtgctgagtggcaccagcaggaccacactccacagcactgtgtcccattccatatcctcgatgtcctgctggaacaatttggaggatatcgttatttggggtgggggatcagggtggattttgactaagataattcccagacgtggctgaactgtttctacaacattgagtttgactacagcagacgctacacccatcgctgcctttgcagtatgggctttgctttgtattcgtccagacctggatgccctgggggttgccacaccagaccacagtctcccagagcctccgcaagcatgtgctggctttctctatcctcttccgtggcctatcagcacgtttataagttacagtttggccctgtctgcagaatgtgctgacagctttcagtaatggatatggacgtctgctgaaaggtttggctgtgtttgtagctgggtgctggatggcacgtaaactctgagcctgaaggagaaaaaaaaaaagttagcatagaattcactctatctgtggatttgtcattttggaatttgtgttcattttagacaggactgacagaaactgctgaacttggagctgagtgacgttagaggcgtgagcccatctctgctgcaatgacgttggccaggccacaggcattcagcctggtggaggtgaaaggaacttagggaatggcctggtccaattcttcattgaatagatgaagaaattgaggcttgtggagatgaagtgacatttccaatgcagccatttagtgataaatccattgtgttgattgatcatcatttcattcttttccacagttcacttattctgttacataatgttgtttcagcattgtcccgatagtataattattatcaaataatttgttataaaaattgtatgaggtcaggcacactggttcatgcgtataattccagcactttgagaggcagaagcgggtggatcagttgaggccaggagttggagaccagcctgggcaacatagtgccacaccgtatctacaaaaaataaaacacttagctgggagtggtggcatgtacgtgtagtcccagctactccagagcctgaggtgggaggatcacttgagcccaggagtttgagactgcagtgagctatgatcacaccactgcactccagcctgggtgacagagtgagatcctgtctctaaaaataaataaataaataaataaataaaacaaaattaaattaaaaatcggatgatcatattactgctttttctaccgctcataggccagccagggtcctccctgacccctcggtggcccacacatgagtacagcctccctggtcttctccatcagcttcccaacttctttttctccatctcagcctggcatgttccttctgcaagcagggctgcatcccattccacactacttcccattctccttctcagcaacctaccacatacagtgcttcttttcaaacttcaccacttctgttcccagtccttccctcccctccggcctctccaccacacattcctccccccaacaaaacatacttctgccaactcatcccttgcacctgctgctctgcctctccatccttcagtcccactctgcccgagggccagctttggagagtaactttccactcctgccagtggctgacctgaacatagtagtaattgctggcactgtgggactctagattttcacagaatgtgtaccccaggagacgtgctcatgagctaaaggggagtccgacattttcccttcccctgctccctgcacttcgaggcactgcagtgtttgagagagagacacaaattattacaacatagcagtggctcgtttctctctcaaattcacctgttatttttttcattttattttctatttgggaaaaatcagtggattgatttgcatttcaaaacatatctgatttcagacactttcagtgacactagcccagaactgtccagtggaatgttccgtggtgagcgacatgttttgtatctactttataacacagtagccactggccagactcgattgctaatacttgaaagtggctagtgtgactgaggaactgaattttaaattgtatttaattttaattattttatatttaaatagccacacatggctactgggtacctaagtgggcagtgtagactagaccattataccctttgttgaggggagaattgtgaaatcaaatattaacattcccccacttctaccatctttttgccacatcccaccacgtcccatgatcctttgcttgcccttgaacaggtaaaaccagggctactcttggcttctagaaggtatatctgacttcagtcccctgtctctgtttctgccaattatataacttagtaattgacttagcctaaaaccgaggctcatgtagcaaataaataataataaataataaataatagatcacatttatttgttgctccatatgtaccaggtatgtaatacttccatatattaattcatttaatcttcaaagcagccctgtgaggtctgtgtgttattatattatacccattttatagttcaggaaactgaggcaagagctacagagctgctacgtgccagaactggaatttgaagttgggcatttgatagtaaacctcactcttgggcacatattgaactgcatctgccatatgctcccctgcagagaaattcctggcctggcatcttggatgctctctgtacctgccaacgtggagtgggattgagctctgtatactaaaaaacagaaacagaatcagaatcagagaggtttgctactgcaatattgcaatgcaattctgacgctaactacctagagttagtgcagacttcacaacttaagggcacagacttcagcaagaccgccctcacttcagatgtcagctgcaagctctgagggtcccaggatgcctgcacttctgaccaattggctacaaatttggggttcccattactccctcaggtttaatacctagaaggaatgtcagaactcgggagagagctagacttgcaattacagttttattatgaaggctacaaatcaggaccaaccaaatgacaagatgtatataagaaggtctaggagggtcccaaatttggagcttgtttgtcctcttcttgtgaaatcagggttgtgggacttttctttagttcagctaaagatggggtccttgtcacatggccacaaaaatttaggcttgcagacaatttaaaaggtgagtaagacaggattttattgggtgaaaagggaaaaaagggaaggagggacccttcacaagccagagtccctgctggtgcacttcctgcccgcagcttgaatcccaggttccacacaggaagaggaggggccaggctccttgtccactgcaaagggtgccaacttcctgaggctccaccccagtgcacaggctggttggagttttcctgggaacctctttgcactcagctgtcttatcaagacacaatactccctcatcacgctgatgtgttcactcaactgagctttggtgtccagagttttattatgctttcattacttaggtatgactgaagtattggtcatgtgactgaactcattgtccagcctctcctccctaaaggttgggctactattatttggcctcaaccctctgatcacacagtttatctttccagcatggccagacttcatcctgaatctatctagggactcactatgagtcacctcattagcataagctgtcaagttccaccatgaattacaaagatactgctatcatttgggaaatcccaagggcttagacctccacctcaagaacttggaaaaaagacctgacaaactctattgtacaagagctacatcagaaatttttctttcaagtaactaagagtaaggaaacaagcatttctaaatgtttagtggttactggtcacattcatctacattatatcatttaatcttcatgacattcctaggaggaagatattatcgatgtctttgttttatagatgaataaactgaggctaaatgaaattaataaccatgtacatgaacatccaactagtaacaattggtatggaagtttaaaatcaagcttaaaacctaactttcaatcacaagccctttgaatacattacaagaatagtaggaggagataagaatagagatatagatgctttcaacacctaattgtttttcttatctgaaaatgcaggatgggaatggacttgcccaggataggacagtcaaggagaaatgtgaggatctgggagtgaggcttcttcccaatgtgccaagtgattccttttctgattttcctcatgtgtttatttacaaaagattatgttttaatgtgtgtcaggcctttaatgtgtagcaagcattgaaaatacacaaatagagagacacagtccccaggcttccttgaagaggacacagacagtacataaaatattgcaatgtgacatggctactgaaacaataaagaaaagcacttagaaaaatgcaataaaaggccggttgtggtggctcatccctgtaatcccagcactttgggaggccaaggcgggtggatcacgaggtcaggagatcaagaccagcctggctaacatggtgaacccccgtctgtactaaaactacaaaaattagccaggtgtggtggcgggtgcctgtaatcccagctacttgggaagctgaggcaggagaatcgctcgaacccaggaggcagaggttgcagtgagctgagatggtgccactgcaccactccagcctggatgacaaaggaagactctgtctcaaaaaacaaaaaaaaagagaaagaaaaatgcaataaaggaaacaataaaagaaagttctaattagaaaggggcgagaggaaaaggggagtcaggaaagattaggggagagaatgcaggagctaggggttggaaacaaacaaggattaaccagatttcgagttctgtaagtgaatagaagaggggtactgaactctctcacttcagatgaggaggctaatatgttgtcgtcgacaaaaagagttaaactctgtaaaatatttaaatagatgtattcttagccaaatatgagttactatggcccgcgatgcagccttcaggaggtcctgagaacatgtgcttaaggtggtcggggtgtagcttggttttatacacattttagggaggcaagagacatcaatcaaatacatttaaaaagtacattggtttagtccagaaaggtgggacaactagaagcggggttcggaggcttccaggctataggtaaatgtaaacattttttggttgacaattggttgagtttgtctaaagacctgggattaacagaaaggaatgtctgggttaaaacaaagggttgcagaggcacaagtttttatttgcagaggaagccttcagatagtaggctcccgagaaaataggttgcaaagtgtttcttatcagacttaaagtctgtattgatgttcatgctggagaggtataatgaggcaagtccgactcctatttcccatcatggcctgaaacagtttcttaggttaaattttaaaagagccctggctgagcaggaagtccattctaatggttatggggagggtttcttagaattttattttttggttacagggtcctgatgatgcccaaagcctagcactttgcagaccccttgctctgcctcagctgtagccagaacccccaaagtagaagggaatggagtcacccaaataatggaggtcaggttgtgatgttgtggatctcaggaatgaggaggatgtgtgtgtattaggagttctagcaagtttcctcatctgtaaaatgatgatgttcgacctccctagataatctctgggatcccttctggctctaacatttcattaatttgtgattttatgaaaaacgttttgcaaagcaaatgaatagtgtaaacaagattataaagagaatatttgccttcttaagggaataaactgttctgaagcacatcaggagtggtcatttgcatataaacaatgcaaattctatataagcagaggaggcttgttttcttaggtgttttggtaagtcaattacaaatcgttcttatcaattttgctagtgtatatgtattaggaagcagaagagttgaattcattttaaaagtgctatactttcgaatgttcccaatttcttgaatgttcccaatacctgacttttctctgaattagcctgagttttcttaaattatttctttattccatgggttaaaacatttgtgatttgtttttttcaagaaggttttggataaattgttatgttcatcagatctcagaggtgtcaactgaaccccattctactttcagtcgtcctgaatgggcttaggactacccaaaaaagtctataacctgttagggtccaaagtcctgcctccacttttgattcccaacatcttaatgatctctcttcatctttctcccctgtacatttgagtgcttctttttcccactccccatatcaatcagactacataggcttccaatacaaattaccactttggaagtattttatttgtctagatgactgtattgaagatttggttgtcatacagagctatcaacatgcagagaacaaagccatcttcctgattctattctctctaggcctcttccccttctctcatattctctttctcttctctttttttttttctccaaaccccctcatcccgctgacattcacccttttcagaagcaagacaccttgtgccccttgtcttaagcacagcagtttccttctgtagcttgggcattttcttaaagttttgttctccactcccaggtggttgctcaaaatattccaaatacattttgttgtgtcagggtaaattcaggaaacacgatctggaagaagcaggtttccaccaagggggataggagaggctgggcaagcagagaggtgggggatgagtttccaagcagaaggaactgcctgcaccaaccatggcaacatgtgagagccagcacgtagaggagcctcacctgattttctgtgatccagataggtggagtaatcgcaaggaataatgagtaaaagacaggaatggagaagaagatgccagtgacattacagtgacctttatgtgtcatattaagacatttttattttctcagaaggtgctgggaacccagtgaggcattgcaacaccagtgtgatgaggctgcagagctgactgcaaacatcccagatagaaaactagtgcaatgccacagaccaggagtaggacatggggcaggggatgcagaggaaatgggacatttaagagagaagtaggagaccaataagatttgggattgattgattatgggctgatggagaaaaaggaactggccagggaaaacgctgcacttttgtcttgaatatttattggccaagttaggaaatacaagaatagaaattaggaaatgttcaattttggaaatataacttcatttggtttatcaatgcactattttaatttatgggcccaaagtgttatgtccttggatgtcattcagttctcaggcaataggctgaacaagttccaagtcatgactgttcagcaacatttttgtgaaaaatgccttagacatgactcctcctctcctaacaaactctggccgtatcatttcatgtaaaccatggcccatgactgccttttccttgtcactataagcttgctacctggctatcagaaattaggcttcatcatggctaaggatgttctgctctgttttttcactggcttattgaacagtttacattcagtgtgggaccaattaatcattatatatttctctagctaccaccttcaaactcacatggtcaaagtgctttcttctttcttcctccatattgttaatatctcaggaagattgtgtacatatctggtcatttttttttttttttgagacagagtcttgctcagtcgccaggctggagtgcagtggcaaaatctcagctcactgcaacttctgcctcctgggttcaagcaattctcctgcctcagcctcccaaatagctaggactacaggagcatgccaccatgcccagctaatttttgtatttttagtagagacagggtttcaccatgttggccaggatggtctcgatctcttgacctcatgatccgcctgcctcagcctcccaaagtgctgggattacaggcgtgagccaccacacctggccaaggtgagaccattttcaatggttgttactagtctatcttaagatttctgtctcaaaaccaggtcagagaatccccctatcctggaccttcaggatgagaataaggggaaagactagtggtggaagaagcggaagcttttggacatggctgttcctacagatgtgattctcatctggcttgtgctagaaggctgccacatgccccgtgtggcccagacttcaataggggctgaacatcacagaagttctatgtcgcgccacattccctgacagggacacttctcttttgggaaggcagaggtacccattccaaattgcccaacatttttctaactgcttcctgagaccccatgaaaagtccctattaacactcagttacattagttttagaaaggtagcaaatgtgggccggacgcagtggctcacacctgtaatcccagcgctttgggaggctgagttgggtggatcacctgaggtcaggagtttgagaccagcatggccaacatggcaaaaccctgtatctactaaaaatacaaaaattagccaggtgtggtagcacgtggctgtaatcccagctacttgggaggctgaagcaggagaattgcttgaacctgggaggcagaggttgcagtgagctgagattgtgccactgcactccagcctgggcgacaaagcgtgactcagtctcaaaaaaaaaaaaaaaaaaaaaaaggtagcaaatgtgcaaatgtgaaactgaggccatgttttcatcatgtttgtggtttcatatatgtcaaaaagaagatgagctatctgactatgactggtatgtatatggcgcaattgaaattctctcttcagatggaatcatatttaaggctgtcagagaacaaagactgcccttcgccacaaatggaagctatgtgatgaatttttttccctatgcctttcttcaattttctatttaaagaaatttctgaaaatacatgaattatgcagcttatctctcagatgaaaaagaattttcttcttggattggatggctgcgtgtttattaatagcagtgaaattttccgtgttcttttgtatcaaatgggatgctgactaaaatatgaagtagcctttccagcaaaaataacagtaatggatgaataattacaaaagctatagggaactgaaagacattttaatttgtcattatttctatgtattcagaaaggatctgaataattacaatgactataaaaaggaagaatgtgatatttttcctcattatgggattaagttcttaatataccacttttactataagtttaaaaaaaaaaccctttcatctgattttctctaactatgtaatcatgactaaagactgtttagctgtgaatatttggtcttcttactgttacgtgaagatgctgtccttcaaactctttttaatctcaaaagtgttcatctttgcagtttataaaaatgaaattatacttatttgctcagtgagaactttcaacccttatgtcacattaatttttgaagatgacaaggactgttgaatttctttaggtcatgaccggatggtagcagagtatgagattctaaaacaggattttaatttttataacaactactaaaaagtggctatagctaccagggtcatgctaaggcaaaatttcaaacatttcaaagctatttttaaaaatatgcatatagtctcaatttttttagtctacattataccaacaatgttcaaattcttattcagatcctaagaatattctatgacagcactgtttttggaaaatgaaatttcaacatatgctctgtgtttctaggtgagtgatagaattttcttttgtagcttttgaattttcatttaccagactgccagtgagacatttggaccttagcgaaggaagatgggaaaacctgtgaaaagagtctaacctgctctaacacttttgccacccttccctctaaaatattctttaagggaaacagccaccactagaagatgcttttccagcagcttcctttcagctggagcacttcttcagcagcatgcgagaaatccccggcagaagatgtcaacaagctctctcacctcctgcttatgagtttttccagggttcaagttccactgcttaacagctgtttgatcttgtgccattaatttagccaagtgaaacctcagtgttctcacctttaaaaggggtggaaatggcacacatagtaaaagtggtctgtggattaaattaaaatgtaaagtaaatgtaaaattcatgactcgtagtaggcatgttgtaagaggtagtatcttgttgtcataaagaaaaaaacaaaactaaaaatccttcaaaaattggctctcaatttgattaaatcaatactttttgcaagtaaggccagaaagaattttttttttttttttgacatggagtctccctctgttgccaggctggagtgcagtggcacgatctcggctcactgcatcaggttcaagcgattctcctgcttcagcctcctgagtagctgggactacaggcatgctaccatgcccagctaatttttgtatttttagtagagacggggtttcaccatgttggccaggatagtcttgatatcctgacctcgtgatctgcccacctctacctcccaaagtgttgggattacaggcatgagccactgcacctggcccagaaacaattttttttttctattcttctaacagagaaaattctgaatgagtggacaacgaggcttatattaatttgaaatttagccactgtaatgttgctctccactttcaacaagagggttctgcatgtagttatacctgaaacttaaagatgggtgtatgcagcatgccataaataaaaatcaattcattatttttatttaaaaacatttggaatgaatttagtgtctggattgacaatgtagagctatacattttcttgtacgtatgtggagatggcattagtaatggagatattttatatatacaggttatttagaacctgaaagattaactttacaaattcagatgcatttgaatttgatggttaaggtaatatgagaagtagaagagagacagggggtgggggggagaaagaggtgttggaatttgtaattatgaaagaaggtaacactgtgtttccttctgtcttatagcctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaac

SEQ ID NO: 38577 - DNA, 19691 bp, Homo sapiens
ggcgcccacagagccgcggcaccatggcacctgctggacgcccgggggccaagaaggtgagtttcgtcccctcgatcctcgcggagctcctggccgctgggctgcgagcgactccgttcacacccggcgtccatccctagccaagccctggggcctcggcaaaacacttggacgggatggccctgagcctcaattttcccctgtcacgggttggttagcgtttatggagcccttactcggtgcctggcgctgcacagagtgctgtgctcaagttatctcctcatcttcacaattatccccatttcacaggtgaggaaactgaggctcggcgagtcaggcgactagctcagggtcacgggtccagccccgcggggagcgaggatcagaagtctagctttcggacgcatgtcgcgcacacattttcttccctcaaccgaccctcgcccgcagctctttgggctaatccgtccgggaactcttcggactgtcccctcgcgttttggaaaagtcagcagcctggccaagcagcctggccttgcgagtcgccggctggtctgaaactagtcctgggcaaggacgcccccagagctgcggtgcagggtggagggtaggtgggattcgctagcacccctcaacctcctctcacccggtggtccccagctcctggcccctttcctggtctggtcaccagatgttggctttatgcccagccatttctacgtcgagtatgtgtgggggtgggatgaaggagtgactaagcaaaattaggaagggcatgagcttggacgaaagacatccccaggacccttcagagacccccacccgctccagccctgtcattcagaatgggaggaagggaggaggggcagtttatgcgtggaaatgtgcaccaccgagctatttatactaaaaagttagaaacgaccaagatactctgcaatacgggattctaaataaattaaggttcatctacttaagttattagacagttaaataacttagtatgagaaccagctaagtgccttggcaatgttaagttgcaaaaggaaatatatcacaaactgatcccaaccatatacaaatatttatatacacactgtaaggaaggacacaataatggtaatagttacacaagatgtggaatattggtttaaaaagcatgttttaggatattttttcaggttataaaagcaaaatgtgagcattgaaagaatacagttaataaaaataatcaaagaacattgtgcttttttctctcaactttctctaatgctatgttcatctttacagttcatatttttaaacgtttttaaaatgccctgtttttgttcagtgtctttggggcctctactgttacaacaccaagattatcacacactaatccatgtgaatgtgtacctgggagttaaggtgttaatgggaaggaactaatctcacctctctcctcagctagcaggtacattttaagaattcatttaattgccacagacaagacctccaattaggtcttaaatccaaaagagcagttctgctggcaaatctaggaaaaggggaagttattttagacagactgggtttttctgatcacctcctactacacagtgaagttgatccccactgagtatgaatagagatgtcttgaagccagatcttaaacccagaggtcttacgtagtgatatctgcaaaaagggggcataaatgcaccctagagctcgctgtcagatgcaaggcaggttcactgccaaactgatggggaggagggaatgaaaatataaatgtactgcaaaattaatttacagggttccttattttacatgttcctgtctttataattttacagttgactttagatcgtactagtataatggtgaggaacaacacacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaaactaaagaagggatcatactggtatagtaattaattgaggtagttagaatagcagtgaaggaagggctaaaagatgctctgatctcaaatcttgataacttagttattttgctaatggctatgtagaaaaatggcaaattggccgggcacagtggctcacacctgtaatcctagcactttgggaggccgaggcaggcagatcatctaaggtcaggagttcgagaccacactggacaacatggtgaaaccctgtctctactaaaaaatacaaaattagctgggcatggtggcatgcacctataatcccagctacttgcgaggctgaggcaggagaattgcttgaaccctggaggtggaggttgcagtgagctgagatcgcgctactgcactccagcctgggcgacaagagtgaaactctgtctcaaaaaaaaaaagaaagaaaagaaaagaaaaatggcaaatttaaaatggtggacaaacatccagataacaaatgaaaatgtcctccctttacttggtttcataaagacacagtcaaaatatatactacaattttcttaaaacctacctaattgtctgctaaagagtaacattttttcttcttcaggacaaaaattctagcatatgcaatacatctgacattttcaaaacagtcctgtttatttgctaattcttggcatagtttcttaagtgtctactcattttagttgttatatgtggtggtagggatatagaccaataagatatgtcacctgcccccaagcctcttacagtcaaactgaggtgacaagtaagtaaccagatactgctgtacagggggatgcatgaatgaaggatctgtgaagttaagcaggacacaaaaggggtataatcacaggtgagactgggtcagtgagcctgtgctctggtagcaatggaagacagttcagagtagggctggagagaactggagaccatttcaataatcaaatgcagtgaggatggtggggcatttgagaaatgtgtaatacacttggcataaccctgtgataggttggatgtgggaggtgagaagctaacctacaacatctgaattctgtgccaatgttttccctcgacaattgtttgagtaaatttgattcttttttttttttttttgagacagagtctcactctgttgcccaggctggaatgcagtggcacaatctcaactcactgtaacttccaactcccaggttcaagctattctcctgcctccacctcacaagtagctgggattacaggcacctgccaccatgcccagttaatttttgtatttttagtagagatggagtttcaccatgttggccaagctagtctcaaactcctgacctcaagtgatctgcctgcctcagcctcccaaagtgctgggattacaggcgtgagccaccgcgcctggcctaaatttgattcttaacatggtgaacctaatgaagtgtatgggattttcaggaaaacagtttgtacacagtaactgtacctctgactttctcttctgtattcctgtgtagcatttattggtcacattctgctgtgattatttgttgatttattggccttccccaaagtagccagactttgagcttgtggagggcagagaccttgtcttattctgatgtttatcccacttgcccacaactatacctgacatgtggaaggtctcaataaacgtccaaaatttaaggccttttttatatttcaaaagtacaaattgaaaagagtgaattgcatttgatgcagggaggagaaagaaagagatgagaatcagtaaatattaacatttcttctgcattcagctaaaattcagctttagatataaaatatggaaaaataaccagagttgagagctctctctgccaaaatagtgtttatgtttaacatagttcacacagctgggctccatttgcctgccctccaagtgcacagtaaaaagatgctgtaggtagagtgacctggtatttacctctagttaaaccccttctgatggaccttcttgcactgcagaggaaagaaaactaaccactttgccagactcctttgcagctaggatctggataagaactagcatccccaatcagatgcaccagtatgagtctgggaaggtggaagcatagcaaatgtggccatagtgcagcattccagggtcacgtgaggggcagctgaggtcgctggagcagcctccttctccctatatgacagctgtgtcctgaagccaacagttcaatagtggcttctcttagttgtggcagagggtgcagccccagccggccaattcagtcatgtttttctaggggtcatttctggaagcccagtgtaaattttttatgtacccatttctcaatattaaactcctttctgcttagtcagagtggtttgtacttctgcagctaaactgaacatggggagaaagctagaataagccccctctctagtcatgccattcgatggagattaagagattattcaagccatatttgacctctcatgtttggttccatactgttaacaggactgtcctgggaggctctgtgggaagatcctcacgtctgctttaatttctggttgcttttattagatccaggattgacccagctaaggacaaagactcctgtaaccaagatcaaattagcttccctcttattctttattgcctttatggccttccagcctcctgggaaaagattgaagaaaatagtatatcaagcaatatggccaaaatgtgtttgggatctctttgttccttggtatccaaggaagctcgctcctgacacctgggtgggtcactttgtgtggggagtaagcaaaggagaaatagcagatgccagacactagaacagaagcagtttctctccaaaatctgttccccctccttccgaaggattagcgttggagctggacacatggacattcactgatgatacttcctggcttcccttgcagcaaggtagagccatgtggctaaactctcacgcaggaaatgtaaatgtcaatgagatgagtcacttctaggtctgagctaaaaactttaggatgagctttgccacactgtttcctcatcgtttgagacagagtatgaacgtgactctgatccagtttcccccatgctgaggaggacagtaccctagggctgggttggcaaacgctttctgtaaagggtcagatagtaattatttttagccttgggggccatacagtctcagtggtaactactcaactctgctactgtagtggaaaagtggccattagacaatatgtaaatcaatgggcagggttttacctaagactgtttttacaaaaacaggtgatgtgccagatttggtctgtgggctgtcatgtgctgacccctgccgtagggaatggcaaagcaataagataaaaggactgtgcaatttggtgcacactctgtaaaaaagagtcccccacaaacagtggctttcctcttacagaggaaaaagaaactacttttatttaaagccactgttgtgggggcctcttttttacacagcttagttttaccctacacccaacacgtaggccagtaagctgcctatgtaccctgcttgatgtctcccttggattcaggaactgagggggtttatgttgatttcatagaacagataagactagttaaaagaggcatctgaggcttttctccctgatccattcattgctttgtgtccagctatgggcaggcctgaaatgaactggcctattatcaataaaaggttgcatcttccactgatgcagcctacaaaagagggatcaggattgctgtggggagttgggaggagtgggtggtttgcattgctcagggaaggcatctctgaaaaggtgacacttgaccaaagaccagaaagcagtgaggggatgaccctgcaggcacctggggagatgtgctttagaccaagtgaaatgggaaaagttcccttatgccccttgcagggtgtgtgatggaggcgtggatcacttcttcagcaccccacagcttaaacccctagggggagcatgcaggtaccccatggcagcatctaggggtgaatgtttacagctcctgaagccccagtgggtgtgtgttacagtgtgctctttcagcttagctgtccactggcagcttgtgttaatcagctcaattagaccctccgccttatcgaaaggacagagggctttctgtatcctggggttcttgccagtgtactggaaaaattggatcacacatgggcttggagaatgagtgcaaggttttatcgaatggtggaagtagctctcagcagatggatggggagccagaagggggatggagtgggaaggcggtcttcccctggagtcaggccgctcagcagccagactctcctctgattacccctggctgaattccacttcgtctgtgtcattctgccaccgatggcctgccagagtctgtgtgttcttctgccagtgtgttcctctcaacgtccagctgcttgtgtttgtgtttgctagggtcttgaggtttttataggcacaggatggaggtgtggcgggccagggtggtcttggaaaatgcaacatttgggcgcaaaaacaggagtgcctatcctcaccagggtctgtgggcacaggcctgaggcctttctgtatcaaaaggaaactgcaccccatggctaactgctctgaatggaaccttttaaataagttatgagtgggctaaataggaaggtggtaaaatagaaggaaaagagagtaggaatttagaagctagtctgattttttacttacttagctctgtgatcttgggcaagtcaaccattctgagcctcagtttcctcatctacacctgagaataaaaactgtgtcctgcctcactggcagagttgctgggagtgccaaatgataagacacgtgtgaacacactgcatgactacaaagcgttgtgtccactaccgttctgttcagtggctgacacgaagaaaaattatttttctcacctaacaagaggtccaggggtaacagcccatggctgccgcagccacccaaggatgtcttaagaaatctgcctcatatggctgtcagatgactgctgtattcccaggcattatgttggcattccagccaggaaggaggaaaatagacaaaagggaagggagtgggcgtctatgtcaggaaagcaaaacttttccagaaatcctccaccagcttccgtatgtgtctcactggccagcactgtgtcacagggctgctcccagaggcaaaggaacctgggaattttttgaaagttaggggcattgtccccccacacaaaaacaggggagagaatgcacactaggtagacaactagctgtgttgtcacaaacatgttgaaaagccaaaataactatcgtggaatcagtgctataatttgactcagattaaatgttatttaagaataaatagtctcagccctttcattgtacaaaataggaacctggatcggccaagaaatatggtatgctcaatctttctgaaatattattagagcacatgattttaacaaaactacagctctaagaacgtaataccacttcacctaaaattagaaaatgcttttaggaaaaaaaaaaaaagtagagcggagcttaggtgctttttttctcttcttcaggggattttggagcgcctggagagtggggaggttgtgattggagatggcagctttctcattactctggagaagagaggctatgtgaaggctgggctctggactccagaggcagtgatagaacacccagacgcaggttggtgtccacatccccaagagtgtctacctgagtggtattttatttaaatctgattgagagaagatcaagaaaaaaataacaactgtttcaaaggggtgttttgcttgctaagattgccaagatgtggagataatggcagtatacaggcggaagtatatggaagaaaatgacctctctctctctcatacacacacctacccacatcacacacccacccatccacacgcccacacacactcccacacacacacatccatgcactcacaccccaaccccacatccacacacaccccacatccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaagtgtaacagcgtttatagtgagggtgattaatggtagtcacagtgtaacagagcacagacagccaggttccagggttgggagggcaaggaagtcaacacagttttatatcatcctcctggctgggaaaaaaaaaaaaaaaaaagagctagaggtaaagaactatgatgggattagatagttacctgaaatgaaaactttaattctcttctaactctttttttgtgtgtttgttctcctaaattaaagtgagaaaataaagccaaagaatgaaatgggtgtaagagaacactagctgagactggaacttttgattcactctgattttatgtatattcacacagcgtatcagataaacctagggtcctgtcttgattcttccactgaccagctgtgtgaccttggacaagtcacttgacctctccaaggatccatatcttaatctgtttcatgggggcacaacatgggctaggtgtgaggactcacaagttaacccgtgtgaagtgcccgtatcatcagtacgatggccgttatgattggtgcatcggacacccagagttctgtggtagagcaggaccaagttttgttcctttggtgcttaacaggatgttttcatctggcccaagaagaacttgttcttaatgttaaaagacctttttgctaaactgggaagaaagtgctggaataacaagagtaaggataagggaggaggggcgaaagtggtgaaggagaggaaggaatgactttcagatagccaggaaaagcttccagactgctttctgatgttcccaaactgcttgctctgactctgatatgggtgccacccacatgcattctgctttctatgagaagctcctcactttactttaagggctgccaatgctgactatagtagaccagctctgtcctttacaacacaggtatagaataaacctctctagaccaagagaccaagggttaattggccagtcaggccttaatctctgcatgtgactgcaccaagtcattgaggcccatcaccagaacaatacaaggctgctctaaacagtacatcctgcctatgaattctactgaccttaatctataattttttgttactactaggtttgaactgaggtatgattgaaagagatgggagtcagtgagctactgctgcttttgaaaatgatagcttctgtaatatttctttattcatttatttcaatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctc

SEQ ID NO: 38578 - DNA, 21679 bp, Homo sapiens
ctttccgacactctttgggaagagaatctctaatgacggcaacagtggagaacctaacgttccagaaggacactttgggaaatgctgttgacaaaaacagtaggtcacaaaatgatttcaatttctctctcattgtctcaatttctgtaagtctctcttctctctttccctcccttctttccttcatagggaaagccattttattatatactagccagtgagctcaaaacagggaaaacaatgaaggagaaattaataatgtctagactcctatcgaagctaaccataaatattgtcattccttgttctggttttaaattgaaagcaaaattggaatgagacatcttgtttgtgaaacatatcataaactaatgctacaagtatataaaaattctgaataaaataaggaagtataattaattagataactgactttggtaaaaagaaaacaagaaaagaagaaagaaagcgagcgagggaaattctccaaccaggtggcaatgatgtgagccgatctgacacaggttttggggatagaatggacctcactccaaacagagaattaaaaattaaaccatgcatctacctgggactttggatgggcccctcggtaagtgagggggctagaaaaattaaactcaccagcccaagaaagtgacaagctttctctacacaaagctctaggtagaaaataaagcaaaaatactgctgagaagtccaaattctagactaaagtgggtatggcattctagtccacacaatctgtgtattatgggagtcaccaagaactttagatgatagactctgaaacagactacaaactaagtatgtttataataaagaaatatagaaagagaaacaaaagtcatgagaagagaacaggtcattatttaaaaaagaacagaaacttaaaaaatgaaatacgtggttattaaaatttaaactaagaggatgggttaaaaacagaagaataaagaaaataaactggaagatacttatgaacaaattatctagaaagaagcacatagaaacagaaaatacagaattcagtaaagacacatgtaagacagaatgaaaaacatctgtcttatgggaattccaaaaggaataaatgaaacatttgaaaataatggctaattacttttagcatggatgaaagacatgaaccttcagttcagagcaaaaaatacaaataaactccaaatatatagtaaaactacaaaaccctaaagacaaacagaaaactttaaaggaacctgacaaaagacagactgtctataaaaaataattagactgacagaatatttctcatgagcaacattagaagccagtagcacgggggttagcaaacttctgtaaaaggccagagaataaatacattaagctttatgagccacatgttgtctacacaactagtcaactctgccattgtagcacagtaacaaccagagacaatatcggcacaaatgagcatgaatgtattcccacaaaattttacttacatacactgaaagttgacttatgtataattttcatgtgccatgtaatttttaaaaaatgtttaaaatgtaaactacatataaagtttaatgtaaaatgtgtgtgtgtatatgtgtatgtatgtgtgtgtgtatatatatatatatatatccctagctcattcacagtccatacaaaatagtcaatgggctgaatttagtctacggcccatagttttctaactactagaatagtgttttaaaaatataaaaggaaaaaataaccattaacctagactgataaacctaaacaatcactttaaaatgaagataaaataaagacaatttcatacaaagactgaaagaattcaaagaatcttgtagaaagaactaggagatggtatattctgagaagaataaaatcagaaagaagtggaatacaagattaaatgctgggaaataagaaggtaaacatgaaggtatatctacaaaagcattgatggcaaaaagtaagaaggataatacatttttcctaaaaaaaaaaaaaaaaaaaaacaaacaaaaaaaacacacacagagatgaactgaattgccagacaacagaaatgtaagagagaaggatggtgatcagaagcaaagtattctagcatgtttgtacttttgagcaaaggcaacagatgattaaaccaatgattcatttggtaaatcaattgtttacagtaacacatttaaggaaaatcacttcaaagaaacatctttttaatatttatttattttgttaggtggctttatgaaagtgatataaaatcttctctatttaaattttgaaaagtgagataaaatatctaaataatatggttaataaagagttatggcaaatacattgatgttggttataactgactgcagttctagaaatctgcataaatcttttgttgaaagtaatatctgcattggtagacgtgatattactacatacataaatatatattttccccaaacaccaaaagagctttgcaactgtggaaattatcctaacaaatgagctgccaagtcatgtcattatacatttgtccaacctcatagaatgtacaccaagagtgaaccctaatataaactatgaactttgggtgataatgatgtgtcaatgtaggttcaagattgtaacaaatgtactgctctggtggaggatatttttaagagttggaggctgttagaggagggaagaggtacaataattgatagcaggaagctgtggagggaggaaatctctgtgtcttccacttaattttgttgtgaacctaaaacttctctaaaaatgtctattaaaaaaaattctcttaacctttgcttttcagtttttgagggcaggttaagtattataacagctaacatctactgagcatttgtctttaatcctagtgaaacagatgttattagccttgttttatagttgaggacattgaggctaagaaaatttaactagagtaattaaggcacacacagaatttaaacatgtttcttatcacaagactgagttgttttccagttactctatttatattttttcctaatatctggcttcaaagtaccttctgttatttttaattccaagccttagagttaattatttgggcaccttagaattatttgggcacaactgtcccgaaaccagaaacgagggggcgtggacccagagactactagaatgcaatgctcgaggcattgcagcctaaaagggcggcagctcgccccgtcgcatgctgggaatggtagtttcctcgctctcccttcttcccccgccctcgagcatccagattggagctccgttcttactcccttgcagggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtaggcgatcgcgaggggccttgtaggaggtggcctaggaaaggggcatccctcagccctgagggtgcccgggttgggagagagtgttcccgccggggagaaggctcaccctgagagatggagaggaagggcagctggtggtggggcgcgggctcttgtcatcgcggagcacgacccgcgttggcgtggccttcgttctggggtggttttgctggggagtggagtggggtggttcggtgaagatttactgagccaggcactgcactgggcgctgggaagctacgctcgtacgctggccacaagcagtactcaaaacacgagtttctgtataaagacgaccttgctagatgttaccgagaggcaaagtagaatatgccatgggcgtgaataagggggtcgtatgaaggggtcctgaaagtaaattttgctgaggaaatgacctttaagctgagacttgaaggctgaataggagttagcccagctgacagcggagggcgagagtagacggtaggagtagtatagtatcataagttaattaaacagtagacttactatctggtatttcctttgatagctaatacttaccaagtgcttaatatgtggcagactttgaagcctttacagataccctccctccagtctttcttgagcccggatgactctcttgaactggacctttacataactatttgtctgactcgcaggagtaatgcatatagagcaagtaacactgtgtctggcacttagtgcttattaaatatgagctatcaccattatcatcattactccacatgtggcattaagtaacattttttataattcagctacataaacttttattgggcatcactggtccaatggaaatataatgcacaccacatatgaaattttaaattttctcatatctacattaaaaagtaaaaacaaagcaaaaaagtgaaattaattttgataatatatattttatttgagctaatgtatccaaaatattatcatttcaacatgtaatcggtataaaaaatgtaatgaggtagtttattcttttttatacttcatcttcaaaaccaatgtgtattttacacttacagtccacctcaatttgtactcaccacatgtgactcatagctactgtgttggacagcacagctctaagctacgttagactgtaagcttctaagacctcaagaagcttacagtctaatgatgagaacttactgaaattgcctttgacttgaagtgccatgtaaaaccaaacccagttatacaccggggcattaaataagttgaagaattctgtaaatgcaggttgtaatgctgttaataagatgtgctacacattttgataaaacaaaacctctggtcagaattttacctagacggcctcaaagtttattattatactcatctaaaagggaaaacttgctattatttttgccacctttttctcttgagacttttacctatggctttgcagtagatactatgaataagagagaaaacggtattttttttttcttttcagtctcatggaggaatgggaacatgtcatacaaaaagggcatcttgtgataatactaacaaagttcatatcctaaaaaatgtatgtttgtttcttaagccttgtgtgaagagcaactactaaaaatagaaatgtcttctttcttaaaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaaggtcagtcagtgtggtatctttcagtccactaattgttaagactgtatcggtcagtttgaaaagctcctcattggttggattctgtagggcaagatgaggttaagtgtttccagacgcatgaataatgtacttctggttaccagataacagcatttttctgaactatataaaatatgccatgagttgtctggttaaagtgtaaagaaattgaatctgcataatttttgatgctgaatcaaagtgagcggaagtttagcagatggaacaactgacaacaagaaggagggtatgcttagtaaggctgcactgtgtacttctgtctataccaccttctgtgttaagaattgagatctggctgggcacagtggctcgcgcctgtaatcccaacactttgggaggccgaggcgggcagatcacctgaggtcaggagtttgagaccagcctagccaacatggtgaaaccccatctctactaaaatacaaaaattagccaggcgtggtggcaggtgcctgtaatcccagctattcgggaggctgagacatgagaatcacagcaactcgggaggcagaggctgcagtgagccgagatcgtgccactgcactccagcctgggcgacagagcaagactttgtctcaaaaaaaaaaaaagaaagaaagaaagaaaggaaaaggaattgaggtctgcaaaaggaccatgagaagactttgggatctgatttgacctcttcactctagaatgtgggactgttttaaagcactaatgctgttatatatgaaattctgagaattaccagaggacttaaaggtaatagtcaaaaacattttttattagggacaagcatagaccattttaaagtatcagttagttgactgtaaccttctgtagtgggtttcttattcctcaaggattccaggatgtaatttctcttaaatatgaacaaaatgaataaccattttagtacaagacttaaaatagaccaagggtgctgtcatttttagtcatttgtcttttgacttgaccctttttgccttcttccagacttttgaagataatataagaaaaaacaggactgtgattagtaactggataaaatacgcacaatgggaagaaagcctaaaggagattcaaaggtaaaattactgagagtgtagttttgtatataatgattcatagattaacagataccaaaaagaaaagaagaaaaagttaaagcacaggtaaaagattgtgcctcgggtagaaattttcaactttggttccatggaaccctagggttcccttgagggcctcaggagtactggggtagaatagtcctggggagggtggcagaagaggctttagagatagatcttgtcagttgtagctaaagaagcacaatttcatttgctttgtatatattgagatttttacaaatttcagctaaacaatggccaaaaaaaataaaaccaatggccaaaaaaaataaaaattgcaatctggcccttcctgtggtctagctttctgcattctccccgcatacctccttcccccactgtgcctgtgtatgtgccactccctgaatatatcatgtctccttatcgtgaggcttgactgttctccttgcctggaatgagcaccccctcctcaccaaacttagtttcctggtaaatcggaacgttcctcaagttctcatttctacaattacctactacttagccttttccaccaaacattttcatttcttcctctctgtttcccgtgcagatcttgactataacataaatcacattgcattataattgcatgcatgtctttttataagactttgtaaggtacttgagagcattatatcttttcatttttttatgcccagaacttggctcatggtagacacctaataaaacatcagtgcattccagatagtttgaaataactgctacatgtgttgaatgctctatttttgatgccctgcaaatcttgcttcttaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtaagtttctgatctaacaaaacagccttttatagactagcaaagttccacatcttctgtatttattttatttacatgatgatagtttaatttgatatcctactttttcttcagacataaatgctgttatgtcccatagtctattaagtcataatcgtaatgttctatagctatgtaatcaaaactaaaattttgattgcaatcttttattcataagcttcttgttgaactaggcaacttttaagaaaaaaaaatctttttttccaatggttcatcctttttcagatttacatacaaatgacaaaacatgtttgatttaacctttaagaaaggtaaaatcttcaatcttcttcccattcaacaatggaagaactaaaccacagcagatattttcgggtgattttgttacaggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatatatcctttggacgagatctgtatggtgccatgattgtcctggatgctgctgctgctcctgtagagatgtctcatgatcaggacacacagtcattaatgtcaggctcaaagtcaagaatgccagtttatcagcttccctatgttttgtagggaaagagattggtcagaatgaaaatttgtattctgggtaactagtcttttctagtgagagtttgggtttattttattgtaatgctaaaagctaatgtttccttgtggaaaatgatattcctgggggattgtttccaggaactcaaggggataccaaaatcggtgatgcttaagtccctcatataaaatgatgtagtatttgcatgtaacctatgcatagcctcccatataattcaaataatctctagattacttatacctaatgcaatgtaaatgttatataaataattgttattctgtatattttaaggaataataagcaaaaaaacgacatgttcaatacagaagcacttttttctcacgaatactttatctcaggttggttgaatccacagatatggaacccatggctggaggactaactgtactaaggtcctggctgccattgccagtcctgtttttctaaggtttgtgttggtcattactaccttactggagttcatccaaggtttactgtttactagctgtgtggctccagagagtcatttaactcctttgagagttggtgtcctcttcttaaaaacaagaataaaaacacctttgttgggctgttgcgaagattaaatgatacacatgaaagcacttttagaaactgaagtacagtcattcctcactatttgcagattccatgtttgcaaaatcacgtatttgctaaaatttatttgtaacccccaaaatcagtaattgtggcactttcacagtcatttgtggacatgcacagagcatgaagtccaacaaggtgaggcttgccttctggtcttaacctcatataaccatgcctagagcttggagacaggaagggccagtgccatgtagtgcaaggagctgtggctctggggccagtcggggagtttgaatccctgtcagtggggcagcctcagtccagtcacttaacatttctgaaccacttttcttacaaaataatgaagatagaatctgccaggatgagttctttttaggatttaagatgatgatgaatgtgagattgtatatatacacgtttctcctaggagcagtggttcagtactcaataattaagtgttcgcattgactaaatagaacataactaccagaaataatgagagtcaactttattatgcagtattaagatctttttatttttttactcttctctgttgaggtgacaatgttaagatcttaattatgtctactaattttaatattattagtttgacgaaagcttttatagcacttgctacgtgccaggcagtattctaagtactttacagatattgttgtttaatcctcataacatccttgcagtgtaggaacttctctgtcctacagatgagggagctgaggcatgagagattaagtagcttgactgggttctcacaggtgctgatggaaatagaatgtgaacctagtagagcagcttcagaactgatgctcttctttgccatattggaatatattactactttggaaattaatgatttattcaaggaagatagattaaaatgacaattcaaaactttctgctttgactctagttaacagttttctttttatagcatgtttttttcttaattattagttcaagtattcatattttaatataattggtgctatttaatgaccagaccattattgaccgcttacggtgccatgttcttttggctagaaactgtgctaagggctttacatacattttctcatttaaagctggcagtaatccagtgaggctggcattatttttccctgtttacaaatgaaacagctgagacttagacgtctaagttcagtgacttatccaagatcacatggttggtaacctgggttgagatttttctttgcttccaactcgagtttatacccaccactaaaatcttaactaagcactggaggaaaatagagatgaacaggcgtggccctgctctcacagaagccactgtttaattctacacttttgtatgtgttttgttcccctagagttgtagtttgaatttttggagtttccaggctttggtatggttttggtgtttacttacttactatttttttaagccatgctgttttgcctgggatttccttaattcccttgcacttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagaggtaagtatacctaacttcattatactgtaaaacagcttagcaaagattacattttgtgcatggtgagttcatttccattttttcttactgacatatccctggaaagatgttttcaaaatacaaaaacacagcttctcacagagaacagcatatatatgtgactaagctacagatgggagctgattatagattgtattataactgtcttaattttattgtgctttgtttgaaaattaagccttttagtctgaatgcccgtaaactgagaactagtcttttggcatcctaagtaaaggacttaaccgataataaatatgggaaacaaaaagcttaaagccctagaacagaaaacatttagaatggaaacagagattgccctacaaataagagagttctttttttcccttgtacctatgaaaatagctcaaatattgagaagatgaggcagaaggatcacttgaggccaggagtttgagaccagcctgggcaacatagtgagaccctgtctctaaaaaaaaaaattgagtgggcatagtggtgcacacctacagtcccagctacttgggaagctgaggcaggagtatcacttgagcctaggagtttgagactacaatgagctatgttcgtgccattgcactctagcctgggtgacagagcaggaccccatttcttaaaaaaaaagggagttcaaataatacagaattgagatccatccaaatacaggtttgagcattcccagtctgaaaatccaaaactcaaaatgtgaaacttgttgagtgctgacatgacactcgaaggaaatgttcattggaacatttcagacttcgggtttttggattagggatgctgaaccagtaagtataatgcaaatattcccaaactggggaaacatcccaaatccaaaacacttctgataccaaatgcttcagacaagagatactcaacctatataaggtcttgcacggaccatgctagggagttcagattctgttcgggccagtgggaagcattgaaaggttttaagcgggacagtgattggatatgatttatattttaaggagagcctctggctaattcatggagaatgtatgagggtagatggcaaaagtggaaccaggggagaccagtggggagacttttgaagtgggccaggtgaacagtggagtttgatggctgggggctggggagaagcaaatggctgtgtggaagagattgaaatggtagggcatgttgcaagagtgaatatggagtatgaggaaaaaagaggaattgaggatcacctgaaggttttggcttgagcaagtgactgtaggttaggccttgcctactaaaattgggaagatggggagagtcccagtttgagtggggaggaaacagaagctcagttttggacctgtttgagatgtgcagtagacatccagttggcagtgttaggtagacagtattaaatatggagctcaaagcagagtaccggtccatcctgacagagataaccttcaacaagagggagaaaagcatcttactctggatattatgaggcctcaaaatctaacttataagtaatattttgttatatttactctcctagttgtgactggcatgagaatattgtgttatagaaggtaatcatcctgtctgcatttagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggtgagcactggtgtggatggtcaactctgcagataacccaagatgtgctcatcaatactagcaacactaaaatgaataatagcaagtagcactactagtgattactctcgtgatgatgtgcccgtgatccaattggcagctatttcagacaagtaggaataaacaaggctgatagaaaaggcaagcaaacaacacttggatttgctctgccacttacatgttgtaagtcgttttgttgattgttgactgtatgtagaactggagcaaaagaaatgtggaatccattcgagctcattgttggaagaaggtggaagagtcagagattggtccaaaaacctgttttgcacatcacctttgagcttaactgcctgaacaaaagatgtatgctagacagggttccatcggcatctctttttctgtaatgtactattttgatttcaattcaaagagagtgtcattttccttcagtattctgttgtgtatttaaaaatactcttccttagtcaagttaattaagatacctccaagcaaaggactaagtctgttattaaatgtggtggtaggttagcaagatatgttaaagatgaattgctattaattggaaaggcaagtttaacaattgtgagcatgatacgattctgttgttacagacataatgatacatagtcacatatttaagcaaatgcattggcaagaataggcatctaattattgactgtcgtgagagtgatggctatagatgaaggagtccttgctgtgggacacctggccagtaatctatcctctgtattcctgtttcttttctatttatgcagtctcagggatggtgtttttaaaatgaaagaacatgtaacatttagaagaaaaggtgctaaaatatagaaagtcagcctgatgccttttttcagcttgcttaacctggcaagtgcagctcttggttttgttttttatttattaaactggttgtctttctaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggtgaaaaaacagaattatgtgtcagctgataatggtttcctgtcttctgtattcacagctcacctattgtggatgtttgtaattcttgaaagaaggaaatttagttttaaatttttataggcttctgttcatccatacagttatatattcgctctgcaacattttaaaccctctgtgcttgttgtggccacacgtgaggggcttttttaactttggtttgatttttacttgaggcacaacaagatatcacttggagcttgaaagagaacagtgaaccagcccttaatttagtgaaatatagtttcctggatttgctcattaataggagtaattctggctagattatgcatttttgcttttagcaaaaatcaagtggcattttcagaaatcatttgtattaaccttctgggtttgatctgagactatgaaacatctttgtttctttctgccatcaggcaaaacggctttctacaaagaagggcttagaagtttggtggctatcttgttggtgattcttaaactgaagtttcatggccgttcatactttagatcataaatcagggtttgcaagtaacaacttgtgaaacatgctgttttgggggtgtacatttttaccaatatcagtaaaattagtaactagtaaaatgagtgttagcagcagacttcaatattttgtgaaaatttcttatcctaatacaggatcctgagaggacaagacaggtgtatcaagcctctttggaactaattcctcacaaaaaggtatgtttgctctaaagtgttccatttcaaacaggtcagaatcctcttctgttacttgtgaagtaattcagtgaaataatattgattgataaaatgcttccctgtcccaccatggacaacataaataagactgagatatgctccttgcctctgaaaacagctcacagactaggttggaggacaacctgcattgacaaacaaataatataaattcagagaaggctaggtaatgtgaatagtctgagtggaaggagaaagacatccatgcagagagcacacaacgtgtgcgggggacacacaggcgggtttgttggtaacagtgagtgtgtgcatgcacagatgaatgtgccccttgtgtagatggttgagatgttacctccgccttgtttcccagcacgagaaacaaaacgtgtttccttctgtagaagtgttgactgagttacttttcagaatagaggtaggacattctgcccatatacaagcatgcctacaaaacaaagtctgttctgagcagaggctaccgtgccatacagtacagtacagtatctggatcatggttctcaggagaggttaccatgccatgcagtacaatatagtatctggatcatggtatgtgggtttctaacttttgtgaaatgaatgtggtctttgcttgtaaataagcagagtacattcctcttactctgaagttttagagaaatcgaattaccaatggctttggttaatttaaattaattttaattcaatttaatttggatgaggcttttaagctagatatttttgtgcttttgttttctagttcacatttgccaaaatgtggatactgtatgcacagtttgaaatacgacagaagaatctgtcattagccagaagagcattggtaagtaaagaaaggatcaagatgtctcatcaagttctatgagaaagaaattaaaatcttggtgcttggaagttgtacagttcctactttaaagagtgacagaagtattatacctttatagcctgggacatgttagaaaacatgcgtcctctgtaaaaacactgactaataatgcgtaaattattcttattacctggggcaaattaacattctgtttcaatattggaaacttctatagctaccagttactaaatctttccacagactggaattagtaatctgatcctgtgcaaactttttggtgtgttaaatgcacttttaattgttccactttttttttcttttttttttttttgtttgtttggtttttttttgagacagggtctcgctctgttccccaagctggaatgcagtagcgcgatcttggctcactgcaacctctgcctcctgggcggaaatgatcctcccatgttggcctctcagaatgctgggattacaggcatgagccaccatgccttgtcctttttatttataggaggttttatgcatttgacatccctattccctaggagatcctgagaaactttcaaatcttattttatttagttgcccaaacaattctggaacactgcctcttgctgagtgaattagaggagtttccttcagccttttgtcaagaaccagtaaacattgtgataccacagagggaaagaatggtaggccatgttgactttgcaagattcttcctcagcagagaacagcctctagggcagtgcaataactgcacagattaaatccactacagtatcacagtggtctggttattttattttccagggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgagcatctcaagtcaaatataattttgtttgagatacgtgtttagtcttactttagatgaccatctaaatgtgggtgtattttagagtataacgatgatctaactaacttagtctcttctactcagattaggcttgtacgtggaaaggtggctgtgggggacaggggaagtagccctctcattagataccagagcagtagacatccaggatgatgcccaggatgaactgggatatcatgggggtgggtgacgccccttctgcagcaggaaagcctaaaggggctggggaagaggccaggcaaggaagaagccagcaggctggcccacccggagaacgagggggatggaggtaggaactgcacatccctgtattctctaaaccaggatgtccttgcaacttctgttgtcactgtcctgaaagtcctcgcctgccttcagtagttaagcttgacccacaaggtagcaccaaaccacagctaggaaagatttgaatctcacatgagtcgtagaactcacccagccgttttgttaatctcatgcactaacatgaccctgcatttaatggtttggccccctgattgcattaattaaggcagggctttgggtatcactgagttcatcagttgtcctcggctcctccaccagactgccagctttcaggtgtccatgccacggtttattcatccttattccctgccaggctgcaccgagccagtgcgcacctgttcagtgaatgcttgttgcactgaactctcataataacaaggaatgtacagtagaggtaagaacatgcatactggctaacctgggcctgttttctctctggacgctcaattgcgtgtggctagaatatggagtacctgggagatgcttggcaagtttctcagctcttgataagtcaagcatttgaaaaacttccaaagagaatctctaagactgaatccaaggccctttttctgtaatctggaattctagccaagttttggccagcttatagataccaatgttatttatcttatccacatgtgttctttagttgttcagtaaaaatcctatgttcctagatgtaggttagagtgatacttcagctgtgctttggatgggggcatgctgctttgtaaatgtcaagactgacccatttacttttcttccttaggtgctttggaaatcatatattgattttgaaattgagcaggaagaaacagaaagaacacgaaacctttaccggcggttgcttcaacggacgcagcatgtcaaggtatccttgctttgtagatgatctttcattttgcttgaatcagcagtccagaagaaaatgatatatttctgtattttaagtgtttgggtttttgttttttttttttttttaatgacttccttgcttttcaagagaaacgtgagtctcagaggactttggaatgtttggaatgttaagtttataccaggtcattgtttatgctgcatgtgagtagcttgggtatcacaagattgaaaaaaagttaaactattttttttttttttgagacggagtcttgctgtgtctctaggctggagtgcagtggcgttatctcggctcactgcaacctccgcctcccaggttcaagcaattctcctgcctcagcctccagagtagctgggactagagacgcgcaccataatgcccaggctaatttttctatttttaatagagacagggtttcacctgttggccaggatggtctcgatctcttgacctcgtgatctgcccacctcagcctcccgaagtgctgggattacaggcgtgagccactgcacccagccaagttaaactcttttcaagagtttaagactatgtcagacatttaattgtagaatgtagaatcaaatattttcagtgtttatattgaagcatatattcattgttttcatctgtgaaacattagtgatgcacacattactttccgatgtcattaactgggaattcgctttattattactacattattatcttctgagtgatatggttaatttggttcaataataactttttttaaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatggggtaagaactctgccctgggactgttcatctcacgtcacatgagtagaaacacttctgacgtcgaaatgtggacttttaagtggcatatgtacaatcttagaatggaagcagaccacctggagtaggagatggttgcaatctggctgttatggaaacacggggtagaacatatggtccagtcagaggtggagaacgggaaggggttggcaaaggtgttttggtgatggttgagtctgggaacttcatgaagtgtgatatttttagagcatttaataggaagtaagtgtggaggaagatggaactgaactttcagataggagcctatccagagaaggcttgtaggcggtaagaaggagtttggtgggagtcagtgaaggctgttttgcataaaatgacgtgaccagattgctagcctctcatcctggcagactcaaggggcttagattggagaaagaagacccatcaggaagcagtttttataagctgagcaagacatggaagctggaactagaacagggccacagggcctgttagaacaatatttgggaagtgaaatcagtgactgataggaggtgaggatgggaaggtagggagttggaataataatgcacagatgtatggcttttgctactgggtgaatattatgtaaagatcgttaaacgttttcttaagtgtaagactgcacaatgtagttggagacactgaacatcttggttggctatagaggagctgtgcttagatttttagaatgtttttctaccagtttagttctcactgagctacagttgctgcttactcactcccagtctttcagacccagcccttgttctttctgtagtagactttgatgttattttgtaaaatggaggtaatcatccggatttccagtaaaaattcttcactctgatatgtgagtatatcacccacgtttgcttatcttttcattttttatttctgtagtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 38579 - DNA, 5586 bp, Homo sapiens
ggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggtgaggctgggcgcgcgtcgcggagttgttggtggaagcgggaggttcccggggaagccgggaatggcacgtctggagccggaggccctgtggaagtttaggcaaaggatggggtggggagagaaaagcaaaggatgagggggcgaggaccctgggtcctcaaggtgagaggcgcccggaaggacgatggatggagttgacacttggtccacaggggaggaggctggaccgatgcctgagccttgtgagaggggctggagagaagagactggggaggcagagaaggggtaccggatagaacgcggagagccctggagtcgccgcgaagggcatgggaactgcagaagttttggcagggcagccgcaggcgcccgggaggaggagagctggcggaggggagggagcggcgggcggaagggagagccgacccagctgagggtgaggaggggtcctgggaggatggtgggcgagggcagaacctgcttagaggagcgggagcaggaggctgggctggtgggttgggggcggagaaaaagctggggaggaggggactgacaagaggatggaggaagggagcaaggggttggggcatatccaaacctccccgtagcgtcgtgggggttggtctcggactctggctcaagctaagccctgtgttgtttgttattgttatttcggctcctcccaaggccccaggcaggagcggccaggggtggaggcgaggtgcgggagaacagccgctggggcctctggctcctctccacatcccagtcttaccacccatctaccccccgcgcctctcctgggccccggctccttggccactaaccagcccattcccttgcccgaccgacccctgggcgtctgggactcctgactggcttcttcccagcagccaagctggtcttgggtcttgcttctgccctttgaagtcttcatagacctaattagtctgaaagtaattggcacaattatgcaaattgtttctctctcccccgctccaccatatcggcctgctccagccatcagcactagacagtgaagtggaggggtcggtatcccagtgtttggaggggagcatccagtgccctctcctggctcccatagtactctgtggatctgctgggccttttgggacacattcaagtctagctgcctccctggccagggtccagagacacaaagcaaagggcccaataaatgccactgggcttttattgcaagaggggaagcagctttattgtaaggcttttatataccaactcttagcccgagggctctgggtgtgtgtttggtctgtgtgatggagggaggaagggacagatgtttttctgggatgcactggggaaggtagataaggatggggccgctgaaagagacagagaatgggactgaggaggcagcaaggaaggcaagggctctgaggacaagaaacagtcacggacgagcctgggaaaagagaattgagaacccttggggagtggaaagggggaggacagtggggatggagttaggaggatgagggaaaagtgatggggtgagaggaaggagggatcatgaaaggtgaaggaggagaatgagagggaaaggagcacagtgtgtaaagaggtgagatcactctgaaaggtgaggagggacactgctaactcagacagaactcacctgaggaggggagagatagggaaggatgccccagggaatgaagcccagagctcacatccatgtttgtttctgcccatcctaggatatgaggaagacatggagacggtgagttccacttttctgttccctccttttctcaccagctgccatagccatcacgttctcactgggcccacacctttgttcccattaataggcaggttttctggggtatagtctcatcccttcttcctccagagatgtgagtggggtatgcgtgggggcattaggatcagagggctgatttcctgacccttcccctcatctgtgtagatttgaagtcccaacatccaagtcatctaattcagaggatgatctccctgaagattatccagtggtcaaaaaaatgcttcatagactgacaggtaaggaaagaagaagggagggaagggaattgaatgaaagtctgtgttagattttcttccttttagccctaaaaagtgatcaggtcctttttgatgtctgcattagtttcctagtactgctctaatgaagcaccgcaaagtaggtggctgaaacaacagacatttatctcaaagttcaggaggtagaagtctgaaatcaaggtgtcagcagtgttggttccttctgacggccatgagacagaatctgttccatgcctgtctcctagcctctggtagcctcacatgttctttgggtgataggtctgcacattttcttttgtatgcatttgtctctgtgtccaaatttcctctttttgtaagtcagcaatctggattagagcccaccctaatgaccttcattttaacttgattacctatgtaaagatcctgtttcaaaacaaggtaacattctgaggtttggaggacttcaacctatctttgtgtgtgtgtgtggagtgggggagggcacagttcagcctataacaatgtctatcctcgattcctcatattccagccattttccctcttcctttttcatacattcaaacaacagatccctgaaggttaggtgcctctcaaaaatctctgcttccaccacctctcgtcactcctccctggaaggggaccccagcatctccttgacccttctttcctcactcactcccaagaagaagggtgcctctacccttctttaaactgcctagagaaggtggtccaccatcttggtcatccaccatcttgcccagtccagattgcttctgacacccctaatccagaaatttttcttcaaagcaccccatacatataaggccaatggttctttttctggtctctggctatcaccacctgctctcctcctctgccccacaacccctacagaaataggactgtccaccccaccccccaattcctgtgggtgggtgggctggtttctcaggataccttggattcctccctgtgcccctcccattacttgaggttccagtatcagtacgactttctctttagatgaaccttccccattttgctgacccagctcccatgccccaccccagatgatgcagattgaggtatcagtccttactcctccctcgaagtcagatcagcctcactcttcctcccccaaccccacaaacgagacaacctctcatttgatcttcctgctgtgctccctgcactgggccagtatgatccttccccaggtccaattctacagaagtggtgcatcagtacaaggtctgatattgcccaggtctgctcttcatatgccttccttctttttggtcctgcagtcgccttttgagctgttgtgtggtcactagctctcagtcttttacgtgatcttcgttgactattctccaccctaccccgcctgtgatttagaaaactctctcatgaggtcctctccctgcctccccgtctccagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 38580 - DNA, 2453 bp, Homo sapiens
gagttcggggccagcagccgtctacccggtgtcgcgttctgtgttgtggcggccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgatgaaggcactgatcttagtggggggctatgggacgcggctacggccgctgacgctgagcaccccgaagccactggtggacttctgcaataagcccatcttgctgcaccaagtggaggcgctagccgcggtaagaccctgggtcgggatcagagtcgcgttcggatctggcgggactagggatggccagcgactaggggtcaggggctcccgtaccttctgactgagcccgcccgtcggcctgcgttctgacaggcaggcgtggaccacgtgatcctggccgtgagctacatgtcgcaggtgctggagaaggaaatgaaggcacaggagcagagggtgaggcacagactcttggcccttattctcggtccccgcccaacttcccatcctggtagaacctgactgggggggcctcttccttccagctgggaatccgaatctccatgtcccatgaagaggagcctttggggacaggtcagtagaggcagaaaggtcccttgggggagggtttaaggccaggaaaagggtaagacccagcctggagtgggcctgctgagcctgaatccagggactcagacctccagcaaggtggtgacctgtccccttcccccagctgggcccctggcgctggcccgtgacctactctctgagactgcagaccctttcttcgtcctcaacagtgacgtgatctgcgatttccccttccaagccatggtgcagttccaccggcaccatggccaggagggctccatcctggtaaggcgccaggtcttctctctcttgacactttcaccctccatgcccagcctcccatgccccctagccttcatctgccttcggatgttatggatacagagctgtgcagtatgtatctttaagcacttggggcagagtctcttgagatctggaacggcatgtgtatcaaggcttaggaacactggactaggtccgaggtccccttccttgcattcaggtgaccaaggtggaggaaccctccaagtacggtgtggtggtgtgtgaggctgacacaggccgcattcaccggttcgtggagaagccacaggtgtttgtgtccaataagatcaacgcaggcatgtacatcctgagccctgcagtgctgcagcgcatccaggtgtgtaggagacagctgttggtgggctggggtggggcaggccatcaccgccatgaccctgctcacaagctgcccactcccacagctgcagcctacgtccattgagaaggaggtcttccccattatggccaaggaggggcagctatatgccatggagttacagggtgaggcagggaggccacagggtgggggtggtctgtggctgggctgaggcccctgatgcatccctccctacaggcttctggatggacattgggcagcccaaggacttcctcactggcatgtgcctcttcctgcagtcactgaggcagaagcagcctgagcggctgtgctcaggccctggcattgtgggcaacgtgctggtggtgaggcccttgcccagcccatcattaaccccctcagtcttgggagacaagtggcccacttgtatttttcccaccgctctcaggacccaagtgcccgcatcggccagaactgcagcattggccccaatgtgagcctgggacctggcgtggtggtcgaagatggtgtgtgtatccggcggtgcacggtgctgcgggatgcccggatccgttcccattcctggcttgagtcctgcattgtgggctggcgctgccgcgtgggtcagtgggtaagcctgtgggctgggctgggtggggagaggggcggggagtgtgcctgcctccctgacaaggcctatcctctcctggaggtacgcatggagaacgtgacagtgctgggtgaggacgtcatagttaatgatgagctctacctcaacggagccagcgtgctgccccacaagtctattggcgagtcagtgccagagcctcgtatcatcatgtgaggggatgcagtggggctggccgagccccggttttcccatcagcaaggggagtgctggcctgacacatcagaagaccctggacttgtcattatttgtctggggggcactgggtgaagctgaagctgttggacacctgccttctcatgtggacatcatctggcaggatccctgctgggcacaccccacaaaccccactccctcaagaagggccagggccagggctgtatggaataataatttaatgctcactgtg

SEQ ID NO: 38581 - DNA, 57610 bp, Homo sapiens
gagggcggagaccaaggctgcgcaggcgtggttggccggtcgttgcgttgggatggatcaggcggaattccagaagagaaaataatccctgtctagatgcagaggacttggttcctattccagtgctcctccggtagcagggaggcgacagaaggtgggtgcggccgcagtggtagtgggcgggacggcggggcggaggccacaccacgtgacgaggcgttgcggcgggggcggtgccaggtgggctacgcggctggggcggctgcggatatcgccttagggacgcgttgacattcactggctagtccaccgctctcagtcggagaccacattgcctcgttagtcctcaatgatgggagtgggaattcttggtgggaaggagaatttcggaaagcgtgcggttctcagaggagggatgagcgcccgtagatattttgtggcgagtgcgcaaaagttctcatttcttctttggaacaggcttttcaaccagttgtccgtttccatcccggactattcggataaagacaactttgaagagctttttgttttaggtttaattcgtcccgtttagttctttgacttttaggggaagggaatttactgaatggccaattgagtttcttttctacaggaaggcgattgtgaagcggggctctgaggggcttgatgccccccacccctcacacggagaccttgaaagaggcaggtgactcactttcagtaagggcgttcctgttgttcgcctgcgatggatggcatcttgagctcacatctagcgttaggccgagaaatggggcccttagggaggcttccagtgaaggttgagttataggtcagggccgggaggttgttgtgcccctctttgagaaataaaagccgacgtgggcctctaagtactgattcttatggggtcagaaactatttcttgagtccgttcttctcagagtttattacttcctcccacgtcttggtctgctggtctaattcccttcaataaccttcaacataggaaaaaaccagagtgtgttgtgtgtctttaaagatattagagaagtgggagctgttgccccaaaactgttttcttatgtagctactgaaggaacagaaagcaggaagaaagaaaaaagttagttgtggccccagaagagttgtttttcaaatgccgagccgtgaagcctcatgcactcaacacaaagtttttctttcatatagataagcctgaagaaaaaagaataagcctgagtatgtattttaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagtaagcatttcatcttcatttaaaaatttaaaaaaattccttcttttccatctggtcaactgaaaaattttagttaaacggcttctggtttgtaagtttaaaataacccaaactgagacaggctctcgctgtcgctgagggtgtagtgcagtggtgcgatctccttagctcactgcagcctccacctcccaggctcaagtgatcttcccacctcagcctcctgtgtagctgggaccacagggcacacaccaacatgctcaactatttttttgtatttttggtagagacggggtttggccatgtttcccaggctggtctcaaactcctgagctcaagcaatccacccaccttggcctcccaaagttctgggattacaggcatgagccaccattcctggctggttttttgctctttgaatgaaagctataactacatgatttttttgtgtgtggaaggaaagtaatatatttaccatttttccatacttgtcacttaaaaaaaattctcttgtatctggtagtactttcctttattctgttaagaatttgtggtctgtgctagtctctggggatccaggattgagcaaagtcagcttagtcccttcccttgtagagcttatatgttagtagaggaggcagagattacaaaagtattggtcaagtaatatatataattacaaactatgacaagtactctggaagaaaagcctaaaatggggaatctgacctagttttggttgtggtctgcctggggatggctagggaaggcctctctaagggaaggatgtgtaagctgaattatgaagaatgaattgattaggcaaagggtatggagaagagtattacagacagagggaactgtgaataggaaagccctgagttggaaagatgcatggttctttttaagacctgcaggaacagtgagcctggaacagaaaaggtatgaaaatggtgatgatgataatgattaaaacaacaacaataaaaatagctggcattagtatatcagtatgtagtatatattatatcataatcatatgtgacattattaacttaatatttatatatgcttaagagtgtgtcaggcaccattcttaccaccatattattatccccattttacagatgaggaaaccaaagctcaaaaaagccaaatagtttaccacagatcacagttagtagtaaatgacaaagactggattcaaatccaggtggtcagactccagaacttgtgctattctgcttctctatgataaggctgtatatatagtttaaggctggattatgtaggacgtagcagaccttgttataaattttggtttttatcctaagagcagtagatagccattatagggttttttgtttttgttttgagatggagttttgctgcaatgttgtaatcttggtggctcactgcaactttcacatcccgggttcaagtgattctcctgcctcagcctccccagtagctgggattataggcgcctgccaccacgcctggctaattttttgtatttttagtagagacggggtttcaccatgttggctaggctggtttcaaactcctgacctcaggtgatccacccacctcagcctcccaaagtgctaggattacaggcgtgagccaccacacctggccaattgtagggttttaagtgagaaagtaagatgaaacagatttgtgtttggaaagatcattctggctaccccatagggacccagaatggagagcacggaaatcaatgtggaggctgggcacagtggctcacgtctgtaatcctagcactttgggaggccaaggcaggcagatcacgaggtcaggagatcgagaccatcctggctaacacggtgaaaccccgtctctacaaaaaatacaaaaaattagctgggcgtggtggtgggcgcctgtagtcccagctacttgggaggctgaggcaggagaatggcgtgaacccaggaggcggagcttgcagtgagccaagattgcgccactgcactctagcctgggtgacagagtgagactccgtctcaaaaaaaaataaaataaaatcaatgggagagatgagttagttgttttggcaaggaatttttcttctgggacagttctttcgctttacactcaaagttattgactttattgtatcagcaaagcaattatattttaaaataataaaaaacaattttatttttcacaccatctcacaggcagtatcattccttttttttttttgagatggagtcttgctctgtcactcccaggctggagtgcagtggcgcgatcttggctcactgcaacctccgcctcccaggttcaagcgattctcctgcctcagcctcctgagtagctgggattacaggtgtgcgccaccacgcctggctaattttttatatttttgttagagactgggtttcgccatgttggccagattggtctcaaaactcctgacctcaagtgctctgcccacctcggcttctcaaagtgctgggattatggttgtaagccaccatgcccagccacaggcagtatcataagaagacagggatgtcaggtaggttttgtttcactcatgaactctatgccttgctagagtgctgggctaagaagagttctgaggtagtgtctgttagatgtggagtgggggatggtggcatccatgctacttgttttccctccagatggtaaattcttactctttctctgcctaaagtaaccatttctttgccaggttttgtggtttttagcttttaaatattttttgtatctgacccatgatgttcttctatatttcattatttctctctctcttttttttgtttcctttttttgagacagggtctcactttgttgcccatactggagtgcagtggtgtgagtatggccactgcactctaaacgatcctcccatctcagcctcccaggtagctgaccacaaacatgctccaccacacccagctagtttttgtagagacggggtctccttatgttgcccaggctggtcctgaactcctgacctcaagcaatcctcctgccttggcctcccaaagtgctgggattacaggcatgagccatcatgcctgaactatttcattatttttcatttggacttttataatagtttcctacctattctccttccttcagtcacatatcccatcaaaacactctacagtgatgccattgtactgtatagatcgagtgatatttctccctttaaagaccctgtttcctccagtgtgatgaagcaaagatctttcaatgtgacatccaaaccatccatgtttaggcctttgtttccctctccagtgtcatcattcattgtttccaccttttcaaatctatgctgctgccagctatttgcagttcactcaaaactatcttctaaaactcggttgcattttatttccctgcctttgcacctgccatttcttgtgccggtggaagaagaaataagctaggtaggctggcaaaattttgtcctcttttaagatgaagtttctcactcacaagtagaatgagctgttctctctctcttttttttaattgtatagtgcaatcacttttattatggtatctacaggtcaatgaattttgtcttcatactgattatactaatctggccatctcctcctcatctttcattgacacactagactgcagtctctctgaagtcagaaattggtcttattgacctgaatctccaattcctagcacaggatttggcacaaagtacatgttcaataattggaataaaagagcctctttcacatataaggaagctgaacctgaaggaataagtgacttcaccagtgtctcatggtaaaactgggatacaacagtttgttgttactccagatgcaatatttctttcattataccttgcctatacacttaacaaataatgtgctttaagttaattcaatgttctttctgaatataaaaattgtgataatggaaatctccctagcagcttagattgtatatttaagagggtaggaactgctcagttgtctttggtttatattaatgttttcaggtgaataggctatattttttcatgattgagggtatagactatgattgaaaagccaattgaacaaattgtgtattattttctatgttgcattgatgaatctcctttgaatattggaaaataagagataaataaaaatgttttttattttctgattttctaagagtttgttctggatattaaaattatagttgaaggccaggcgcggtggcttgtgcctgtaaccccagcagtttgggaggctgaggtgggcagatcccttgaggtcaggagttcaagaccaccctggccaacctggtgaaaccctgtctctactaaaaatacaacaattagccgggcgcggtggtgggcgcctgtcatcccagctactcaggaggctgaggcatgagaatcacttgaacctgggaggcggaggttgcagtgaactgagattgcgccactgcactccaatctggacgacaaagggagactccatctaaaaaaaaaaagttgcagtttagtccttatattcatatatgttgagtattcatattcattcagtgagtttttattcctgcctgctgtaatccataatacttgaacattgttgtgagcagtttacataccttaatccattcgatgctcacaaccctcagttaagtactgtttctcttcccactttacccatgaggaagctgagtcctagatagtaacccgttaaaagtcacataattaataaatggttgagtcaggatttggactccagcagtctgattcaagagcccaaacccttaaccaggatggtaaactgtattagttactttgttttcagaaaggctacagagatgaaaagataggacttctgctctcaaggtaattgatagtgtaatggagagaaaagttatgagaatgagagaagtaatatttgttgagtgactgtgccttgtgagaagctatgctaagcatatcttatgcattctcatttaaacctaattgtcttcaaacttgtatgctttctgctgctttgtgccaccttttttttttctttcttttttttttttttttttttttgggatggagtcttgctttgtagcccaggctgaagtgcagtggcgccatctcggttcactgcaacctccacctcctgggttcacgcagttctcctgcctcagcctgccgagtagctgggattacaggtgcccaccaccacacctggctaatttttgtatttttaatagagacggggtttcaccatgttggccggctggtctcgaactctacctgcctcggcctcccaaagtgctggggttacaggcgtgagccaccgtgcctggcctgtgccaccttttgtgcaaatacaaaatcaaggccatgagtggtggctcatacctgtaatcccagcactttgggaggccgaggtaggtggctcacttgaggtcaggagttcaagaccagcctggccaacacggtgaaaccacaactctactaaaaatacaaaaaaattagccaggcttcgtggcacatgcctgtgatctcagctactggggaggctgaggcaggagaatcacttgaacccaggaggcggaggctgcagtgaacagagattgctccactgcactccagcctgggcaacagagcaatattccatctgaaaaaaaaaaaatacaaaatcacagtcttaggtaagtgctttaaaattgtgtgaggtgcattgggagcataggggaaggagccctaaatctatatgggaaggagaggaaggtttcacatagcaggtagcaattgtattataaaaattgactaagagtttcagacagagaaaatatagcagagaaaatagccacgtcatggaggggtgagagaatgtggtgtgtttaatagttgagtatcaacaataaagtgggaaaagataatagatttaaaaatggttaggtaggattgatcaaatttagagattgtttatgggtgtgaaggtcaaagaggagtccaaggatacttacaggttttggggtttatggtgataccatttactgaggggttagaacaggattttggaggaagtactaagtgcagtttgaggtctgttgtgtttaaagggcttgtgggacattcaagtggtaaactgcacaaggaggcatttgcacataaaaatctgggatttgagattagaaagttatctacttggagatgtagggcttccagataaaatacaggatgccaggttaaatttgactatcaaataaacaatggtgatttttactataagtgtattgcttgcaatacttggaacataattattctaaaatagcactatttcagctatagctaaaaagaaggtttccttttcctgtaagatagcaggacagtttgctgagcaatttgtaggtaaggtggagggggctgagggatgttgagggagttcttagttacttgtttttacctggtgcaattgaaacatcaatgagcaggaaagatgtggagttgggactcgtgagctatgaaggtttagaaaaattactttgtgaggtaaaagaaactggtcagggaaatataacagaaatactagaaaaattttagaaattgagttgataaggcaaagaaatttttattgaatctggccgggcgcggtggctcatgcctataatcccagcactttgggaggccgagacgggcagatcacgaggtcaggagatcgagaccatcctggctaacacggtgaaaccccgtctctactaaaaatacaaaaaaattagccaggcatggtggtgggcgcctgtagtcccagctactccggaggctgaggcaggagaatgtcgtgaacctgggaggcggagcttgtagtgagccgagatcgtccactgcattccagcatgggtgacagagcgagattctgtctccaaaaaaaaaaaaaaaattttattgaatcttaaacactcattttggtaatttgaagatgtatataatatttttaatgtcctcttcattttgcaagtgtcaataaatattgttatttaagtataatgtttaagaacatgcactttggattgaatagacttagattccttcatttagcaagtatttattaaatgccagttatgaaactaataaataagtatgagaactagcattttggccaggtgcagtggctcacgcctgtactcccagcactctgggaggccaaggcgggcagatcacctgaggtcaggagttcgagaccagcctgaccaacatggagaaaccccgtctctactaaaaatacaaaattagccaggcgtggtggcgcatgcctgtaatcccagctactggggaggccgagggaggagaatcgattgaaccctggaggtggaggttgtggtgagctgagatccgccattgcactccagcctgggcaacaagagcgaaactccatctcaaaagaaaaaaaaaaagaactagcattttgtgtacatatcgtgcttgcttttgactaactgtaagatgtcattctgtataccttatttatattaagtcatttgccccctccctccccgttggccctatgggttaggtaatattatctttattttacagataaagaaattgaaactaagaaagattaaatagcttgtttaggagtcaagatcatatctgtttctgtctgctgttagaacctatagtcattactgttatgttgactgtgttgggcgattgggtatacaggggtgagaaaaacaggtattgtccataatggatgtgatctttttagtctaatgtgtgtgtagggggaaggatgaatgttaagcattaatcaaattatccaaataagcaatgaaatgatttactatggtaactgctgtgagagaaaggagatgggagagactactgcaacaggggaacttaatttcagttggaccagagtttgaattcattgtagtaattactttatattttcacatctatgacagtgctatcttgggttttagaacagagagactggctgggtgcggtggctcatgcctgtaatcccagcactttgggaggtggaggtgggtgggtcacctgaggtcaggagttcaagaccagcctgaccaacatggtgaaactctgtctctactaaaaatacaaaaattagctgggcatggtggtgagtgcctgtaatcccagctacccaggaggctgaggatcacttgaacccgggagggagaggttgcagtgagccgagatggcaccattgcactccagcctgggctacagagcgagactccgtctcaaaaagaaaaaaaaaacaaaacagagagactgggtttgattcccatctgtgcacgtagtctctttgtgaccttgggcaagttgctgaacatctcttagcttcactttcctcatctataaagaaggcatatcttatagagagcacctctttgggtgctcataatacatatcatgggaagtggtgaattaatgcaatggttcctagtttttggcatttaatagtctaaagaaatttctaaagtaactttggaactaacatagctactcatttattttgctatgtgtggagagattaaaaatacaactgccatttattaccatcattgattcagaaaagtaagactttttaaaaaacttcctgttttgaaatatgtaagggtattttaacattaaaaaaaaggatggttgcaatttcagaataaagataggcatttacattttaaaaatgtttcatgattacattttgttttaaaacgttttaaagaatgtggtaagaataaataggattttgtctgtgatgattttatgtataatgagcagattgcattgacactcttgtatcttttctgccattaacagaaaaggcagcttgtaaatctaaaatgattgaaatccaaactctaaatcattcagatttaacttttctttttttctttttctttttttttttgaggcagaggctcgctctgttgcccaggctggagtgcagtggcacaatcttggcttactgcagcctcctcctcccgggttcaagtgattctcctgcctcagcctcctgggtagctgggactataggtgtgagccaccacgcccagccagatttaatttcatttattgctcctttttgccgggtgcagtggctcacacctgtaatcccagcactttgggaggccaaagtgggcggatcacctgaggtcaggagttccagaccagcctggctaacatagcaaaaccccttctctactggaaaaaaacacaaaaattcgccgggtgtggtagcgcaagcctgtattcccagctacttgggaggctgaggcaggagaatcgcttgaacctgggtgttggaggttgcagtaagccaagatcacgccattgcactccagcctgggtgacagaatgaaactccagcctgggtgacagaatgagactccatgtcaaaaaaaaaaaaaaattttttttttcatttattacccccttttaaacacactacctaaaaaataggtagtgctcagcatttggaatagctatgtattactcccatatatcaaaatttcatttgaaaagtagataaaagtattttaaaagattctctaattctgaaagattgtctttgtaaagattagtgtaataacttgtaaattttgacttttgaggtgcttgtgaaggtatttatgattagactgtttaagagatgaatagggccgggtgtggtggctcacgcctgtaatcccagcactttgggaggctgaggtgggtagatcacaaggtcaggagttcgagaccagcctggccaatgtggtgaaaccctgtctctactaaaaatacaaaaaatagttgggtgtggtagcacatacctgtagtcccagctactcgggtggctgaggcagaagaatcgcttgaacctgggaggcagaggttgcaacgagctgagatcgcgccactgcacttcagcctgggcacccaagtgagactccatctcaaaaaaaaaaaaaaaaaaaaaaggagatgaataggatagaataatttttttttgcttgaatttctagtttacttacatacattgtattcattgctcttttctcttttctttttttttttaaaggagtatggatgtgtccaacagccaaaaactcaagaaagtaaattgaaaattggtggtgtgtcttcagttaatgagagacctattggtaagaaatggaactgtataagttagttacaattaatttgcttattctgacttttaaaattgagggaaagcatcttttcatgtatgtctttctctttctttagagctgtgttttttcaaactgtgagtagctggttttcagcagcgttttaaaaaatagagtaagattatatcagaatatgatatgtgtagtaaggaaacatattgtttcataaaacttctgtttcagtgattaaattgtacatacatccccacgtttacaaacatatgtatgtgagaactgggttataatattaaatgtatttcttgcgttgagtaatggttaaaaaaaaattgaaacctctgttttagagctcttattgcctcattaactggatttcaagattgggaatttgtcctgaaaaagagagactgggctgggtttagtggctaacacctgtaatctcagcaacttgggaggctgaggcaggaggatcgcttgagctcaggtgtttgagaccagtctgggcaacataccttatctttgctaaaaattaaaaaaaaattagctgggtgtggtggcatgtgcctgtagtcctagctactcaagaggctgaggcgggaggactggttaatcctgggagtttgaggcttcagtgagccttgattgcaccactgcactccagcctgggtgacagtgagaccgtgtctcagaaaaagaaaaaagagagagagagagagagactgagactgtatatgcattagtattgatactaaaactttttttattttgttttgatagcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaagtataaaattcttaacatccctttttactttaccttttttttagtgtgtatattgtttagttcaaacatactgttgatactttaaatctcttcagcatgtatctgtagaaataactttttagttaatggaagaattcaccaattttaaagttttgcaacattaaataagtgacttggtgttagaatattgcctaaaccagttttctatcactttaaattttactatggaaagaaataacaaatgacatgtgggaattgcaggactatcctgtaattgtagacacccaccatttaaatttatttaacagttatcttgaaagctattgggtatagcataaaataatatcactcttttaatagtatacaaaagctatttaattctttaaaaagtaaaaactctacatggtcgcaaaaatgtgtttatttctaatgtccttgtggggtcattgttgctttacaataatgcttagatgcagagagaggaaaaaacagcaacaaagtcacataaatctttccctgacttagtacatttgaaggatttggcatattttgcctatttctgtggtagtgtaatttgaggaatacagtgtgttgttaatagtcactacaggcaaaaaacagtaagagcttgcttttaaattgtggctctgtcatttatctctgtgacttcgggctagatgtttaactttctaagcctccatttctcatcagtaaataatagttgcttcctaggactttaatgagacagtgttagcaaatggcctagcacatagcaagtacttaaaaaatggaatcctgttattattaataataaaaattatatcgtgcgattatttataattaacataaataaatataataaatatatgtgtatataatacatattactatgtatacttaacatatcacttgtaggcccctattttgtctttggctgtgtttatctgctttgtgtcttgacttaaactatttaaaagtagatcctgctatatggaaatttccaagtaaagaggagagaggatttttttttttctttgttgcccatggtagagtgatcacagctcactgcagccttgaactccccgggctcagatgatcctcccacctcagcctttcaaatagctgggaccacaggcgcataccaccatgcccgactaatttttgtatttttttgtagagatggttttgctatgttgcccaggctggtctcaaactcctgggctcaagcaattagcctgcctcagcctcctaaagtgctgggactattggtgtgagccatcacatgtggccaggagagaggaattttaaaatatttatatactctaaattagtttgttgcaaaataccattctaattaatgcttttatgtcattctcatgaaactaatctgaaagagtaaacttagttttctatttttagatattgtttcaacataccaaataccaaaataaaattaaataattttaaagaacataacacaacttatacatccaaatgcctattgttttcttaaaagtagtcacccccgtcagtgactttttagcataaggttaggagacagattcttatcttttcagcatgcatttgatttttacaaattttcaaaggctgcttgataccttaatcaggccaatatattagctaattaaattaagtcatactgttaaaacatgatatttataaaattaaaagttaaaaaatagtctaagggtttatcttaagttttatcttaaaaaaattagaaaaatgttttgagctatgttattgttggaaggtgtggtttttctacggtaaatgttacgatataacactcatttgcatgtgtaaggttcagagtacacttataatttatgtgcacagattttcattataaagtcattctctttgatttacatatttttacttgctatttttgtacttattatgccactggcagattcaccttattaagtgaaactctttattgctctgttttcagtagaaaaatcacttttcaaaattaatacttcatctgtgtataagcatattcttttggtttctaagatttgctgtcatatttttaaagttgagttttaaagaattaaaataatttttgttgttgttattttctcatggtttaccattgaatatacctgtataataaaggtgcaggatgggaggcaggatagtggaataattaattccatagactagaatcagattgcctggattagtatttcagctttattgcctactagcaatatgactttgacaagctatttaacctctcattcagtttcctcatctgtaaagtggcagttacagtaatacttaaccttatagtggtttggggatttttttttttttttgagacacggtctcactctgtcacccaggctggagtgcagtggcgtgatcccagctcactgcagcctctacctcccgggctcaagcaatcctcccacctcagcatcctgagtaactgagaccatgggcatgagccagcatgccctgctaattaaaaaattttttttatagagatcgggtcttgctctgttgcccaggctggagtgcagtggcatgatcatggctcactggagtcttgaactccctgggctcaagcaatccttctgccttggccttccaaagtgctaggattatgggggtgagccactgcactccatcatttttgtggtatttaaattgggtaatttgagtaaagagaataatgcttggcacatagtaattactcaacacacttattgtagtatatattattgccattattatttactttgtggcctgcactagtgtttataattagtgactatttcctttagtttttatacttgtcagaagaatggcaatacttaacctctgttttaccagggtattgctatttgtgcttattgcaataattagctcttacaaattggctctaggagtctcacagaaccacccaattatttttgttcttcctgtctcgttcttgtttccatctgtcctctgatacaaagccttaacagcccttttgtcatatatcatgcttattttttgtcttctgttagctcatttgtttctcaaaatcttgcacttttaatttttaaacattcatttattgtcttggctggacacggtggcttatgcctgtaatcccaacactttgggaggctgacgcaggcggatcgcgaggtcaggaatttgagaccagcgtggccaatatggcgaaaccccgtctgtactaaaaatacaaaaattagcctggcatggtggcacgtgctggtgtcccagctactcgaaccggaggctgagacaggaggatcgcttgaacccaggaggtggagattgcagtgagccgagatcgtgacactgcactccagcctgggcagcagagcgagactccgtctcacaaaaaaaaaaaaaaaaaagaaagaaaaaattcatttattgtctcatttcagttctactttgggcagcctctggctaatgagagaaccagtgtcttgtggtctggagttgtgggatggacactggtcccattggctatagcagatgaaacttggttggggctggaagccttcctatttttgtcttcagcatctggctggccacatatatatatatatatatttttttttttttttttttttgagatggagtctagctctgttgccaaggctggggtgcagtggcacaatctcggctcactgcaacctccacctcccgggttcaagtgattctcctgcctcagcctcccgagtagctgggattacaggcgcccaccaccacgcccatctagtttttgtatttttagtagagacgaggtttcaccatgttggccaggctggtctcgaactcctgacctcatgatccgcccacctcggcctcccaaagtgatgggattacatgcatgaaccaccgcacctggccctggctggctatattttaaatataattcactcttgacaaatttatgaattagatattataagccccattttatacatgaagaaattgagatagtaattacatcattcattgtcactcacctgataaatagcagaactcatcaaacccaggtttgcagattccttatcctttttctaccatacagtacctgcccttagtaagtgttatttcacctcacaaagaggaggaagttacagttgtgaagaatacatttcatttttacctttgttatttatttttagagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatgtaagttacattttacttttattgggattctgctgaaagagatttttttttaactggctctgcttattttgtgtgtgtatgtgtgtgtttatttcctagactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcaggtatgaatatctatttgttgcatgtacttaggcccactccttctgatttggctgcacagggatgaactacaaaatgagagtgagctcctcccattagtccatcctgatatgtgatttcccttccagaaaatgggatagattctgatggtgtgagggatgattgtggtggtaagttgatataggtaaaataggtcccttttttaaggctcccttcatagctaagaatttacaaatgtgatttcttttctttttttgaaatcgagatagggttttgccatgttgctcaggccggtgttgaactcctgagctcaagccatccactcgcctcagcctcccaaagtgccgggattacaggcatgagcaaccacacctcggcctcataaatgtaatttcatgattttctgtgagcatgaaatattttgtgatgtattgatagcaagaaaaccatattataaataaaccataagcaagagttaagatgataaaatcagtgaatctaaacaaagcttgtctttttcatttcaaaatgtgtttgggaatgaattgtaattatttggtcaacactgtctcatgagaatacttcaagtaattttatttattgtaatgaataatggattaagccggttactaaatattatcaccttgtgtcaatttaattattactaatttgtggttttaaaaagtttttcttaaagaagtatcttgtaaggccggcgcggtggctcacgcctgtaatcccagcactttgggaggtcaaggcgggtggatcacgaggtcaggggttcgagaccagcctgaccaacatggtgaaaccctgtctgtactgaaaatacaaaaattagctgggcgtggtggcgggcgcctgtaatcccagctactcaggaggctgaggcaggagaattgcttgaacccgggaggtggaggttgcagtgagctgagattgtgccactgcagtccagcctgggtgacagagcaagactgtctcaaaaacaaacaaacaaacaaaaaaaaaaaacaaagatgtatcttgtaaatgataattaaactttttttcagttagcaagtttgatttgttgcttcctttgagcagttggtaatggacatatggacattcatcactgaaaagaatctctttttttaagatttgccatttttggcagtctggttctactttcacaggaaaagaatccatgttattttatatatgatcccaaaatcagttccatttctaattttgttactagtattgtactctgtctttttactaggaagattatgtagtgaaacctcacaatttatattttcctacaatttcttttcatattgagagaccttataatgtatcactgacagcatagtgtagtggttaggagcctgaactttggagcctgatgaaatgagtttaatttcctacttcttctgctcatctgttaatttaaactttttgttaatgtaatttttgagagcgcctcactctgttgttgaaaggtttctgtgatacactatatataaatttcttagcctggggcctgactcatggtaagcattcagtaagttataatattggttatgtaaatggtagctatttttattatttcttaaaacatgaataaacttataagcagattttattatgaaactcagcttgaaaaataggtagttgtgtaggatctctattaatatacattaaatatcatttctatctcctgctaaagaatctcacaaattaagtaaccttaaaggtggtagactcttctagattgatgtacaagactataccaagaatgaccctttggttcatgggttagctggtcttctctggttattggtgattaaaaagtatgtaatgactatttaattcattacttgtgtttgaattcatgtgttttgtttgctaagatctctatctgaatagttactaattttcttcagtttctattttattgttgtctggaagaacttattttcccacctcccaatagtgtggtttcatcatcatgctcaaatatttcaaccaaggaccgtggttgtaggtagcttttctttttacttttttgaacaatatgtaaatatgtatgtttgtactaggtatctaatgttattttattttaatagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtaatgtttaaatttgataaatttatagatttaataactattgaagaaaaacgtaactgcttttctctgattttgttacaagctaaatttatctatttagttaaataaaaacccaagactgacttttaaataactgacttttatgtgaaaatagtttttccccgattttcttggttgcaatatatacagtattttataatttcatatgtgagaggaaagaaaaaacacttaaaatttccaagttagtttttgtgtaagtgggacttaatagaggttagttgtggttagatttcagatttttataaagttccttgatttttttggtatattattgattatttaattttttcattctcccaatacatttttgtattgtttgttcattggtataacttaatcattgtttttaattttttgtcaccaaggtgtccaggtttcatgtcatagttgtaaaacctcagcaatccctcagtatcacctagccatgtcaaatggaactatatacagcttctgcagctccagttgtgtggttgctttccaggtatgatctaaggtagcacattatgcatgtggttctgttaggcatcgatctgtggcacagtgttaactgctgaaggcctgttcttatgaaagtttaaatttgaattaaaaagaaaaaaatttgtttcatccaggggcccaaccaggtcatttctacaaaatatctgaacccagatattgggtctcagcagtttcttctttatttaggatcctagcctaaactgtcattccctcccactttctcccttgggtctctccccttcaaaaagatggaagctaggattgtggtttgggtaggtggtatggtgaagaacagtagcctgatgggattcacataccccttcctctcatcctgtgtcagaaacacagtgactcctggcatggaattgtaagcatccacttgtcccattttctcctccctctctgcaatacatacacaaagagtagagtttagtaatctccagggtaggaacatgcctgatgtagtatccctggcattagggagaaagagactgctggtagctattgtgtcgtagtagccatcagaagctggttgatgatgggagtgcaggtagggggaagttttagggggaaggagaggcctgctctaatttattagaggcatatactggaggtctttgtcaggaaagcctgaattccagtccttgaccttttaatgttgtatttctcagtccttttattctggaaatataccatttaaactctttctgtgagatagaaaattttaaaaaatgtttgtgggagacttgatttattaaaatgaggaaatgaaaagtacaaagttatcttatttctcagttgataaaatctttaccttatttgttttcattcagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaaggtaaagagagatcatgaaagggattgtatataaactcatccagtagaaacacttttgtgttttcaattttgatcactcaatttgctttgacatgaaaaggagttcttaaagataaagcaactgtttagttggctcttaatggactgttgtttctctgcagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaaggtaaagacaaagttgttttattcacagagcatgggttgttataattcatgacgacttgggcaattaagccatgattagttttcacattctttttgtcttacaaggtgtaattagaagtattttggaggccgggcatggaggctcacgcctgtaatcccagcattttgggaggctgaggtgggtggatcacttgaggttgggagttcaagaccagcctgaccaacatggtgaaaccccatctctgttaaaaaacaccgtctctatacaaaattagccgggcatggtgccgcacgcctgtaatcccagctacttgggagcctgaggcaggagaattgcatgaacctcagaggcagaggttgcagtgagctgagatcatgccattgcactgcagcctgggcgacgagcgaaactcttgtctccaaaaaaaaaaaggtttttttgaattgtgtttatagttaattcactttaaagtcaatctttttatttattatttttgtttgtttatttttttgagacaaggtcttgccctgtcactcaggctggagtgtggtggcatgatcttggcttattgcagtctctgcctccccggtttaagggatcctcccacttcagcctcccaagtagctgaagctacaggagcgtgccaccatgcctggctaattttttttatttttggtagagacggggggtttcaccatgtttcccaggctggtcttgaactcctgagctcaggtggtactcctgcctcggcctcccaaagtgctgggattataggcgtgagcgactgtgcctggctgaaagtcagtctttttaaatgttgcagtaattgcaataaaaaactgtaaaaatgattacatcagtggtattaataaagaaaatctcttcataagtttagctatgacatcagagatctttttgttcttgcactcatttgcgaagaggaacttaaaacagttgctgcttcttggcttaaaaaacttttatacctctaatgtttctgaatataaatggcctaatatttagagtatatttaaaaggtggtggcagggcgcagtggctcacgcctgtattcccagcactttgggaggccaaggcgagccagatcacctgaggtcaggagtttgagaccagcctggccaacatggcgaaatgccatctctactaaaaatacaaaaattagctgggtgtggtggcaggtacctgtaatcccagctgctctactcaggaggctgaggcaggagaatcgtttgaacctgggaggcagaggttgcagtgagctgagattgtgccactgcactccagcctgggcaaaacgagtgagactctgtctcaaaaaataaaataaaataaaaggtggtatgagtttggtttgtgaatatagagactgtcctgtaatctagaggcaaataattgtgtattagaaattagcttaaagtttcatatctaagaccacagaaacttattatacctcctcagttaatgtaaatttgatttttcttcctttcatccctctgatcctcagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcaggtaaatgtgataatatactttttttggctttctgaaatcagtgcaaattgtttttatttaaaatgtattcaaattatgtgaagaaaaatttggtgtttagcactggataaaataagttatgggctataatagaaaaattcaattgaatataaacaggaaatctttgggataaaaagtataggatttctgcagactttgttgttggttggatatgttccttttatttttgccttcttatgaggcactttgcccttatttgacttctttcaggttagaacttcacataatgttgcctgaagtggctctctcattcaggttactctgaggaatttgaagttagaccttgtctcacttcataggtcaaaggacaatagctggcaaccattcctacctcatttttaaaaagattaactttttgaaaggctaacaatggtagctacagttaattgaaccactaatacatgtctggtgctctgtaagtgtcatttcatttaatccttaccatagtcccaagaggtaagtatattactgccattttataaataaggaaaaggagagaggtccagggaagttaagtaatatgctcttgaggaagctggtaggtgacagcaagacagcatctataacactctggtaaatcactgtttgtttttctacctctaaaaaaatagaattttattgttgggggagggtaatatatttttcatgattatataattagggccaatcacagtgcttaagacaaaggatgtctaattaaatatttgctgaatgaatcaaaatctttatgactccaaagcccatattatatcaactactgtaagctgctgcttaattttttagaagttgaacctatctttattttttttttacttacttttttcattgtgtatcttttcttcccccatcccacctgcccaccccccatcccccagccagacagaatcttgttctattgctcaggctggtgtgcagtggcgtgatcagtgggcgatgttggctccctgtagcctctgcctcctgggttcaagtgattctcctgcctcagcctcccgagtaaccaggagaggtgggcaccaccatgcccagttatgaacctatctttagatagattcccttattggtaattttgaaaacagaagagcatttttttttttttctattgagacagagtcttactctgtcacccaggctggagtgcagtgacgcgatctcggctcactgcaacctctgcctcctggattcaagcgattatcttacctcagccttctaagtagctgggattacaggcgtgcgccaccacacctggctaatttttgtactttagtagatacggggtttcaccatgttggtcaggctggtcttgaactcctgacctcatgatccgcccacctcggcctcctaaaatgctgggattacaggcgtgatcccacaattaccgtgcctggccacagtttttatattatcttgatttagggcatctatataaaacaaataattaaataaaatcagtattttaaggtaagaaccttacattttgtagtctcaactgactcatatatcctgttttcgtagtccctctttttatgattaatgttatcttttcattattttatagttttaagcctatcttgtctaacatttctttttcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaaggtaaaattaaacttagctaatgggatttttatgtcagtgctaggacactatcagcatatacagttataaataatataataaaaacaaaatttcattggattcaaatagcctgaatttccttaaatttttctttaagaagtctttaagatttccccttgagggaaaagtaattctaatactttttgctctgatagtcaagcacaccaaaaggccaataatgtatatgcactaatttttataggaaacttagatttgattgctttttgattgaatgtatctgtacataaataacttaaactagggatatatactatttagttaataaaccagaaataaaaacagaaaatcagggcaaacaaagggagagtatagttaatatagttgctgtgactagtgtaaaatttgtttcagagcttgcttataggcaaggagaaaagaacaacacgttaattatctcagaaaatataaaatggaacagttcttcatgggtagcaaagtttatcctagctaagaataaaataattttgcaagtaggacagctaatatggtcagaatatccaggtgagtagatagatccatgatatattcataaagtagctctcctaagtatttctttctaagtattagattaaaaacatttggtagccaggtgcagtagctcgcacctgtaatcccagcactttggaaggctgagatgggcaaattacttgaggccaggagttcgagaccagactggtaaacatggtgaaaccccatctctactaaaaatacaaaaattagccaagtgtggtggtgtgtgcctgtaagctcagctgctcaggaggctgaggcacgagaattactggaacccaagagatggaggttacagtgagccgagatcatgccatggcactccagcctgggctacagaacgatattctctctctcagaaaaaaaagccacttgctattatgttctctgttcaaagcctggagtgctacctgattgacagagctttggctctttgcagtctggccattgcctacctctgcagtcttattaatgattaccttaattataaatgccttgtgctaatctttcgtgttagccctccattccccagaaccagtcaggctggtagtagaatattcattttataatatgggttaagaaaactagtgttatggggttggacagctccctcattaacttatttataaaaattgtcatgttaagtttttatctgatgcatgcttaggtctaggagttttaatagtcactaatagaacagtccagtgaatcctgaagctaatacctgtcttttttttttttttttttttttgagactaggttttgctatgttgcccaggttggtcttgaactcctgggcttaagtgatccccctgtttcagcctcccaagtagctgggattacaggctggtgccactgtatccaatacctgtatttttacctgttaaatgtcatttgaggtttatgactttatagaattggactctctttaagtcctaaagaacactaatctgaccagagtcacccaacctaacatgatacagaatcagatatttatattgcttcttgaaaacctagttactaaacagggttttgtgtgtgagtgtgagtgtgtatgagagagagacccttttgcttattccagatcttaactttttattttaatcagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtatgacttgatataatggcatttggctaagccatagaagtgagtgttgtctagcctaagtagttctctctttttgagacagtttcactcttgttgcccaggctggagtgcaatggcgtgatctcaactcactgcaaccaccgcctcctgggttcaagcaattctcctgcctcagcctcccgagtagctgggattacaggtgcctgccaccacgcccagctaattttgatatttttagtagagacgggatttcaccgtgttggctagggtgatctcaaactcctgacctcaggtgagccacctgcctcggcctcccaaatagctgggattacaggtgtgagccaccgtgcctggccagtagttcttactggtaatatctttctttacgtgatgtaggggaacatgcaccccctcccaccgcctccccacccccgcctcaggggagtgggtagcaagcaaggtggtgtggatgggaaaggaagtgtttttatttttgttttttcaatttttaatttttttttttgagacggagtcttactgtgtcacccaggctggagtgcagtggcgcaatctgggctcactgcaacctccgcctcccgagttcaagcgattcttctgtctcagcctcttgaatagttgggtttacaagtgcctgccactacacccagctaattttatatttttggtagagatgcggtttcaccatgttggccaggctggtctagagctcctggcctcccgccttggcctcccaaagtgctgggattacaggccaccacactgggctaatttgtttgttttctttttaatcaggcaggctcttgagccatagaaggctcagaggtactccctgggaagtgatatttttttaggagcccacatgattttaatatacctactcctttactgccagagattctaatacagttggatgggattggggccctggaatccttaccgttattaagcaccctgggtgatactgatgcagtttccttgtaccatttttctgagaaactctggtttagactctagcccagcttaatgggaggaaagtaacttcttgatttcagtgtttacttctgtatattctaaggataataatatttgttttaatttacaacaggtgcagttactaaagaggcagcaaagatcattcaagatgtgagtttaattgttaatacttttcttgataatgccacttgggcttattttcactttggatatggcattctaatatatctgaatacttttctttttgctggaagagggtcctagtcattaatctaggtcttgggcacaactaacagtaaagtgactggcataggcttttgaccatatttcggcagcaattactgtttttgaagatgatgtaaatgtggattgctgttcatagtggcaagcttagtctttaaaaaagtggagtaatagatggtgtgcttttgttttgaatcttacagtttaatcttagatcattagtaagaatgcattcttgatttattttattatttgtattcaggttctttaatttatttaaattcttgttaattccacctggttggaaataacaaaactacattatttttctcttttactatattcaagtattttcctttaagttttgaaagttcagtgtagtcctgttttatgcaactttgaattatgtgagactgaaaatagtgcaaagtaaaaatatatttagactttcactttatgtctcaaatttgaaatattgtgagacttctcaaaattaaaagaaacgttcaagaaatgcatactttcaagtctggccggctgattgcaaattatggcattgttgccctgtatcagcatcactttagcaggaaaacaaaattcccatcatcctttattagtatcacatgatactgtatcaggtcttgggttaatgtttttgatgactgttatgctttttttttttttttttttttttgagacagggtcttgctctgttgcccaggctggagtgcggtggcatgatcatagctcactcaacctcgaaattctgggctcaagcagtcccctacctcagcttcctgaggagctaggaccacaggtgtctgccaccacacacagcttattttgttttttttcttttgttgagatagggtctcagtcttgctatgttgcccaggctagtctcaaactcctagcctcaagtgatcctcccgcctcaacctcccaagctgttgtgattacaggcatgagccgatggtgcccagcttgtgctgctgtcctaacatttgctcttgatataattaaaactctttttttatatcgtagaataatgccatttaagtgttatattaagtggtggtgctagtgctaaaaaaatgtgccccaaatttaataactttagaacaaaagttagatgtgataaaaaatctatgaagatgaccaaaccactgctgtgatatctcatgctattaatttaggagagtgtacccagcagaatattagcagtagtgctcaaaaaactgaaagcagtattaaagcaggtatgcctcttagttcacaaaaattataaccaggcaatgataatggaataaatggaaaaaaattctggtaacacaagttgcaagatcagtgctgccataatgcacccctgagggcaatctatcatctatgctaaggcatcagtattttcattttgatttgaaaagaggtgacagtgagacaaaaggtttactacaagttatggctggttctccaattttaaagcccaccaaggttttaggaatataaaaatgcactggcaagctgtatctgctaactccaaagctatgaaaacatttcagctttaccataatttaaagaggctttaacttggaagacaacataacacctgctaataaggaatctgtgtaagtagaacagaaggtagatttgcacagagttcctgaagaggatattgaatatttgcttgggttgtcccccatggattaataaaggaagtcttgctagaattagaagaacaaaagcaactggaagagggtcctagcagtcaatccgggccttgggcacaactaacagtaaagtgactgccataggcttttgaccatattttagcagcaattactatttttgaaggtgatctaaatgtggattgctgttcgtggtggcaagtctaaagatgaaaaatgtgtctgcataccaagaaatcctcagtgataaaaaaaagaaagaaaaaactctcaaaccacattagagtcattctttagcaaaagtcttccaaggaatcagaccagccttcactgtaatgtggagaggtagcttatcctaatttagtgtctcgtaactctctcattatttgtgttattggaagatgatagtaatttctccttaattattttcaagcagtataccacattagataattaactgtcattaagttaacttggtatttatttgaatattatgtattttgcattaaattatattttaaaattacataataaatcactgtgttgtacattattaaccacacaattgtataatcaaggtattaatgtattatatattagtaagtattaacatgtattcataaaaacattctatattagttgtagatttatgtactctgagaatgcttctttcctctgtatatatgagataattagtcttgaattatgttagttttgaattatttagttttttaggaacatatacctcatatttcatgtagctgccctatatatgttttccctatgtggagtatttctataattcaccagtcatttaaactatgttacagaatagttttgattaatatttttactttagtctataaaaagtataataaataatgtagtgctcttacaatgtgaaaaaaaaaaaaaaaaacacctgacagttttagaatcttttcttggtttctctgagaactttgttgtgaatctccctcaagttacttaaatgattttaaatttttgggaaaggtgaaaaatacagaaaattacaaagaggaaaatctgtaaaactcagcaaactttttctataaaagtctagatagtaaatattttaaactttgcaggctctatggttgcaattgtagactctgtcacctctgccattgtagtgaaaagctgccataaataatacatgaaagagtgagtgtggctgtgttccagtaaaattttatttacaaaaacagatggtgggctggacgtggtgcacaggccatagtttggcaacccctgctctatgatattcccactatccagaattaaccattgttagatttggtttatttgctcagtttctttcccctacctttttcttcttttttaaaaaattaaccactactaccagttagtctcccttttacatccctggaagcaactgctattatgagtttagcatgtgttcttttagacaatctttaatatttaatattaaatggaaaatatttaatattgttttaaaaaatacctatccatgttgatactgagtaggtttggtacattcctgttgattatagtaatgttttgcctgtaggtaccacattttatttatccattgtcctattgatgaacattagatcgtttccaggtttttgctattaaaaatctttgcagttaggcgcggtggctcacgtctgtaatcccagcactttgggaggccaaggtaggtagatctcttgagctcaggggtttgagaccagcctagacaacatggcaaaaccccatctctactgaaaatacaaaaaattagctaggtggtggcaagtgcctctagtcccagctacttgggaggctgagatgggagaatcacctgaatccaggagttcaaggctgtagtaagccttgattgcaccactgcactccagcttgggtgacagagaccctgtctcaaaaacaaaaaaaaagaaaaaaaaaatctctggggcgaagtgtggtggctcacgcctgtaatcccagcactttgggacgccaaggatcacttgagtccaggagtttgagaccagcctgggcaacatgatgaaacctcatctctataaaaaaataccaaaaaattagctgggtatggtggtgcacgcctatagtctcagctacttgggaggctgaggtgggagggttgcttgagcctagaaggtaggtcaaggccgcggtgagctgagatcacaccattgcactacaacctgggtgacagagtgagaccctgtctctaaataaataaataaataaaaatatccgctacagtgaatatccttgtatatgtctcctgtgtgtgtagatgtgtagaaatgggagagtagaattgttaggtcaaagagcattttcatttttagggctgttccaacttttatccctaccaacagttatgactgtacccatatattacagcctcaccatcatttagtgttgtcaaatttaaactttttttgctaatctgtttggtggtatcttattgttatcttattttatgtgttactgattaccagtaggtttgcttatatttctgttttttggtcatttgaattttctttgaatttcctgtttttaatttttccctatttttgtgttgaattatctttttcttaatgatttttaggtggtctctctgtaatctggattttcccccttttcaactcattattttcatcaacacaaaaatatgcagtcctacatcttatctgagaataatccttttttaacaccatggccctccagcaactatcccttttctctgctctctttatggaaaaactcctctaaaggtagcctgttcttgccacctctgtctccttatctgtaatctctccttaggtcattccagtcaggcttttgtctgcaccactgcattgaaactgttcttgtcaatattgctatcagtctttatattgccaaatctggtagtcaatttactgtatttaacacagtcactctttcctcctttcttgaaatactttcttcattcaacttccaggacatcatacttggcccttttctcagtctacattacttttagtgaattcatgcagtcctgtggttttatttatttactgattgagacagggtcttgagtgcagtggcatgatctcagctcactgcaacctccaccttctgggattgagagaccctcccacctcagccttctggtagttgggaccacagcggcatgccactatgtctggctaactttgtacatttttagtagagatgaggtctcgctatgttgcccaggctggtctcaaacttctggactcaagccatcctcccgcctcagcctcccaaaatgctaggatacaggtgtgagccatttctcttggcccactcctgtggttttaaataccacctagatggtgattgattccttctagatttatttagatttatttctcttaccctgacctttgagctccagattcctgtatccagctgccgacttgacatttacacttatatgattaacagccatctcaaataatatatctaaaacagaacccttttatccctccagacttctcttcagtgatccctacttcttaccacctccattaccgcctccttagtctgagcatcatcattcttttggattattgcagtgacctatctgtcttcctgcttccatttttgtcctttgcagttttttctctacactgttaccagaatgatcttttaaaaacccaaatcagatcatgtcattcctccgctcaaaaaccttcaatgacattctgaaaagaataaaggaggcaaagagcaagtttccacatattgaaattataggaaaactacagatataaagctacgtagttaaaacaattggtactggtgcacgaatagacagacaacccagtagaagagaaatccagaaataggtccaaacatatatatatatttttgagacggagtcttgcccagactggagtgcagtggtacaatctcagctcatttcaacctccgcctcctgggttcaagcagttctctgcctcagcctcctgagtagctgggattacaggcgcgtgccaccacgcctggctaatttttgtatttttagtagagacagggtttcaccatcttggccaggttggtcttgaactcctgaccttgtgatccgcctgcctcggtgtcccaaagtgctgggattacaggcatgagccacagcacctggcccaaacatatatttaaaatgtgggaatttagtaatgatagaggtggcatttcagatcagtaggaaaaatatggattatttaataaataatgctgtgacaactgagtagacatatggaagaaaatatagatttgcacctcacaatttagaccaaaataaagttcagatggagaaagacttaagaaattgtaagtatgtactcagaaaaatataggaaaaaattttaacggtgtagaggtctttctaaatatgtcacaaaacccggaagccataaaagaatcaatggggaaattcaaccatatttcaaaatcaaaagacaaatgacaaaatgaaaaggttacatacaactcatgttacaaaaatctagtgttttttaatatgtaaagagcttctatgggccaggtgcggtggctcatgcctgtaatcccaacactttgggaggccgaggtgggcaaatctcttaagggcaggagttcaagaccagcctggccaacatggtgaaaccctctctctactaaaaatacaaaaattagctgaatgtgttggcacatgcctgtaatcccagctactcaggtggctaaggcacgaggaattgcttgatcccgggaggcggaggttgcagtgagccgagatcacgccactgcactccagtctgggtgacagagtgagactgtctcaaaaaacaaaacaaaaacaaaaaatccccaaggagcttctatgaatcattttaaatgccagtaggaaaatgggcaaaagtaacatatgcaaagatatttaacttcaaaatgagagaaatgctggttagaactatggcttaattagattggcaaagaaaaacgatggataacactgctaaggtattcttattgccagtaggagtgtaaattgataaaagtgctgcagagggcaatttagtagaacctgttaaaattttaacttccatttacccaggaactccatttttaggaatttatcttccagatacattttgtacatttatgaaatgaagcatgtacaaggattttaatcatagcattgtttatagtagcagaagcttgaaaacaacctaatttaaatttcaccagtggtcagggccatggtgcattcactctgagttattgtgtgaattagaaaaaaatagctctacatgggcagggtctgaaatgtaccctttttgaatttcacacctatttatgtggcctggcaagtagagttgctgtgcaggcatacacagtggccttgttcaggctgtagttaaaactgaacaaggtatatatccataacaatggaatattacacagttgttaaaaaagaatgtggcagctcagtatatacagacatagagcagtctcaaatatcataagtgaaaaaagacacaaaattgtgtaacatggtgccatttgtgctacacacacacacacatacacacacacacttgtatatatgtatagactatccctggaagacaactaataaatgggtaatagtggttgcctctaaggataattgaatgactaggggagaattttaaaagggaaaattattttttcattgtgtattacgtgaatctttgaattttttggcacatctgttaaagaaacattcatagaatttttttttcaaaagataaaggaaagtggtaatgaatatgaatagagagttcacagaagagggactacaaataatgcttacatgtgaaaaatatctaactacactaaagtaaaataatttttcactcattgagaaataacaaaatggtaatactctattgactaggatactgggaaaggcccacatctattgataatggtcacataatttgatataatgtctatcagtaccatcagaattaaaattatatatttgggacccaccaacaacacttctaagactttattctgtagataaactagcacatgtagaattaatttatgtctaaatatactcatcatagcattgtttataatagtaaaatatttataacatcctagatatgttcatcagggattcttcagattacttatggtacatttaataatggaatactatacaagctgttattaggcagctttatacaatgttatgtaaatggacctccaagatagtttgctaagtgacaagagcaaggttctgaatcttggtaataataggctacactttgtagtcagaagcaactttgtttaattacatacaccatctctagaaggatatatagtagtgccacttatctgtggcttgaaaatattaaatggaaaattccggaaataaacaattcgtaagttttaaattgtgtgccattctgagtagcacgatgaaatctcatgccattctgcctgggatgtaaatcatctctgtctagcatatccacactgtgtgtactacccatcactagtcagtagccatctcagttatcaggtcacaagaagaaggatgagtacagcacattaagatattttgagagagagtaccttcacataatttttattatagtatattgttataattgttctatttagtagttactgttaacctcttatgcctaatttataaataaaactttatcataggtatatatgtatagaaaaaacattgtgtgtgtgtgtgtatatatatatagaaccctatatacatagaggcaacatatatacatatacaacgtatatacatatattgtatatgtgtatacaatcctgtagacatatttcaggcaacacagtggttgcctgaaaccatgaatcataccaaaccctatatacatatatacatatgtatatatatagagagagagcacttagcacttaccactacctggaattatatatatatatacacacatacatatgtgtgtgtgtatgtgtgtgtgtgtatatatgtatatgtatacatatatacttacgtatatacatacatatatacgtatgtaagtatatatattacatatatatacgtatgtaagtatatatattacatatatatacgtatgtaagtatatatgtatacatatatacatatagatatgtatatatccatattatgatatattatggatatatgtatacatatatatatatatgtctatatatacacacatatatacatgtgtgtataggcttcggtatgatccatggtttcaggcaaccactgggggtcttggaacatattcccggcagataagggggaacaactgtataagaaactgggaacagtggttgtgttcaaggttgagtctgggtggacggcagtcattcatgtgtatattactttaattgcaaaaaccacaattatttttgtaccaacgcaatacttctgtacattttgaattttgcactgagttcatgtattacttttgtttaaattaaatttaaatataacctccaatggcttcccatcacatttaaaatacaatcctaattttgtttttgactgagaccttccagatcctatacaatttagtttctgcctacctctccaaatgtatcattctccccttgcttactgtctttcagccttgttcttgttgatgttcctaaagcatgccaagctttctcccacttcagggtttttgcacctatagtctgcctgcctggactcttcagaccttagacctttgcatggcttactcttttgaataattcaaaaggtctctgctcagatgtttacttcagaattgcccctcctccatgccatcactctccattcctgtacgctgctttattttcttcatcgcacttatcactacctagaattatatattatttgttttacttgtttattttttgtgtcttcctctagaatgtaaggctcatatgagcagaactttgtcttgttttctgcggtatctccacggcttagaacagtgcctggcttgtagtaaacattcaggaaataaatattgagtgaatacacatgttttaagtacattcctccactctgttgtttgccctataactttgttttataaagacctttgtttacagaagttttttttttttttggattaaaaaactttactttttggccgggcacggtggcttacgcctgtagtcccagcactttgggaggccaaggtgggtggatcacgaggtcaggagattgagaccatcctggctaacacggtgaaatcccatctctactaaaaatgcaaaaaaaattagccgggcgtggtggcgggtgcttgtagtcccagctactcaggaggctgaggcaggagaatggcatgaatccaggaggcagaggttgcagtgagctgagatcatgccactgcattccagcctgggtgacagagcgagactccgtctcaaaaaaaaaaaaattaatttactttttaagagctttattatgataggcagaatagtagccccccaaagatgtccatgtccttgtccacagaatctgtgaatatgttacattacatggcaaaggtgaattaaggtagcaagtggcattagggttcctaatcagctaaccttaaaatagggagattatcctggatcatctgagcagttttaaattttgaggtagtcaaatgtatcagtcttttctactttgatttactcttttgtgttttatttaagaatactttgtgatcccagctgggagtggtggctcacgcctgtaatcccagcactttgggaggccgaggtgggcggatcacgaggtcaggagtttgagaccagcctggccaacatggtgaaacaccatctctactaaaaatataaaaaattagccaggcgtggtggcgcacgcctgtggtcccagctactcaggaggctgaggcacaagaactgcttgaacctgggaggcgaaggttgcagtgagctgagattgtgtcactgtactccagcctgagtgacagagtgagactccgtctcaaaaaaaaaaaaaagaaaaaagaaaagaatactttgtgatctgtttatttgaaagttctctagtgactttagttctttttttttccctgagatctttaattgatgtggaatatatttttgtgtatggtctgaggttggatctaatttttctgagtagccagttgtcctaatcagcaagattaacaattgttttcattgttttgatcatacttattttaaaaatatatattatatgtataatttttatatttatagtttataaatatatttttatatttatagtttataagtatatttttatatttatagtttataagtatatttttatatttatagtttataagtatatttttatatttatagtttataagtatatttttatatttatagtttataagtatatttttatttttatagtttataagtatatttttatttttatatttacaaatatatttttatatttatagtttataaatatatttttatatttatagtttataaatatatttttatatttatatttataaatgttttttaaaatcagtaaattaaactaatactgattgggagaagtaggaatctgtgtgtattttccaaggtgacttttttattgcaaccactctttcagaggaattatatttctcttgatgtatatgaactttcaattgatagcaattatagtcagtgataaggtactaaaaaaaatctttctttggtttctgaatttgcttttaactaggaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacaggtatgtatccttgtgcgttcccatgtacaaagcttgttttctggcttgtttgtttttgttttttaagaaaggaaaagaaaataattgacagagtcttaaatgtgaaaacattccttttcttggatcacatgctttgaatacttaatttattgctttcataattattaacactaataaccagctatcataacaagctattataattactaacatacagttttagttaaaagcattagtgatttaacctgtttttttttttaaatactgcgaattcagttgtcagttgctaacagtacaattaatttatctgaggtattggtgacgatgaaaattgtttgagctttacttgaaaaagttgtgaagtattacttttaatcccactacccttagattttcaattgctttaatagtctactgtgcctaaagcactgggtttttttttgtttgtttgtttgttttttttgagatggagtttcactcttgttgcccaggctggagtgcaatagcgtgatcttggctccctataacctctgcctcctgggttcaagcgattctcctgtctcagcctcctgagcagctgggattacaggtgcctgccaccatgcccggctaatttttgtatttttagtagagacggggtttcatcactttgaccaggctggttttgaactcctgacctcaggtgatctgcctgcctcggcctcccaaagtgctgggattacaggcatgagccaccgcccctggcctgatttttgtttttaataataattttacttcatagaatacactatatttaaaagcttagtctgtcaacaagtagtaagtttttatgtagggtacctttattttggtagaagtcaagcagaatcctgttttccttcctcaggaaatttattttatattcctattaaaacaatatattatttgtacctgaatttatattatatacacgttcacacatggagagtactaaaggatctgtgggcatctatatgtgtgtatgtgtgtgtgtatgtttgtgtgtgtgtgtgtgcttatgttttgagttctagattaaatattgaattgttggtcagacgtggtggctcatgcctataatcccagcactttggcaagccaacatgggcggatcacctgaggtcaggagtttgagaccagcctgaccaacatggtgaaaccccatctctactaaaaatacaaaattagctgggcatggtggcacaggactgtaatcccagccactcaggaggctgaggaaggagaatcgcttgaacctgggaggtagaggttgcggtgagctgagatcgcgccattgtgctccaacctgggcaacaagagtgaaactccgtctcttttaaaagaataaatctcgaatgttttctaacaatcgaaattactttttcatttgacattgcattggaaacattattccacaacaatataaatttaaatatacattgagattatttttttccaatttttattttattatgtttattttattttattcgggggtacatgtgcagatttgttacctgggtatgagattcttaacatagatttcagtgtatataatataaccaactccgttaagattggaaatttagatatttgtattataagcaatgttgggttaagctatgttaatggatctttgtccacttgcctaattatgtccttaggataaatcctaatcagtggaagtgttgattcaaagactatcatctttttttttgtttgtttttgtttttgagacagagtctatctctgtcacccaggctagagtgtagtggcgcgatctcggctcactgcaacctccacctgccaggttcaagcgattctcctacctcagcctcctgagtagctgggattacaggcacctgccaccatgcccagctaattttcttttgtatttttagtagagacgggatttcacagtgttggcaacgctggtctcaaactcgtgacctcatgatgtgcccgcctcagcctcccaaagtgctgggattacaagcgtgagccaccgcgccggcctatcatctattcttaagtattttgatacctgttgcctaaattgccctcctgaaaagttacatcaatgtatgctccaaccagcagtgttcaggaggatccatttctctacaacctcactgacactgagtatcaaaattcagaaaggttgaatatacagtacagtcaatactagtatactcttcatccagattaatgaaatgttaactttttgcaatatttattttctttttttttctggattgtttgaaagtaaaacattatttttctgtctctttttcttccttttctttcttttttttgagatggagtttcactcttgtctcccaggccggagtgcaatgacatgatctcggcacattgcaacctccgcctcccgggttcaagcgattctcctgcctcagcctctcaagtagctgagattataggcatgtaccaccatgcctggctaattttgtgtttttagtagagacggggtttcaccacgttggcctggctggtctcgaactcctgacctcaggtgatctgcccgccttggcctcccaaagtgctgggattacaggtgtgagccccatgcctggccttttttttctttttctttaaaaaaattttttgacaccagtgtcactcaccaataaaaaatttattctttttgtttttttttgagacgtagtctcaagagtgcagtggtgtgatcatggctctctgcaggctcaacctcctgggctcaggcaatcctcttgctttagctacccaagtagctgggactataggtgtgtgccattgcatccagccaattttttttcttcttctttttttttttttaatgtagagatggagtttcgccatgttgcccgggctggtctctaactccagggctcaagtgacccacccaccttggtgtcccaaagcactgggattataggtgtgagccaccctgctcagccaaaaagtttattgttaatttgatgtgtatcatggtcttcagccctaatttcaataacctattgggtgcttgggattacttgtacatgtaccacatcctacagttttattatacctagtgatcaagctttgggcaaaggagaaattcagttttcagtagcatcattggaagtattatgacttgtgcttaaacttttaccagtgcattcttttgataaatagaaatagtaacaaaatatgaattttaaatatgtggggagatacataaagaacattgcttatttgttcttgaaaataacagtgattcaaatatttcattcagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatttttccctttttgttgaggaatttaataattatgattgttataaataattatgtataattataatctagggtagaaaatttagttatttcattaaatttggactagtgacaaagactgcaggtaatgagaagcccagtttataatgtaacagcacaacctggatgttgaaacagcttggcctttagaagcaagtggaacatttcagtcttctagccaaccagctacttacccctgcaaggttgtgagtaggtggaaaagatagatcttttttttgagatggagttttgctcttgttgcccaggctggagtgcaatggcgtgatcttggctcactggaacctctgcctcctaggttcaaacaattctcctgcctcagccttccaagtagctggggttacaggcatgtgccaccatgcccgtctattgtattttttttagtagagacggggtttcaccatattggtcaggctggtctctatctcctgacctcaagtgatccacctgcctcggcctcccaaagtgctgggattacaagtgtgagccaacgtgcccagctggaaaaagatagatctaagcagcttgggtaactataaatggaagcagcagggggatttgagacccctgcttggggcctttctggcccaatataccagggcttagcaaactttttaaataaagagccagatagtaaatattttcagctttgcaggccatactgtcacaactactcaattctgcagttgcagtgcaaaagcagccatagacaatatgcagataagtgtggctgtttttaaataaaacttattcatgaacactgaaatatgaatttcatataattttcctatgtcacacaagcttctttaaaaaatgtttttatcataaaaaatgtaaacaaacattattagcttgggggaaggggagaagcatggaaaaaaatcagacatctggccaaatttggcccatggtttgcccatcccagctttagacagatttccaggtaagagcaaatgggccaggagtggactgtagggcttggttcagtgaaagcctctctatccatgcaagtatctgaattttcaaacacctttcacatttcattgtcagccgagataaattagagggaaaagatatctcaggcaaagagacttatttaataattaatggttattgatttattacaattttataaattaatttactaatttacaaataactttctgagctcttacatgtgcaggcactgtgctaggcctgttacaaactctggagaactgagttatccccatatacagatgcagatactgaggccctttggggtgggtgacagctcagatcccacagctagtgtggcacaggcaggaacgaagcccggggtcttttgatggtagctgaaccgcacccagacacccacccgtgtctgccagcactccgtattggctgggaaacactccctgaatccaaaggtgcctgtttagtcagttaccagccagtggtcctcaagtgtccccacctgtaagatgggggcgccctgccccagtactgcagcctcgcgaccccctggagggtgggggacggtagctcaggcgagagtcttccggctgccccggggagggaggaaatgagccggcggcaggggcgggttttcggcggggccaacccacggtggggggagcgcggccatggcgctcctgctttcggtgctgcgtgtactgctgggcggcttcttcgcgctcgtggggttggccaagctctcggaggagatctcggctccagtttcggagcggatggtgagcggcgcgggcgggcggcaggggatcgggcccgcggcggcgtgtgctccgccctgccgctcctcgcccccggcccggcaggccgccttcgggcttccgaggctcagctggagctgggggaaagcgcctggctttcgactgaggcgcaggtcctgcctggggagttcctcgagttctctggatcttccctagacggaaggggacagaacctccccttcctgcagaatattggtggccccaggcaaatctagagccttaggaggtccctcccacccccccggaccctgggggaggatgatgcggtgggaaaatgagctcacttcccgctctcttccctcttttcgccgtttgcttcagtttttgggaggttcgtggggttggggtgtagtaatcctggctttgcagggaaggaagcccgccctgaagggcaagtatatctgctaaagattgcacatctagtcaggaagcaggacacaagctagacactcctaactcggaacccagagagggaagcctctctcggaagcctgagagggatgccctgaagtcgtctttcagccttctgtctagttccagactcatgggaaagctttcatatcctgttcaccaatctccccagtccctcaaaagagccagacttgtagacctctgctggcatctctctccaaggcctggataaatccccagagacagacagcttagagctgcttcccagcagagctgaggaggggaggtagagctgaggagtgggaacaggaaaaagtatccccgaaagtaaggatgaagttgtcatttggctcaggggagggcctgccttgacaagaagagtcactttgagcccacctaactctgcctcacctccaaatattccctgtacagcagccttaagagaaaccaggccagacacaaagaaggaaactgtggaattccccaggccttggcactagggagccaagcccagccccctcctcctgggatttggggctgggttgtaatctcttgagaggtctagtgagaagatcaatctctgtaccacttggagcatggagcctgtttcctgattccaaagctcagcgccacagggcagccctctcctcttcaggctgacctcagccctggacctgacctagagtagtagttcttttctctgggaagttgagggcacaggcatagatatgccatggagcatctggggagctcatccttgttgaacaatgaggctaacaggcattccttgccacccctagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggtaagggggccaactggcctgagaaaatggggtcttctgggggaggattatggaaagacctggctgttcccccttactgttgccacccttcttttttctctgggatcaagagcactttctgctctaccacagtttccatggtcttcaaactagcacaggtatttttttttttttttttttttttttttgagatggagtctcgctctttcgcccaggctggactgcagtggcactatctctgctcactgcaacctccgcctcctgggttcacaccattctcctgcctcagcctcccgagtagctgggactacaggcgcctgccacagcgcccgactgatttttttgtatttttagtagagacagggtttcaccatgttagccaggatggtctcgatctcctgaactcgtgatctgcccgccttggcctcccaaagtgctaggattacaggcttgagccactatgcccggcctagcacaggtactttttaaacttaatgtgctagaacattatcacatgttaagtgtaccttctacctcctcaattctaatggctgcatagtattgccttgtgaagatatattgcaagctcagcgcctctgctccttcctccacacatccactcctaggatgaggggatggaggagcagctgccatttgatgcatgtgtctggcagattggtgtagagagcagggaagctggagaaccttgaacaggaaggcagagaatttccctagggagtccccctcaagtagctctgcccacaggaactgctgatgtacaaagacagctgttgcttcaaaggccagatatcttcaggctcttctatatgccctggcatctgttaccattgctgccactgctaccaggcttgcttccatctctggagcttctcccattttcagatctttcccatacctccaaccaacagcccctgggctagtccttccctccatcttaatcttagtagatgtaggattaagaaaggagaaggggccagacacggtggctcatgcctgtaatcccagcactttgggaggccgaggcgggcggatcacaaggtcaggagttcaagaccagcctgaccaacatgatgaaaccccgtctctactaaaaatacaaacattagccgggcgtggtggtgcgcgcctgtaatcccagctactcaggaggctgaggcaggagaatcgcttgaagccagtacccagaacccagtagcccagctactcagaaggctggcaggagatcacgccattgcactccagcctgggtgacagagcaagcctctgcctcaaaaaaaaaaaaaaaaaaggaaaggagaaggatcagggagatttttttttctaaaatctatccactctagccactgccctatttggctgggtcattcccgtttctttcttgtcctctgagaggggcaactgttgccactgctgctgttgttcaagaggcttctaatttcctggtcctgctttctccaggaggctagagatgaatgccgctagttttgggaatgtgcgttaggagtggtgggggtgtttaatgggagggcttgggctggagtgggtcagcctaaactagagagccctgagctcctggatctcctgggttcttccaaggagcctcagggacctcactttccattccaggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgtttcatgtctcttttgcctcattgctgttaatggctgcatagtattccattgcaaggatgtactataatgtatttaatcccccatgaggaacatttgggttattctcaattttttgctctcgtaagcctcacagtaaatcacttttgcatacttattttcttcccctagaagtgagggtgctggttcaaaacacatgcatgtttttaaggtttttaatacatatttaaaacgtacaggttctgtatgcagagcttaagtacttgcttctgcctatgccctttgagacatattagagattccctcccactcctttttttctctgacatattagatgtgcagagctaacaggtaggcattgagtcatttgacaggacctgaaatcaagctctggtggtgatctgtggcacccagtccagtgctccttgacacctacgtggagatgagggacagccaactccatgaaatgctgaatggtacagcagggcccaaagcctgggaggaatcccagaggtccttgggggtaggaagggtgcatatgtgtgacagttctcaggggaaaagtggacaacacgttagggcacctgctattatgtcaccaccatctttatcttaggttggcagggctgtgggcttttgggaagtgatgtacctcccatgagggactatagtgagaaacagttcacttatttatgcaaatattctagctatcagcctacagattgctttgagggtggaaaagaagtctctattactccatttcatgttcactacaaaatgctaattcccattctgactagtgtgaacctcaggcaaggtgacactctcagttggatttttttcttctgagtctgaaagcatagtggtgtagtctgcctatagtaaggatagatagattacactaaataaatggtagtgtcaaaacaataaggaaaccttttctctcatgtaagaggtccagagataaccacttcagtttcaatgttggtcagtttgcctaatgatggcatcaagaatcaacattctttaaactttctgctctgctgctttcagtgtattggctattgccctcagaattgcgaaatagctgcagcagctccagacagtgcatttgctataatattgaaaggtgaaaagagaggaagggtgccttagaagaccctagatttggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgctgtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaagaagaccctagattttcgcatggatctcactgggcagagctatgtcccatttccattcctagactaatgactggcaggagaatggaattcccatgatggacttagactaagatttacccacactggtcagcaaggaagaagagggggtagacaatggtttctgtcacttactagcttatttgaaaactatggataatgatagtaactatttcatagcctggcacatagtaaatgttcagtaaatgctagtcattattaaatattgatttgttttacagatgagaaaatgcatttggaaagcttgagtgcctatatatcagacctggaactagaactaagtcctaattgattccagaactcaaacttttcactgcaccagctgccaaagctgaaaatggacaggcatggcaccccagctctcttcaatctgagggtagatgggatgacctgtctggggtgatgaaatctgctctgctttcccagcatttcccctctgattggaatttttttttttttgagatggggtttcaccatgttggccaggctggtctcgaacttctgacctcaggtgatccacctgccttggcctcccaaagtgctggggttacaggcattagccactgtgcccatcttgcttgaaaattttgaagcccctgaaagtagagcctggagccccgaggatcctggccttattctttctccaccccttccaggatgccaccgccagcccgtctcctgccaggatggactttgagtaaaacctctcgcagctagcattagattgagggctcctgtttaccaagtctgggtctgtaggctgataagcagctactgggccccccaagcttggctgtaggactgcccagcagctgcaggaaagtcagggtgctagaggagtaggctgggcagctggtgtgtacgagcagttgggattgacagcagcaggaggatcttgagcccaagcagtgcctccttagcagcccaaggagaagccaggcctcaggaaacgtgccccccaaactacagcctaaatctaggtcagctcagcacgatgacgttcagctgcctgcccttcctaatacatttttatctccctccctgtgctgaaggctttcttgtcctccgatgacactcccttcccttggggccctactgcagccccaaaaacccagctcatagctgccacaggtgggctccagcccttccagctgtcggacccattcttcatgtcgtttcttgggattagctggcgataggagggtctgggatgtgtgggtgggaggggattctcccctgtctcagatccttaaagtcaggaccccagagagaactccagcagccattatagcaagaggcaagaaaggaacagtctggtaggatggcaggggatgggtcagggtggggctacaggcatggagaacagaatagaggaaggtgggaaaggaaatacagttacccagggtctcagaaaggattggagcctgagatgctcaaaggcaaaaatgcagattttggaagaactgagttttaggacatcctaggagtgtgtaagtgtgtcacaaatagtaacaggacattggtttgtgcacttactcccttgggaagagggtaggaatatgcccagatgtttttgtgttgttttgtgtgcctggggtgtctgtgtctctgacacactgtgtgtgcctgtgtgagtgtacacatttatctatgtgctgcctagaagggaagggaactaacagtaatgaagtatctccccagtgtcagccacagggctcagttttacttaggttttctcataatcctcccaacaaccctgtgaggtaggtattttcatctccattttactgcagcaaagacaggctcagtgaagctgagtaatttgcccaaggtcacatggcaaatagatgtgtgttatctagaatctgcctgattgctgggtctgtgcactttttgcttttctgtccagaggtttgagtctgacccaggacctctttgtggtcaaaaagtgaggggggaggaaacaggatgaaaggcttgagagtggcaaaagcttttcagcccagccaagggtgctccaggcaagcgctggggcacctctctgggagaggaccttcaccaaggcaagtctgaggtcagtgtgcataggcactgcaccgcaagcccattcctccatccatgcttctcatctgggtggcacagggatgggggcggggaggggggggcgggtgttggggctttttctggaaaggcctcttctttatatttcagcctgtttctccagaactccctgttggctcagtcctacgtgggtttactgcacaggtctgtggcccaacatgtatgaaccatactccatctgtgaggggcatctctaccctctcagtcactaaggttggaaatttccaagttatctaggactcctgcctcttcctcgcttcccacagtttgtcaccaaaaactctggagtccataccctcctctcagcagctgctggccaggttcggtcttcattccctctcacatggactctgcctctagtgtcccctcccagcaagggctgaagaagaggagactggggtgggagaaggtggaatgggggctgcctttgtcgctagcctccgcagtaacctttcttctgccacttcaaggtcagagatgaacagcagtgttggggacctgggtgttggcggctgcagcctctgggatgaccctgctcgcttcatcgtggtgcccgcggcctatgccttggcactgggcctggggctgccagccaacgtggcggccctggcaatgttcatccgcagcggcgggcgcctgggccaggccctgcttctctacctgttcaacctggctctggttgatgagttcttcacgctcacgctgcagctgtggctcacctactacctgggcctggcccggaggccgcctgccacgcggccggggccacctactacgtgtccacctatgcggcggtggtcttcgccgcgctcatcagcgtgtgccgctgcggcttcgtacgcggtcccgggcccagggcggctgcccgcctggcccggtgcctacggcgccccgcgcgcgctgcctgcgccttcgcctggctggcgggcctggcccctccctgcctggagcaccgctgggcaagctcggggctggcctccgccacggtggccttcgcggccgccttcctgctggtgctcgcggccaacgtgagcctggcgcgggcgctcaaggcgccctctggcccgggcccgggccctgcaaccgccggcgcgcaccggcgcgcggccaagaccatggtcctggggttcctgctggtcttcgccctcagtctggcgcccaaccacctgctgctggcgccctaggtggctgggggggaagacaacggagaccggtgtcgcgccgcctccacgctcgacatcctgcacaccctcagcctggcgctgctgagcctcaacagctgcctggacccactcatctgctgcttcttcgtgcgcctcttccaccaggactgctgctgggcactgagctgccgcctggtgaagggggcgcccagggcgcatggggcctccttggcctcctcttggagagtctcctggcctcccctcctgtctcacccccctgtcaccctcccagtggcatccagggtggagaaagctctttggaaagacctagattctaatcctgacgcaaccacatactacccctgtagctgtgaacctccgggctcatctgtaccaaggacatagaacattctttgtaacccgaatgttccctggatgttgccagcttttggatacaaataatataccactgtgttttttttaaacctcttgggataaaacccaaagtccttatcatggcctacaaggccctgtctgatttggctcccctttctctccctaacccaccacccctgcgtctccctgcaggcagtcaccttcttaggcccgggaaaatgccggtctcctactcttcatggcctttgtacctgacttggccaggaatgatctctgttcctctctttcactaagttagttcttcttcaccctcacttcctctaaagtaactccttatagggaagcctttcttggctggcaacacacacacacacacacacacacacatacacacacgactgaatcagatcggattgctctttgatagctcttttcataattgtaatcaagcaattaattgggtaatgcgttgttgttgttttctttctctcttgccagaatgtattcatgttgacccataagacattatcatttttataagtccccaaaagttgaatattggaaattttatttccacccaattcaacttaataaattctgtgtttaccttgctcactgctgtatctcctgtggttggtactgtgccttgcatataataagagctcagtgtatcagatgcgtgagtgaaaactgaatatcattaatttaaattgcttaagtactcactcagacattccagtctctgatagcttttcctcaagtgtttctgagattctccaagcttgtcttacccacccccgaccatgcattcctagcccagtcctgatgactgtctccttctgctgttgctggatacttgcagttctgccatcacctccactgtaccaagacttggtgggaagtaagctggagatccaggctgctggagatccaatgcctgctgcctccagactctttcatgagcgccaatctctgccaggggctccggctaccagtgcttccccttctgtgctttgacaactctgcagtctgcttctaatgggaaagggcaccactctcctcagccacattattggggccccacagcaagactgcttgggtctcaaggaaatcgagcttaatgaatgagagcaaaccctcttcatttggccatgtcagcttgtcaggaagggtccatcaatcagccaccatgtcttacctgcctttaggtcctattgctgagtttgacttctaaggatacatttggtaaattcctttttttcttgatgaattacctcttattggtccctaattccttctttaacttttttcttttccattttaaaagcaatataggttcataaaagtaaattcaaagcagtagagaaaaatgtaagataggaagtactagcctgggcaacgtggcgaaaccctgtctctacaaaaaatacaaaaattagccgggcgtggtcctagctactcgggagactgaagtggaaggcttgcttgagcccaggaggtcaaggctgcagtgagccgtgatggcgccactgcacttcagccttggagacaggggagaccctatgtcaaaaaagaaataaaaagaaagtaaaagtcccctagtgatagccactattcacagcttctcatttgtgtagctttccagatattttcgattccactgtaagtccacatgtcatcagttttctttaaaaacctacaaatgggatagtattgcaaggttcttctgcaatttacttttctcattgtttcttatatattgttctatattagcacatatagatagattcatctcgttttttcaatagaagcagagtattcgttttactcaattggtcccctactgatgggcatttgttgccattattttactgttataaacaatgcttcagtgaatgctcttgttaacaaatgtttgcatacttgtaaatctgtagaataaattcctggcaacg

SEQ ID NO: 38582 - DNA, 17860 bp, Homo sapiens
gcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggtgggtggccgtcgccccggccagcgcctccgacccgccccgccgccccggcccggccccgcgggcttccaggctcccgcgacgacccctccgcctccgggcggccccttccccagccggcccccgcccccgctctctcccaggttggccgcgtccccgggccgccgcctcaggctcctacgcccgcggggagggcgggaggcgcgcggtgtcccggtgcgggggtcccgggagggcaggaggcacctgtccagggcgggcgccgggaggcggggtgcggggcgcgggctggtcccgggggtgggtgcggccctgcccgaggccggttcgtgctgggctagcgcgtgtggactgcgtcccgagagctggggctcgctcccgagaaagtggaaggcggagcgccttcctcgcaggctcggtggggagggcgcgtgctgtccgcggaagcgctggagctggcggccccgcaggggtccctcccgggaaccgggggaggcgtcggtgccgcgggcgggtggccggttccgaagccacctcctgctcggaaggagggccaggacccagtctgcgggccaggctgccccccgtttcccttcgtctataccaccctccacctcggaagcgaggtcgcagtcgcccactggacagtttgaaggagaccgcagatttgcacccgtttcccatgggcccagacacggcaggagttgcccaggccactcctgcagacattggggcgtgggcgtggggtccctgagccaggccatccgctgggcctcccgtggggttccctgtgacctgatcggaggtgcctttgcctcacaccagccccttggccaactgggaaggccccgagtgcatttaatcccactggctgtgcgctaacaggtgtgtccagtttctgttctgtggattttaccacgataaaaaaaaaattgggggagaaaaagaatttttgtaatatgactttcatacttaacacgtgttacagattcgtttaattccctcagtgatagaactaagcagacgttggaactaggttcaagaagtcaaagtagcactaattgactgggttcattgaagcttggttggaggcctggtggggggtgagcggccacagagcctcggggacaggacggaattcgagtgactctggggaagtgtctctggcatctacagtgtacggagccatcaccggtcactgagcgtgtcctggagagttgagaccagtgctgcccacctctccccagtatcgccaccatgaggagtctttttagacactttccgccaatcatcctccttcatcttttttaaaatttacttttaagttgacacgtgaaaattgtatttatggtgtaacgaactcttaatagcacagaaatactctacgtctgtatgaaccgtaaggagcacgtgagaaagtgtggccaagatgaggcagaggtttccaccaaagcacaatttctttctccctgctgtacacatgcactgatcttacggttctgttttatagtgaaccactgtgttcccctccttcattctctcttccagagcccttctggtatcagctgaattgtttagcatttttccctgcctttctttgtggcctctgctgaggcactgtgtggcagtcccgcggtgacttccgactgagtggagttgaaacacttgagtcaaggtggcacccctcgtggaagagaagattcattcccacgctggcgtggtggcaggatacccctccagagccccccaccatgtttggatgattaactgggatctgagcagctgagggaggtcctagcattgggtgggcttgggggacagagaaaccattctaataagatggactttgtctctgagttttgcgttgtgaattgtattggagcatggtcttacaggccagaaacgaccaaagacagtgttctggaggaacttagaacggggcagtaagggctggaagatttggaataaagtccagctttaggtgcaatagctcgaggggacatgtacggtaacagtcgcctggcatgtggtgatgctgaaggggacactgagctacactgtgctggctgcgtgcttggggccgctaaggtgattgtcgggaggtgactcaaatgtgcagataaccagttgtgggaaataggtttatttgaggtggtttggaatggggagaggagaatttggtagaacttggcaggtgggtaacattgtccttggcttggtggccgtgtgccgatcggcatcatcgtcatatctgtaaacgtgttggtccattttcattccagctctgttcttagccaggggagtctgaatccagcccagtgcccgtctcccgaataccagctgcctgaccgggctggtttatcagtttgggcccatgagggttatccctttaaaatgctgcaaaaccccctggggagcatgtgcacacatgcacctttctccgagaggtggcctgcagctctcagattctcaaggctctgacgcagaaccagttgagaatcgtttctccagtctgtgcctcctcaggaacctgtggggcaggggaggcagaggcggcgtgtaaagcttcgtgcgacaccactttggatagaggtgctttgggggtgtgaaggaagcttcagatgatctctggggcttgtctgactctgccatcaaatatccgacactgacgcaaggcagtgggcttgggggtgggcggtccgggcgtgcagccatctgggcttgtcacaagcagctgagatcctgagttttatccttaaaatccttgccgctgtgcacccctcccacctcccatccgtggtgctggcagaagaatgaccgcagctccatgctggcgggttgacactttgatggatactctagattcagagccaggaaggagagagcacgtgcgcgtctgatcacgagcctggactcggatgaggagagatctgaagtgaggactgttgctagaggcgtctggagctgtgcagcggggagaacaggggaccctgagttctgcgagggtctcacaggccaggccggacagggcttttcttttgcagggaggagtggccaaggctagaaagaatcaagctggggaggtgggatgggccagtggagggtcaggacctccagcagatcagagagctgaggccagaatacaaaaattagctgggcgtggtgatgagtgcctgtaattccagctacttgggaggctgagacaggagaatcacttgaacccaggaagtggaggttgcagtgagctgagatcgtgcagctgcactccagcctgggcgaccaagcgagactccgtctcaaaataaataaataaataataaaaattcaaaaattagtcgggcgtggtggtgtgtgcctgtatcccagctcaggaggctgaggcaggagaatcacttgaaccgggaagaggaggttgcaatgagccaagattgtgccactgcacttcagcctgggtgacagagcaagactctgtctcaaaaaaaaaaaaaaaaaagtccaggtaagggaattgtgttccagttgatcatgaggagaaatggccagtgttttctgaggcagagaatgggaatttggagggccttgctgcaggtaagcaaggggggcatctgtgatctcctctggctcgtatggggagggtggttctcggtggaaggctttcccagcacactgcagggtggggggtttcataattgtttccaggatctcagcgcttgggtaaagctcacccctgtgaggtgccaggggctgccagagcctccacaggtgttctgggaaccagcagcctcatgagatactgccagggacaccagcgagctcctcaagggtccctgtggctggctaagagctttttcttttttgagacaaggtgttgctgtgtcacccaggctggagagctgttactgatgttaggtaaaactgagactttgaagccacaaaaaaggattcctgggcgtcctgtgggaggccaggccgcctgtagcataaccctcccaggctgtgatcatagtgtctgcacctgtcaccgtcttcaaactgtctgacagcttcaaattgtagaaaactgatagtaacgcacgtgtttctagtccctgagatgcaagtagattttgtctctcagaggtgaagttgatgtcctctctcacacaccccaccgcggggtccctgtgagaggagccagtttacaactcatatcttccttcctcacggcctgtatccatgtctgctctttggattctcctttgaactgggtttttagtcttattggttctctcattaactaatgaggtaaatctttgacgtgggttccttttctgtttgtaggagttacgctctaccagttaaacgtgattatctttcaataaaggtgcattgatacatgcatttaaattgttttttgattggcgagttcttggggggctgagaattagttgactgtgggagccccaccagccagtgggtgacgcttctcactgtagtgtgggagctcagagtgcgtggtggggcctgatgttttttgtcaccccagcctcaaagggagggcaggcctatgtccatgtccagcctgtgtcctgagacttggttctttttataactttttttgaacatccatttaaactccctaaactatactttcagattatatggaggcgcttttggtttcttgcgtgctgccaaaccccactctttggggtgggccgggtgctggttctgaggagctgccctgtgaccctcgaggggccgttcctgttgcattggagtgggggagcgggtctcgacctgcaggtctctaaggagctccatgctggtgtctgccgcactgtggaggagtgatgggcttcatgatttctgttttttgttttgtttgagacggagtctcactgtcacccaggctggagtgcagtggcgcgatctcggctcacttcagccttcacctcccgggttcaagccattctcctgcctcagcctcccgagtagctgggaccataggtacccgccaccacgcccagctaatttttaggttttattttgtagggacagggttgtgctatgttgctcaggctggtctgaaactcctgagctccagcagtccacccacctcagcctcccgaagtgctgggattacaggtgtggccaccacgcctgacctggtttcttctttcattgctcgcggccatcttgcttacccaccgggaagcctagtttatggcatctgccttgaccgcctccgagcatgtcatctggcagggtgggtgcaagtcagttgtggtttactggactagcaaggaggggacaagcgcccagggctctgactcctgtaggcagccaggagaagtgtgttccgaaatttcactgggagccgtctgcatgcacctgccctgatcctcgctccctcttggccccgcttcccttgagacagctccttctgtgtccatatagcttcccgccgagcctgtgattggccctgcaaggtggccacggaggcctcccatggaggtgagtgccaggcgccccagagaggcctgggccgaggctgcctctgtgacgccactgcacagggcacagagggctcctggagagcacttgggccccgccgtccatcctagggggcagtgtctgtcattagcgggtttatctgcttggcttgggcaagagggtcaggcagcagatgggtgttattaggggcactgcccaagctgaccttgcctcactctccctcttcatctctgtgtgtttgtcacagcctgcacctctggcctcgtggccctcactaaacacctttattatttatttattcattttcctcactaaacgtcttgaggcctgtttcattgggttgttcttggaggttttagtttccccagcgaatgtgctggtttgaaagtctgctccagcccacgctggtggtgacacatgtgtacctgggatgtgacgcagaggctggcattccagacaccgctggccacctacggtgaaaacggatgaatcacacttggtttctgggctttggtgtattctccctagctcctaaaatagctgttccactgagcatcagagctgcggggtccagttaaaggaggcgctggtgggagcctggtctggggcccggcttgctgtcctgcgcttcctttgcggggcgtgcttactggcggggtaggtatttggcagtagttttaccttatgtcttcatccattgctttatttcatattaaattgctctgttgataattttttaaatttctttcactaatataatcaataggaaattaccttatttaaaagcctatacatctaagctccttggttattttatagtaataaacttctggatcacttatatttttaagggggcaaatcctaggtgtggtctgtctctttttttttttttttttttttgagacagggtctcactctgcttcccaggctggagtgcaatggcatgaacatggctcactgcagcctcgacctcctgggctcaagctgtcctcccagctctgcctcccaagtagctgggactacaggtgtgcaccaccatgcctggctcattaaaaaaaatgttcaggccgggcacggtggctcacgcctgtaatcccagcactttgggaggccgatgcaggcagatcacaaggtcaggagatcgagatcatcctggctaacacagtgaaaccccgtctctactaaaaatacaaaaaattagctgggcgtggtggcgggcacctgtagttccagctacttgggaggctgaggcgggagaatgacgtgaacccgggaggcggagcttgcagtgagccgagattgtgccactgcactccagcctgggcgacagactccgtctcaaaaaaaaaaaaatgttcgtagagacagggtcttgctgtgttgcccaggctagtcttaaactcttgggctcaagtgatcctcctgcctcagcctcccaaagtgctgggattacaggcgtgagccactgctccagcagtgtggtgttatatttagaaattggcctttcagcttgcccaaacacaaactgcacagtaaatgtgaaaagcagtcctctttcaccaccgtctgctgagaatattgagagccctctcccctcctgtcgggcgctgtgggccagggtcaccatggagagaccatcaatagttactctcactggaacctggtgataacgtggcctcgtgtttgcttaagctcagagttaaaacccccgtgaagctttctctagcagattctagtggattctgtggctagtggatgtctggggtcagggaaggggccaccacacagaggcagggactgtgccaccgcacagcaggcagaacattccagaaccgacaggcccatttgagggcaatggcagggctgggctgaagcacaatcagggcggggaacagccagccaacgcccacagcccgtgggcagggagcccctggcagagctgccagctggactttttagatgcttccagaaggctggggtgggccaggcctggtttccaagtccaggaagcagcttaaaagcaaagggaaacaaaaaaaggctggtcgtgggatctcacaaagctcaggacctgcctgcctgagttggggcagtggcgacatggaactcggcagggatgaggccctcgtgtgggtcgcgacgggccagtccttgctgcagaatggcgtctgaagggcccctgatgtgcgccacaaccgggacctctgtcctcctacagtgagggtacacgtggctgtgggccccataggactccttccagaagcatctgcagagtcccaggaccaccagactctgttttgccaactaagcacagtgggcacttggcacctgatgtggactgtctccgagccccctgtggaggggctgcaggcttcctgtgctgcctgtgtgggtcccgcaggctggagggaggcccctgcctttgcagattgcagggtggcagggacacgctgagggtggcggggacatggtgagggtggcggctgtgatggcaccgcatcagagcagctcctccacaccagcgtcttctggggctcagagaaggggttggacttcccagagaaggggtgcagggcagggaagagtccccatgcctatgagggagaggatcagggtggggtgatggaggatccgtggctgggcccccagaccacagggaggctgtgcagccatgtcagaggcgctgggggattgggcggccgcgcggtccccaccccagctcagacccaggggcctgtgttccagaaggtgctcggccccggtgaccccacaggccttgcctgcctccttgtggaatcagccccagcagtgttcgccggcccagggttgggctggaacggtgccatgcgtgtgggagcagctttcccacggaggggccgagccctgtcagctgcttgtcggtgccagcacagcccgtctgtccttggtggagctctgaggcggctctcgcgttagataagacgtctgagctcttgtgtggcttggtaatgctgtggccacctccagtctgcctccttttcgagacttcaggccctcagtttatgctcgccaggtaattcctggtctcgtttgggggccccctccttcccccagaagggaaaagggggctcttcgtggagcgaaggtcttctcttacatctcttttgaggattattgtgcttagaacatggatgattcttggtcaatattcagccgagcccttaatcatcagaagccaaaagaccctccatctctcccaagaggacccctttgactcccaccgttccgtcgctggttcattgaacccacacctgtttctggttcaccacccgccaccgaggtctctgacagcgaggaccaaagcggggtgtgcttgtcacaccttgtttcatccttaccaaggaccccagagcacgagggtcttgttctcatgaagctgagggaggcgaggcgtcctgggtcccgcagcccccaatgcgctgctgaagggcctgctggggagcgggtgggcagcaccgagggccagctttgaaaaaggctgtaccggcttaccaaatccggggaccattttcgtggcaaaagtgtccctcactctgttaaaagaatgcatggtgacacagatttccttcagagccaggtctgaatgtcttccccttggactgaagtccctgctgttagagcgggggagccggcggcgatggcggcgtcctcgtgctgcgctcgtgccggcgtcagggtccccctgccatctggagtgagcaggaggcggccaggccaggccttcccagctgaggtttgggagttccgtgcctttggtgctgagggtgagcgtgttcacggtgacttcgtcccttggtcatgaggaggttcgagctaggaaccccctgcaagtggtcaacgcatccggcttgctgttctaagtggaggcggcaggcacagctgggacccacgcccctcagaagcaggctctgtggtggtcggagcaggcacctcaccaggccacgctccatttggggctgctgagaagctggctgtggccagtcctgaggtctctgcagccctcgggagcttggaggcccggctggtttttctaaggagttggccgggtggccatggctgcccacagtggggtgtgaccttgggcttgtggcctcctcagtgagggcctcctggcaggggctgagagcccagcgtcagtggggggcttcagcatagaccaccacatgtgtgtctctgggtgcttggtaaatgcaccctgtgcttcggtgacaagtttttttgtctagtcaagtgaagcagtggaaatgcagggagcatcttaaatctgttttatttctaactgatttcaattccacctttacccttaggccgaccaagcatctgaggtgccgggacagtaccaccttgccatggggcttcaggcctgctgtgaccccttggggaaagtgagccccatggccacctgcccagttcccaggtcttgtgctgtcagaattcctggtgggccctgagcccagtcaccttcctgtttctgtctacctttgtacattctgtgtgcatagaacactcttggccaacaaagtccagccttgtgagccctggcttgtgagtcttacagcttctctgtgcctgggtcctccagctgaggaagcatcttcagggcgtccccaggcctggcgcccgcccccgtggcacacaccggcctgcgtgtgcttcagctgcttccaggggttccctcacaggcgggggtcagggcacgcacgccaggactccaagtaaactagaataataagctttatgtctcagatacctgggcttttgccggctggcgcgcagccccagaatcagcacctccccatgctcgcctcgtttgtgaagtgggtgctagcacagccttccctggtttaggggtttaggttggctcttgctgtggatttcctagtcccttcgtggcgttgctctttggttccagtaacaggaccagggctaaaaaggcgttgttaaggtgaactgctgttgggtccagtgtggagggacctgaagtgccaggatgcatgctctgctgcgagacagtcaaaccccaagcccacctcaggccccatggttacgctgggtgcatctcccgcaggcctgggagcagcctgcaccccaccgcattggctctggagcctgggcacaggcggccagtccaccgtcctgcgtcacaaccctgcctgcctcaggctgcttgggtgcgtggggaggtggcagggcccagctttctcagcagcccgtggtcgtgccccagcgacgtggtgagtgaccaagctgcgttttaacgctttgtcgtgtctttcctagtgtcggagatgtatgcagtgtgacgccaagtttgactttctcaccagaaaggtgagctgaggccgctgagtgggggtggtgggaagaggggaggggccccaacaggacagctgccgctgccccttctggcaggggacggatgtcatcttatggctcgttttttttttttttgagacggagtttcgctcttgtcgcccaggctggagtgcagtggctccatctcggctcactgcaacctctgcctctcaggttcaagtgattctcctgcctcagcctcctgagtagctgggattacaggggcttgccaccacgcctggctaatatttatatttttagtagagatggggtttcaccatgttggccaggctggtctcgaactcctgacctcaaatgatcctcccacctcggcctcccaaagtgctgggattacaagtgtgagccaccacacccagccgttatggctcattttgagtgtcagccatgccctgtttccgtggaaagtgactgtgctgattctgccggacgctatggggtgggggtgcagcttgcgaggcctgtgcacccacctgccccccgccccctctgccccctccgccccgtccccgtgccgctttgccctcgtgaagtgtcttgcccctaatgtgtgcccagctcatggcgccccgaggcgcgagggcgtcctaagcagtgggacttgggtagttgaaagaaagctgaaaaacagccattttgatccatgattttgaaaaaagggcctcatttcccaggtgaggcggatccccgctgcgtggtggggagcccaggggctggcgacaggaggtgcgcgtgtgcagcggccggcacaggggcctcgcgtttaggcgtggcccggggagtgccaggccagccggggccacacccggggccgcttgttccctgcccctcctcactgccaatcctcccgcatctgcccagcaccactgtcgccgctgcgggaagtgcttctgcgacaggtgctgcagccagaaggtgccgctgcggcgcatgtgctttgtggaccccgtgcggcagtgcgcggagtgcgccctcgtgtccctcaaggaggcggagttctacgacaagcagctcaaagtgctcctgagcggtaaggacgggtgtcctgcacagtcccgcgcgctccgccagccggctcctcgtgtctgtggcgatgctgtgggctgtgcacggggcgttctgcttctctgacgttctctcgccctccctcccttccccgttttcttctggattcgtttagaagcggttatagagccttcccttcttttcagaggcggaatgtcgtctaaaatgttggtgctgactccgctgggcacgtccatcaggtgggaggggaggccctgggcccaggcagcaccttcctccttcccccgggtggaacccggcgccggcgctcgggcgtttgcaaccactgtggctcctcggaggggccggagacctttgcccaatagcacgatgcagacccggttttgagccatctctggggacctggtgtgggagaagggcattctccaggggcatagggtgtgcctccctggaatctgaacaacgagcagcgccttctccccactgtccgtccacctctggccactgccgtcccagcctcctgtcccctgcctgcccgccgtggggtctgggaccacctgccttcctgcccacagctccatcctgtgtgaaacgggcatggtccctggctggacggtgggctttgttgtgcctcctttctgctgtcttggtcctgtcctgccagctcttaggacgtgtgagcagagtggtttattgttctttgatctggaccttggtgatgaattccctgcatcgtttgaaggatgtaaaagaatttctaggagctttgtaagcaagcagaacctgtctagagcagcgcctttgggtttacctcttaaacccttgatccatgactgcctttttgctcagctgaaggggtccttagaacaaagctgtggtttgtttcttgctgtttttactctgtcctctgtgcgtgcgtctcctactggtactcgtgggaagggttaggtggaaaagaagcaggccctgttctcacgtttgcttttgtgttcccaaggagccaccttcctcgtcacgtttggaaactcagagaaacctgaaactatgacttgtcgtctttccaataaccagaggtaagagccggatcctgcttggcacggggcagcattgtcacagaccgggagcctcggtggcactgagcctgagaatgacccgatttggacacttttatttgatgtagatacttgtttctggatggagacagccactatgaaatcgaaattgtacacatttccaccgtgcagatcctcacagaaggcttccctcctggaggtaaatgccagcacgtcctttcctaagccaggagggtttggtgccatgcgtgggtgacaagaggagcatgcacttttgggatcaggcagctgccctgaggagtggggtctgctgggtttccaggacaatctgcctttcctctttcgcggggcgtgtatttactcagtggctttagaactcgccaggtgagtggagacttaaactgtaagacaacaaagggacatttgcctcagcatgtcataatgatttcctctgctctaaatgctctaacgtatcattcggtttattgttggattcaaaccaaggataaagccccaaatgcaataactgagatccccaaaaaggtctgaatggtggctcatcgggagccagcacttcagccctcctcctgcaggcgtctgtgcagactaaacccctggtgcatttcctggtgagctttggcccatcctgggcctctccactaaactctgctgacggggagctcgcatcccgttatctgcaaactgtgctgacagatgcgtgtgccgtaacccatgttgctttccttccgttctctcaccggctcttggttgctccttctcgccactgcctgcccaccttcttgccatagaaaaagacattcacgcttacaccagcctccgggggagccagcctgcctctgaaggtcagcctcttcctcctcaccggggctccccgcatgcagcgggcccgttcctcccctcgccacctggcttctgtccacggggtggtccatgccaaggttctttgtgaaacctgaattcacttactttggttgacttaagagagatgttggatctgataagtgggtttataaagcataaatgaagataccgcagcagatgtactttctcagttctgtctcagcgggagggttacccagcaattgacagctctctgtcagtacctgccagccctgaacaggctgaggccagggggcgtgggggctcacctgcccttgggagcctctgccaacactgcccttccccccgaggcctgctgctccccagctcagtgtggcctcctgggacccctgactctcctggcacttctgtcagcctcctggatggtgaggtgagatgcccaggccagtgttctgtcctgagctcagggatgtgtgtggagccgggatggcatcaagctggttgccttgagcaggctgcaaggtatagatgcccaggtgcaaagggtagggtctggagaagcgggggtcaccccaggcacccctctctgcctgcctcctcctggggagcctgaggctcagatgaaggccagtgtttaggggcatcagatgaaggccagtgcctcaggaggccagggcaacacagcctcccggactgctctcccgggcagaccctccccagggcttctggcactgtgtcccccttgtggtggcttggggggtgcagtgagccccgctctgcccagtctcagtagagcccttcagaccccagcaccctgtcttccggtgggggtggggacaataggaacagtcccctgacctgaaggcagccaaggggccgcctgccagcctgggccctgtagggcaggccacacactcattctttcaaggccagatagtaaacctttgccagccacgtgtgctgtggtgaaggcggaggcggctgcagaagacagggtgacagacggccatggctatgatccagtggtgctttatcaggcaaatgcaggcggtaggcagagccatggtcgccctgctctagagcctaggcaggacgttacactgacaggcaaggttccccagtgttgggggtgggggtgcgtgccctaaccacagaaccgggcttatgaaagtgtggttctagaggcccggcatggtggcccacgcctgtaaccccagcactttgggagactgaggcgggcagatcacctgaggtcaggagttcgagaccagcctgggcaacatggtgaaaccctgtctgtactaaaaatacaaaaattagctgggtgtggtggtgggtgcctgtagtcccagctactcgggaggctgaggcaggagaatcgcttgaacccaggaggcggaggttgcagtgagctgagatggcaccactgcactccagcctgggcaacagagactcaaaaaataattaaaataaagccaggcacggtggctcatgcctataatcctagcactttgggaggttaaggcgggcagatcacctgaggttgggagttcgaaaccagcctgaccatcatggagaaaccccgtctctactaacaatacaaaaaaaaaaaaaaatagctgggcgtagaggtacacgcctgtaatcccagctactcaggaggctgaggcaggagaatcacttgaacccgggaggcggagggtgcagagccgagatcgcaccactgctctctagcctgggcaacaagagcaaagactccgtctcggaaaaaaaaaatgtggttccggggcctcccaggggacagcgtgtcataggttgctcaggcctccaagcacggtcggtgggcctccgactgcagccttggtgcccactccaccaaccggcagaagagccggccctgagtgctgatggggggatgtgtgtctgatggaggggtctcctgagaggtcagtgattgcctacgatggggcttccctcccaagtcatcaagttcatgggaggctgcatcccatgggtctctttcaacaccagccctgactgaagagctgctctcttcagcagtgtattgttggagcgagtgctggaattgagtcattgtcactggaacagctggtcaccgcccaaagacggggagcctgggtcccagagaccagtccccaacatgggtgctgggtctggggagatggcccgtgaccaggctggggtggcatttccctgacactgggcctttgtagtgacaatcccctctgtgctgacgccgcttctcaacggtgggatggctgaggcctctgactcctgggtgaggccagctgtgtccctgaccatctgcttggcctgtcagtggccagggcactctcgaggtggcctccactcttcccccagccctgggtgcaggtgggcacctctgcaggagccagtcttgtctggaggttctctgaaggcaggaacccccacaggccccagggcatagcagcgcctcaattagccgagagcaaggcctctcgtggtgatgtggctcttgttgtttgtcccgggccctggggcacccggctgagtgtcttggtccctctcccaccccacctgtgagcttggggtctcccctcagaggcctgaggagatggtgttccctgggtgctcctgagcaccagccctcactgccaggctactcttggagcagcacaaggttaggatgtgctggccaccgccttggggctggtggccgcctgggcactcagggcctcctttgggccgtcttacctcgtctctctcctccaggaggcaacgcacgggccacaggcatgttcctgcagtatacagtgccggggacggagggtgtgacccagctgaagctgacagtggtggaggacgtgactgtgggcaggaggcaggcggtggcgtggctagtggccatgcacaaggtacctgagcccaggccagggaggctgggccctttggcttagacaaaagcttgcctttcccagaggaagctctgtgtcctgccatttgccccctatccccacaacctgttccccctcagctggggtgcccacgccatctcccctgaaatgcacacaggcttggctccaccaggcacaggaccaagcaggcctcactgtgttgatcttgtctgatctgcaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacgg

SEQ ID NO: 38583 - DNA, 36142 bp, Homo sapiens
gcaggggccagacccggacggctccagagcctccagagcctccgggtctgggcggcgcttcggctcctcccgagccgcctgctagccccgcgccgcactccatccccacaggctggggacgggcccggtgcggctgtgtgggttcgggagcggaggtgagttgcgcggaagtgatggcagtcagcccttcccttcctgtccgtcaactccgggttatggccctaccccccatccttggtctccctgcaaggcggaatgggagacatgcccaacagaggaggaaggctggcagtggggtggggcatctggcctcggtcaccctctcaactctccccctgaactgcccctctccgatacctccacctggcggtggcggccatatgcctggtggtattaggaggaaggacttcgtttccttctctagaatttagtctttcccgagtttactacccattccctgccccgaatctcccgaagtggaatccctccattcagatgttaacgaaagttctagaaaataggtcacttcagaagggtgaggatgaaggatatgctgagacttggagtgttgaggcaggaatcccctagaaggaagaccactctgcaccggggtactgtcattttgacacggaaacgataaaagaccccccgggctgtcttcatagtaaatggacatttgttctagacctttttacacccctagagttgcaactaagttgacttaagtctttttgaaaaacatatgctttgatgaatcacccgcttttctgtaaaatgggtcttgcagagttgttggaggaattatctatagtgcttatagagtaaaatgccaactacaaacagaagtagatgagaatttaggatctcatttttcctgttgaaagattaattgtgacttgtggacttttggagaccacagtttgatttccttccccccggatcatttcagaaagttttggattccaatatcgattctttaacagtaatggacattcacagatgtagagtaggaataccctcttgttgaagagcttcaatatcttaagcaagtgtaagtccatcgataacttgcgtggtttccattattcagtgtaggtaatgggtcctcaattgaagtttctttttttttttttttttttgagacagagtctcgctctgttgcccaggctggagtgcagtggtgtgatctcggctcactgcaacctccacctcctgggttcaagtgattctcgggcctcagccttcttggtagctaggattataggcgcgcatcaccacgcctggctattttttgtatttttagtagagactaggtttcaccatgttggccaggctgctctcaaactcctgacctcaactgatcacccacctcagcctcctaaagtgctgggattacaggagtgagctgttgggcccggcctgaagtttcattttaagaagaaatccagatatgtttggaagtcatcagacatatcatttggatacttctttagaaaaaagtttatttttactgagtggcctttcttgctctaagttgaagttgaatacacactttttcttacattaaattctaaacatttattgtgcaacttctaggatagaaagcatacatataaagcaggatcctctttttatgtatgctctaaatacttatctacttaaggacattaaatagtaataatataacacctttaagaaattttatattttcggtttatcatttgagacaagaaccttgtcaagatttacaagacatatattgtttatctctacttacatttcagcattgatcatattaaatgtcaagtggtagggacactccgtgatagaggaattcagaggaagaagagagagcttttacatggactagatagtggctagtggttggtggtgatgccaggcataggagtgccctcaacttgtgtatgtttgggtctgaggaagcctcttaggttcttaatttgtaaagctaattaaatatgttcagttgccctagttctttgaatatgctcattgtttttttttccctcttgtagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgaggtaagtggtaaattagccccacacaaatgaaacccgtggaactctagttgtctaatttcactgaataaaatagtggaagtttgatataattttgaatttttacagtgtgatgttttggcagattctggataagatctaccacttagatgactatgccttagtttcctcatctttaagttagggataatagtaatatgtaacacatggttattaaggttgttgtgaagattattttatgaaataacataggaagtgcttagaatagtgtaatatgtagtaaaacacacatgtcagctattggattttactatttcttaaatttgtcttccaatttttctcctttttttgtttttaattttatttatttatttgtagagacagggtctcactatgttgcccacgctggtcttgaactcctgggctcaagcaatcctcctgccttggcctcccagagtggccacacctggcattacaggtgtgagccacggcatccagccttttttccttctaaagtttaaaaatttttaagtgaataccagagggataaggaggaaggaaggagagaggagtaggattcaaaccacatcccactcctcctaacaatatgtgaagaaaatcagtgtaaattttaggataacttcaaatgaaaggaagaagagtttttaatgaatagctgtacaggcgttgagtgtataacctgagaaaggatgttaactcataagcacttaacaaagggaattaggaaaaggttggcttgagagaatacaggtagtgctcacaaagtattaagaaacactacttagtaattgcctgacaaaatacttgaaatgtatagtaaggctgctgaatatattgtgttgaatattcttagaaagctgaacagaaaataacattgcaaatctttgtttttcaagatcccaagtctcattttaagagcagatttaaataaattatcttgatttattttttcaaagctcagttgtgggtgcatcactgtttattatataatttacacttacatgtatgcctgaaatatttcattatgaaaacactgttttaaaagtctttttaagcacaagttttttgtttgttttttgttttttttttagttagttctatcatcttagtgtagatattgctgctgaatcagaatgggagaggcgtattctgtgatggtaataactaccttttatgggccaggtactgtgctagtaattgttgtgcatatctgactcaccctaggggtaggtattaccatctcattttacaaatgaaggaatagggtttcagatattaaatcacttgcccaaagtcccatggcttgtaagtgctagaggtgggatttcattttatattttccaactctaaagcccaaacagtttgtaactcttgtgccgccttagcctccgaagtatgaattttatatactacaatctaattttaaaactggtatagttaaaaatactatgagccaatgctcagtcacatggctagtagggaaaacaggaacctgacaggtcattccaactaattcaggctaatttttaaataaacttgtgtgatataccaaggcagatccctgtcctatactgttctccatgagatatacccaagatcatcagaagcatttggaatttaactgggtaaagagagtgtcacccagcagctgctgagcaagaaatgaactagaacggctgattgctaattatatgttgtgcatcctgttttttgtcagcttgaaaatagtgtctttactcttttgttatttggaaatgaattctttttttctcatcagtgatgatttctttctttaaaaactgacatcaggcaaggaaatgctagatggttttgtctttatttttgagagtaattgttcaaaggagagagtccagagacctggattctaggcttagttctcttagcaattctgtataaaccctgggaaccatctaacttcactgggttgatctgtaaaataaagtagttgaactagatggtttccttgttctcttcagctatgaaatgctcctcaaatgtcatctgattgaaagatcacaaagactgaggcaggaggacctgggttttgtctctctctctctctcttttttttttcctgaaatactttaataagaatgatatctgtctcttactagctaagtgactggttaagtcttggatcttcagctgggcgtggtggctcacgcctgtaatcccagcactttgggaggccgaagcaggtggatcacgaggtcaggagatcaagaccatcctggctaacacggtgaaaccccgtctctactaaaaatacaaaaaattagccgtgcgtggtggcgggcgcctgtagtcccagccactcgggaggctgaggcaggagaatggcgtgaacccgggaggcggagctggcagtgagcccagatcacgccactgcactccagcctgggtgacagagcgagactctgtctcaaaaaaaaaaaaaagtcttggatcttctttgatctttagaccctttatcgctctctctttttttttttttccttgacgcctggctaattttttgtatttttagtggagacggggtttcaccatgttagccaggatggtctcgatatcctgaccttgtgatccacccacctcggcctcccaaagtgctgggattacaggcttgagccatgtgcccggcccccctttatctcttagatagtaataatatcagacctaactaccttaccaggttgctgtgagaatcagatgaaatagtagtaaatgagaagcatgctgaaaaattctaaagcaaaatataactgtaaaatgtataattgctctaagttcttacatagtgaaattgtttccatatttaaactatttgatggaaatgtagtttattgaatgagaaatttctggaatacatgtacttacatatttcagtaccataattattaaatgcatttaatgtgttgggatagtaattgtttatgaatattagtactgtattaaatgttaataaaacctaatatgttttttcaaaataatgtgctagtgacttttttagtgttagggattgattttgttcttggctttggtagagagtgctttttggttattctctggctgatggagaaataaaaaacgttaaagccatttagttaataatggagatgcaccagagttttttaagtaaaatgaatttctaaactaagattaagatctagtaaaattttcataaggtattttcagatagtttcctgtaaaattgaagatttcttctcttagctaaacagttttctatgattatctggcctcatcaatactcatagcttcaagaagatatactactaacaatttagactaaatatactgctaacaattcagttagtctaacccaatattttgaaaaagtaacaaataatttatttgtattcagatgatgttacataagaaagtcccttaggatgacctgcatgttctttttcgtcattactaaatgcagtctaagggccgggcatggtggctcacgcctgtaatcccagcattttgagaggctgaggtgggcagatcacttgaggtcaggagttcaagaccagcctggccaacatggtgaaaccccatctctactaaaaacacaaaaattagccaggcatggtggcatgtgcctgtagtcccagctactcaggcggctgaggcaggagaatcgcttgaacctgggaggtggagcttgaagtgagccaagattacgccactgcactccagcctgggcaacagagcaagactgtgtcaaaaaaaaaaaaaaaaattagctggttgtagtggtgtactcctgtaatcccagctacttgggaggctgaggcacgagaaacacttgaacctgggaggcagaggttgcagtgagctgagatcacaccactgcactccagcctggggaacagagcaagaccctatctcaacaaaggggaaaaaaaagtagtctaaggacagatgataggaactaggtagtcctggagagactggagttataacccacaggctcctctacgaacatgaaatttctttgaaatattgtgtcttatcttaaaagttcacggaccagtgttatgttcatggaacttttgcattctattctgtaaatacatctgtattttaatatgaaatagatttttaaagttattcactggcaaaattactattccaggaaggtgttacctattacttattcctggcgtatagataactacctacttcatttggaaagctacagataatgtgccatatttgctttattaaaatccaacaaaattggccgggcgcggtggctcacgcctgtaatcccagcactttgggaggctgaggcaggcggatcacgaggtgaggagatcgagaccatcctggctaacacggtgaaaccccgtctctactaaaagtacaaaaaattagccgggcgtggtggcgggcgcctgtagtccaaactactcgggaggctgagccaggagaatggcatgaacccaggaggtggagcttgcagtgagccgagatggcaccactgcactccagcctgggaaacagtgcaagattccgtctcaaaaaaaaaaaaaaaaaaaaaaaaatccaacaaaatagagcataattttatttttttattttctttcttttttatttttttgaaatggagtctcactctggtgcccaggctggagtggagtggcacaatcttggctctctgcaaccttcgcctcctgggttgaagcaattctcctgcctcagcctcctgagtagctgggactacaggcatgtgccaccatgcccaactaatttttgtatttctagtggagacggggtttcactgtgttggccaggctggtcttgaattcctgacctcaggtgatttgcctgccttagcctctcaaagtgctgggattacaggcatgagccaccacgcctggcctgtaatttttaaagataaatgttcaattaatattattaacatctctaagctcttagatatgagattctgcctttatcttgtggaattataaccatcattcttttataccttttgaattttcagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtacagacattaaaacttgctattgtttatgtcaaaatagccctggaaaggttgaaaattaatagtgtaaacttaatcatgaacattttggagacaaactatggatgttcatgtttgctggccatggcttttgtctcattgagcaataagagatcagatgtcaatagcactataaaggaacttctccagatatgagtatttggctctataaaagagagcatttgcaccttttctgttttaaaaaaaaaatggaggaaggagaaattatgtgttttcttacatacatgtatgtaacacacctataaggaaatataataaaaaagtgatactatacatagcctacatggatactctttatctatctggccattaagtggtagtatttcattaagatacatgaaatttaaattgatgcacaaaatattaaagtatgatattttcacaggattacaggtggtttgttttcccttacaattcccaggttttttgttttgtttttgagacagagtctcactctgtcacccagattagagcacagtggtgcaatcacagctcactgtatccttgaattcttgggctcaagcaattctcacacctcagcctcctgagtagctgggaccacaggtgcatgccaccacacccagctaattaaaacaaaatttttttgtgtggagatgagttctctctatgttgctcaggctggtctcaagctcgtgggctcgagtgatcctcccaccttgcctcccagaatgctggaattataggcacgagccaccgttcctggtccccagtttttcttttttaacattcagttatgttttcagtttttatatatacataattgacacacttttagtttttaatacatgatttaaacagtgtgaagcttttgcattagtgcatagccataacattaaaatactctgaacttttcaattagataaatatgagatttgttattactatcttctccttttctttcactctagtcttttagtaagttttcatgtagagtagaaaatggatacattatgctgaattcgcaattggttttatagtttgattcccaagagttttataggcatttttgttgaattgtgccaggtctctggatgtgattcatcttgcaatactcattttaaagattaagcagagacaggtgtaaaggtcttgctgaaagtggcacagtacataagccagaaatagagtttaagttccttaagcatagaatttctaatctgtttcttaggtgttgaaacaagggttcatctgataacatgtagagaagatgctgagatacaagaatatatcctagatcacacctgtccaactattctaaagtgtttgctgcctgtgtctgtcctaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtacggatttgtcttgatgttatggtttcttcaagattgggcaattacaaaacttgcaaataggatgcagttacttaccatcagggcttcataattaagtgtgcattttggctcaaagatttcattaacccctcctgtaccaaatttatttgcatttttatggagagggagtttgccactttcttcaattagatatatgatcccagtgggtaagaatcactattcaacagagtatagaataagcagaaattggaagtaaagtaggtatctgtagaccacttctctattacccgttcactcatttcacaaacatttattgagaatatctactatgtagcacttaactatgccaggtgctacagatccccaagtgggtaaatatagttcttgctttcagaaaattcacaacctgctagtagagacagagatatagacaaaaaaaatgttataaagaggatcatgagaatagtgagcctatacaaagtaaggacattacatagaagaaagaagaataaacctttgctcaggagtggatcagaaatgaagagacaaaagtttggaagtgaggatctacagaagcaggagccaaatcataactgtcttgtgaggatgcagcggttggaagggagggacacatgaactggatgttaaaggaatagtaggccaggtgcagtggcctatgcctgtaatcccagcactttgggaggctgaggcagaactgcttgtgtccaggagtttgatactagcctgggcaacatggcaaaaccctgtctctacaaaaaaataaaattagcctggcatggtggtgagcacctgtggtcccagctacttgagaggctgaggtgggaggatctctggagcctgggagtttgaggctgcagtgagccatgatcgcaccactgcactctagcctaggcaacagagggagaccctgtctcttgcgggggaagaaggaataatacttcacctaccagggggatactacctgtgccaggcaggcattcagtgacttaacctacacagaagaaaagtcaatcctaattctaaatcagagtaccagtagcagagttttattgcatataggtttgtagttaggctgagaattggagtgagaagtccaatatagttattagatgtctttgaagcccatagtattgatctccagtggtccaattctttaattttttttttttttcttctgagatggtctcactctgtcacccaggctggagtgcagtgatgcaattatggctcactgcagcctggatgtctgagctcaagcagctctcccacctcatcctcctgtgtagctggaactgcacatcaccacaccgggctaattttttaaaatttttgttgagatggggtctcgctgtgttgcccaggctggtcttgaactgctaggctcaagcaatgctaggctcaggcaataccatttaaagaaagcctctaatatacttccataaactaaatgattactctctcctgatttattttgttaaaactaggatatttgtgtaatataataacaggtcttaagtatacttcttccaggctggagtgcagtggtgtgatctcagctcactgtaaccttcaccttctgggttcaagtgattctcctgcctcggcctcccaggtagctgggactacaggcgcccaccactacaccagctaatttttgtatttttagcagagacggagtttcactattgtggccaggctgctctggaactcctgacatcagccacttcagcctcctaaaatgctgagattataagtgtgagccacggctcctggccttaagtatatttcttatcaaattttagccaagtgtttctttacacctttctctagtgactgttctgagggaaaatggattagagcacattggtcacattggttccaactgtagaggaattattttccagcctgacatactgggctctgtatcagcccagagaagctgctgttgcaaatgctattgagtcaagaatttgctaaaatcttagttctcagcctcttagtgtaggacattgtatccttgtgctgaagtggcaggcatagccaaaaaacatattcatcagacttggaaactggcaattcactagaatatcttgatttttcttgatttgtacacatattggaaaatacaatgaatagaatgagcactacagatttgacgttcactacatataatagctaatacttattcagcatttactgttggttcacttactaaatacttgttgaacacttactgtgtgcccagaacatttccatgtgctgcagatcaaattatgaacaaaacaaaaatccctgtccactggagcttccattctagtggcaccattcttggtatttttatctcatttaattctcacatcttcatttttcacaggaggaaagtgaagattggagtttaaccatcataccaccactagtaagtggtagagccaggtttcaaattcgagtagtctggctccagagtctcttctcttaatcactcaactatgagctcgtcatgttttcagtttgtttctaattgtccaaatcaggaaataatcatagaagtcatttcttttggaactatacaggctttggaataaaactggatggggcagagagaacaaataactaaccttatttagaagcttaaatgaaaaacagcttgagaactcttatgtgtagtttttttttaagtgtgtgtcaagactgccctttgctttttttctggaaagaaagcaagtgacatatatttttctgttccctataccagccagaaataggaaccagatgtctgactcccagttgctattgctccctcttattaaataaaataatagtacttaaaacaatgggaagcaggatgtcatattggttaaaacagcatgggttttagagtccaactgggatttagtcttggctgggtggcatgtgttacctaaccactaattttcagtttcctcttctataaaatgtagatattagtgctgagtacacaggactgttctgagcataaaataagaacgccagtacctaatactcaagagaattctttgtgaaaatgtattgtggagaaaatctatttttctctgtagtgaggcattaatgtttgggttttttcttccctgttagctgtttttctgcaattctaatttattctatcttctgctcatgattgtctgctcatggctagtctgagggcagtggtgtttacaactgttgaccacaatcagttacagatttctttcttcttgctccacacctgctgcttcatgtgattagtctttttttttttttttttttagacggagtttcgctcttgtcgcccaggctggagtgtaatggcacgatctcggctcaccgcaatctctgcctcctgggttcaaacgattctcctgcctcagcctcccaagtagctgggaccacaggcgtgcgcaccacacctggctaatttttgtatttttagtagagactgggtttcaccatcttggccaggctcgtctcaaactcctgacctcgtgatccacccgcctcggcctcccaaagtgctgagattacaggcgtgagccaccacgcccagcccatttgattagtcttaaaaacgcaaactaaaaaacctctgctcatgattgaaaaactctatctttaaattgatatatctaatttaacctagaatgtgtcagagtctatcatgtatctgcttaaaactattttccaatcatataaaagttttaagttaagatcaaggacatcttctataccctcccctgcatcttatccaacaattgcctgggttagtttaacttcccaagtatttctccagtggctcaccactgccacaactatagtccagtaagcaccgtcaccttttgcctaatgtaccagagcagcatctaacctcttctagctcttggccctttaaactgttctacccacagtagccaggataatctttacaaaacatcaatatgatcatatcactagcctgcttgaaaccttcggatgatttcaagttgctctgagagtcaaatccagtattctaatgctctctgtacctggcccttgcttaactctccagcttcatattttactcctctatcaccctcattcactctgctacactagccttctagtcatttcctcaagctgccagttcttttttgctgtagaacagagctgttcaatagtacattctatgaagatggaagtactctatatctatagtgtctggtttgctcccgctagccccgtgttgctgttgggcacttgaaatgtggctaatgcaactgagaagctgatttttaatttagttttaattacggtgaatgtaaatagccacgcatgggtagtgtattggacaatgcatttctagtgctttttagtgtgctcttctgtctgcctcggagtactctcttactccccctggctaactgctactcatccatcagatttcaatttgttgcttcttccgggaggccttccttgcctcaccagtctaaactaggaaatctcatgttgttctgtctcatagccccagtacctttcctatgtagtatgcaataatagtgagattgttcatttttctgatttagcagtttgactccccatttaagagcaaggatcatatctgatttgttcaccatatctgatttgttcaccattgtgtaatcagtttccaggacagtgcctggcagttaagagtggggttcagtaaagccctcaaatgaatgaactttgtgaaacatctgcgtttttagagtatcacagttcttaggaaaagttttttttatctattcacagtgacactctgaaaggtatctcccagaatatgtactctgtaggggctggtagaaggggcacaggacctctattcaggtgtctgtctttgggaagtcctaggtgttattatatacctaagtccttccagtgatgtagtgtaggtttttttagagtgtatctcacattatctaattggtcatatgtatgcttagatctaagttccccagatgattaattaaatatatcttctcaaatagcatagtgcgtaatacacagtagttccttgaaggctaattgataatgcttttctttcttgttttttttttaagacatttattcagcatcaccatcagactattacatttagcaatcaacagcatgggtgccaaaaaaaaaaaaatctgcattaaaaccctttgttggaatgctttacgctttccacagaacagaaactaaaataacctgttacacaattagtcacaaatacagtcctcgagttttttgcccatacacatgagtatttgtctaaaacatgtctcctttgtagcagttaggccctgccaccactgtgcttggctgagttcacaaatctgttgtaacctgtagcttccctgtcacttctccggctctcctctccagctaagctttgtttcctaattaaaatcttctgccactgccatagctactgctgctactgaaaccaccatagccaccttggtttcgtggtttggcagagtattggcctccaccgccataggggcccagagcttctgcctccaaagtttcctcccttcatgggtccaaaatttgaagactgattattgtagttgccaaaatcactgtagcttccaccacctccaaaattgcttccatcattaccaaatccattatcgccatcctcactgccaccatatccaccaccaccaccacggctgtcatgccaaccgaaaccacctccacgaccaaaccaaagtttccagaaccacttcgacttctttggctggatgaagcactagccatctcttactttgacagggctttcctaacttcacagttatggccattcgtaggatggtatttctgaatggcagtcttattcacagagtcatggtcatcaaaggttacaaaggcaaagccccttttcttgccactgcctcagtcagtcatgatttcaatcacttccgtttttccaaactgttcaaattatctcttaggtgatgttcttcagtgtcttctttaatgctgccaacaaatatctttttcacagttaagtgagcacctggtctttgagaatcttcccttgaaacagctctctttggttctccaactcttccatccaccttgtgtggccttgcattcatggctgcatccacctcctccacaatggcatatgtgacaaacccaaagcccctggagcacttggtgtttgggtctctcattaccacacagtccgtgagcattccccattgctcaaaatagctcctcaggctttcttcattggttatttcaaagctcaaccctccaatgaagagcttcctcagctgtttgggctctttaggagactctgacttagacatgacggcagggaggagagagactttaaagatgcttcttcggcggcgtccacaggcagaaaggcgataatgcttttgaaaactgcaacatagtgatgttagagaagctcctgcttcagaggcttgggtgaacagtttgaggggtgagcctggagatcattagataacaattatgacttaaaattatttcaagagctgacttcgaataaggcaacagattcccccacctgccttccttaaagttatagagaagaccagaagcaattcaggaatgggaaaaattctgaaacgaaggccaatacgtgactggtgatttattaggtactatctatcttagagagagagagagagagagagatacatatatatatatgtgtgtgtgtatatatatatattttttttttaacccaaattgactataattcttttcctggtctgttagctgtgtctgaaaaaaattgttttcccaagagcctagctatttctggaagatgggaaataatggtggtgggcaatgggaagcaggaaggaaaaagtgaacgtggttacgttttgagatggtgagctaattggaaaagtaggatccacggtgtgtaattatacatttacaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgaggtaagtagtgcaacactctcaggatccaaaaccttgacggactcttaccttagtgttatgtattcaaaattgagtattttaatgtaggcacagagtctcctgttttgcctctctaggaatgccagtgagagtggtgctgggtagtccccaagcatatttctaagaaaagcgaatttcttggcaagtcaggctcttgacacaaatgaaaatctgtggttcaattttgtgttttgctgtctgttttacatgcctctgagtgttttatataaacacttgataataaactttgtccccttctccattaaacataaattgttccaaattgcccttatgccacacttagcaagcctcttcatttttgacttctggtaaagccagcatgaaaggagtttgatgcattttagtgtcaactttaatcatatcatgttgagtttatttataaaagtgtttctccaacttaagttctctgtgatactttttcataatttttaccatatataccacctgtgttgcctggaccatacttcgagggagcattgatttataatatgtaggtaacccagcaagaagagttcctcttgctggcccagccctagatctcttagttaactacaaacagtttttcagttgttcacattagaaaagttgcagcatggtcagtgtcacatctcaaactctttttctcctgtttgtgatttctgtctttcttacaaccaattcacatatcccttgtgtctagttctttacattgtgtttaggagcacagactctggaaccagactcgggcctgaaatcccaaattcaccacttactctgtgaacttaatatgtcttaatatatttgtgccttagctttcttatgtgtaaaacagggatgataatagtacgttcctcataggttcttgttagcattgagtaagttactatgtgaaaacttttaaaaccaagtctttgtacataagtgtttactactatttattgtttgttttcctttccagttcgactaagaacttcttgggtcaggttaatagaggtgccatttaattagagctgtgtcctttagggtcccaacaggaaacagatgctatactcaaaacaggacaattttagaagagttttttttaataaagaagctgtttacaaaggcgcaagttcagagaaacaacaaaagacagtgaaataacctggatctaggacataagctattaacaacccctaagcctgaagggacaaggttgaggagtggttactagaaccttaaaggaaagagaatcgtgtagagtcactgccttgagagaaaccttgacctttggttgggctgatcccaaccagaagctagaaggcataggaagccctattgacacagttcatataggccagtcttctgagccagagagcagagtggaaaaaggtacagagtgagttgggaggcaaatgaaagatgtccagtacagagctgtcagaaatagacaatggtaattacaacaggactgtgaaccttgggggagatatttcagacaaaatatgattcttcctgtcacccagaaaataacagaatctttttggttttccccttaaaattcttattagttattatgtacttgtgtttgcataatccctggaagggcatccaaactatgtaaaaatagttaaatgtaagcgctgcgatagatgggaaatactgctcaacatatctgtttatatcatttgatttttgatccatctagtatgttatctatttttcaagtaaattttaaaaatcatttctggaaaccgagagcatggttactaccagcaatactcctggaatcacagggctttgcaaactggttttctgtagtcagaagttaattatttgcatgtgctctttgtactcttatagtattacaggtatccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggtaagctggtatctcggcagaatgaggggatgcttttcaactacttcttgcaggtgacaacatagttgaaaataatactctataagaagtacagacacctcgtttcagaccttttcttctatcatctcagacaagtcactttaccactctaagctttctttcctataaatcaaggatgtcttctctatctacttcacataattatttggaaattaaatgagataaaatataaaagcactttatacattgtcaggcattacataatatgttacaattttttgtcaatattatttagattctgtgaattagagataattttagtgccacataatggcaggtaagtagtatatgcttccacccacctcttcacttccccttatgtggtttttccattccggaatgaagagaggaagaaaaggagcccagtgtggtagaaagtacatgggttttggcagttactgttggtgcaggtaccagtttacctcgtactagatttattaacttgggcaggaaccttaacctctgtgtgcttcagttgcctcatctgtaaatggaatcatcgtagcacctgcctgtaacattgttatgaagagtaaataaagttatttatgtaaagccttaaaacacttcttggcacataataactatgtgtattagctattatcttagcaaatagacctaggttcaaatccaagccccagcaatgactggttgggcaaggtatcaatttatctgagcctgtatgtctaccactaagatgagagttagtgtcttatctcagtgttgggaggattgaatgagataatgtatataagatacctaacactatagctggcacacactaaatactcagatatcaccatactttccacttcctattctctttgcttcactgtccaaaagcctaggtgtatagtgtataaaaacattttataagttatgaattactctatatgtatggggtggtattttgttttattgtttccttttatctgactgaggactcatgatgcgtgctaaggtgttagttgataattaagctgctcactgatgggtttaggtagaatggtgatttatccgctatattttattttttttaatagaaatgaggtctcactatgttgcccagggtggagtgcagtggcgtgatctcggttcactgcagccttagcctcctggactcaagcagtcttcccacctcagcctcccaagtagctgggaccgcaggcacgtgccaccatgcctggctaatttttatatttttttgtagagacagagccttcctttgttgcccaggctgggtcttgaactcctggactcaagcagttcacctgccttggcctcccaaagtgctgggattacaggcctcccatatatatatatataatttttttccttttttttttttttttaagacagagtcttgctctgtcacccagactggagtgcagtggtgcaatcttggctcactacaacctctcccaggttcaagcaattcttgtgcctcagactcccgagtagctgggacaacaggcgactgccaccatccctggctaatttttgtatttttggtagagacagggtttctccatgttgaccaggctggtctctaactcctggctgcaattgatccacccaccttggcctcccaaagtgctgggattacaggcatgagccaccatgcctggctccctctcctatattttttaatggcataagtactgcatgttcaatgtagaacttgtagaaatacagagaagcaaaaaataaataaaaatcatccataatcttaccactcaaagatactgcatttttttaaaaagagaacttttagatagggcattgtagatggtattttctactactgcaagatgacaaaatgtgatctgtgtttcatatgctttatacacagatacatatcaacacaagatagattgaaggactgaatggtgaaaaactatgagaatattagaagaaattataggaaaatatttgtataccttctggatggaagtcttttttttcttttttgtaaaatatatgtaacaggccgggcacggtgtctcacacctgtaatcccagcactttgggaggccaaggtgggcagatcacttgaggtcagtagttcgagaccagcctggccaacatggtgaaaccccatgtctactaaaaatacaaaaattagctgagtgtggtggtgcacacctgtaatcccagctactctggaggctgaggcaggagaatcgcttgaacccgggaggcggaggttgcagtgagccaagattgcaccattgtactccagcctgggcgacagagtgagactccatctcaaaaataaataaattaattaaataaaatatatttagcataaaatttaccatcttaaccatttttacatgtacagttgactcatgttaaatacattgttatacaatcaatctctgtaactctttttgtcttaacaagactgaaactctgtacccattaaacaataaactcccaattttgcctttcctcccagggtaggaacttttttttttttttttttttttttgagacgaagcgttgctcttgttgcccaggctggagtgcagtggcataatctttgctcactgcaacctctgtctcctgggttcaagcgattctcctgcctcagcctcccaagtagctgggattacaggtgtgtgccaccacgcctggctaattttttgtattttttagtagagacggggtttcaccacgttggccaggctggtctcggactcctgacgtcaggtgatccgcccacctcagcctcctaaagtgctgggattacgggcatgagccaccgcgcctggccattacttttgttttttaaaaaataattattatttttaaaaattgggttgggtggccgggcgcggtggctcatgcccgtaatcccagcactttgggaggccgaggcgggtggatcacgaggtcaggagatcgagaccatccaggctaacacggtgaaaccccgtatctactaaaaatacaaaaaaaaaaaaaaaaaaaaaaaagccaggtgtggtggcgggcacctgtagttcaagctactcaggaggctgaggcaggagaatggcgtgaacccaggagatggagcctgcagtaagctgagatcacgccactgcactccagcctgggcgacagagtgagactctgtctaaaaaaaaatcgggttgggtatccctaatctgaaaatcttgaaattcaaaatgctccaagatctaaaactttgagtgccaacataatgctcaaaggaaatgctcattgaagcattttggatttggggtttctgaattagggatgcgcaaatagttgtgcaaagaaataatgcagatattacaaaaatccaaaagtgtctgaaatctgtagcgcttcttgtcgtaagcatttcagataagggttactcaacctataccatgaaagccagtgatgtagtggaaagaacctggcactaggagataagacattttgcttactttgatttttactccaatttccgacactcactctagtaacttgctgtttggacaagtcctttaacttctctgggttaccagttctttatatcaacagagttaatgttcagtcactaaggtactttccaacacagaaaaatgtttcctttttgcatgatagcactcattatttgcttattaaattgaactaaaagctaatgaaaatttttgtgaatcagtaaacccagaagattctttggaggtacatttcttgcatatctctgaacaggcagcagaaggggctcctgcttggttagagaacttgcttattgccctgaccttaagggattaaactataaatctatatatcttcatagtcttgaggttatttttcagaagttctagaagggaaatgctgaagcagtttccaattagattcttagtatcgctttgtcagtgccttagcaggtagattgttcttaccatcatgtcctctacccatctctatgcatattggctgctaaaccagctaccaggataatgactcttctgcatacagcagaaggaaattaaattgacagccaagttaaaatagcctgccaaataagggatttttagttattaaccttacccattactgtctcaaagaagatataatggaaattacttttctaatttgtggctgtctccttttttgaactaaagatcagtgcaaatggaaatgtgagtctctgaaccctgttattttagcagtcctgcatctgccttatttctctaacaacgtgtcacagcacacacacactccccttcccctctttctaaaaataatgaccatgccactgccaggttcttcagttttagaaatgtgctttttcacactgttcttgtaagatgtcctagacaagcttttctcattaaaaagataaaaatctcacttaacaagtactccatcattggcagagaacaaacaggcttctttcaggttgactctttcactagcttttttttacacgagtcagattgtttgagtattggtctccaacttagggttaaaacattaaaaccttaggagttcttctggggaagaaggactttctaggcacaaaatagtggaagaaatgacaaagaataaaaacatatttgaataaataaaaaaatcatatacaaaattatgataaattaggaacataggtttggaacaaccctttaaagggttaaagggttggcctggcagggtgccttacgcctgtaatcccagcgctttgggaggctgaggcaggtggatcacctgagatcgggagtttgagaccagcctgaccaacatggagaaatcctgtctctactaaaaatacaaaattagccgggcttggtggcacatgcctgtaatcccagctactcgggaaattgcttgaacctgggaggtggagattgtggtgaaccaagatcgtgccattgcactccagcctgggcaacaagagcaaaactccatctcatagatagatagatagataaatagatagatagatagatagatacatagatagatagataaagggttaaagggttaaaaccatttgtgtgtaaagagctcataagaatgcatgagacagggccaagagcagtggctcacacctgtaatcccagcactttgagaggctgaggcaggcgatggagcccaggaattcgagaccagcctggccaacaggatgaaaccctgtctctactaaaagtataaaaattagccaggcatggtgacgcatgcctgtaatcccagctattggggaggttgaggcaggagaatcattttagcccaggaggcagaggttgcagtgagccaagatcacaccactgcactccagcctgggccacagagcaagacgccgtttcaaaaaaaaaaagaaaagaaaaaaattagtggtcccagctactagggaagctgaagtgggaggctaggaggatgcttgagcccaggaggtcgaggctgaggctgcagtgaaccataattgcaccagtgcactctagcctgggcagcagagcaagaccttgtctcaaaaaagaaaaaaaaaacaagaatgcatgagagaaacaataaagatttgagtgtacagttcgcagaagggcaagtaaagctggctactagatacaagggagggagttcaacctaattaataatagggtcttattagttataaagaattaaacataattttttgcctaccagagtgtcagagatttaaaaactatccagtgcctcagaaagtagaatgagttggcacctttatagtgttggtgggagtgtaattggtaacagcttcaaaaagtcaccttatgtctcaaagtaattttttttttttttttttttttttttgagacaaggtctcactctggctcctaggctagagtgcagtggcatgatcttggttcactgaaacttcactttctgggctcaagcaatcctcccacctcagcctcctcagtagctgggactacaggcgtatgccaccatggtgatctatttcatttgtttgtttgttttgatacaaggtctcactgtgtcactatagtgcaatggcatgattttggctcactgcagcgtccacttcctggactcaagtgatcctcccacctcagcctcccaggtagctgggacttgggactacaggtgtgcaccaccagacctggctaattttttgtatttttagtagagacagggttttgccatgctgctcaggctggtcttgatctcctgggttcatgtgatctgcctgctttggcctcccaaagtgctagggttacaggtgtgagccaccatgcctggctcaaaaaatttttttctaattcaggttcattactcagcattcttcccatttctttaagaaaacaaccaggaaaagtttcatattcaggatatttatcacagggttatttatgtgattgtttataacccaaaattataaaccctgaaatgcctaagaatattataaccatgtactaaaagagttattcatatatttggaaaatgaaaaacatcaggatacaatataatatggtcacatttgtaggtttttttgtttgtttgtttttggtgtttttttttttggacggagtctcgctctgttacccaggctggagggcaatggtgtgatctcggctcactgcagtctccacttcccaagttcaagcgattctcctgcctcagcctcccgagtagctgagattacaggcatgtgctaccatgtctggctgatttttgtattttcactagagatggggtttcaccatgttggccaggctggtctcgaactcctgacctcgtgatccactcatctcagcctcccaaagtgctgggattacaggcgctagccactgtgcccggcccccatttgtgttttataaatgtgcagaaacaaggctggaaggaaattatgttacattttggtgtgtctttgtattgtggaactatgggtaatttttttttcataatacctgtctgtattttccaagttttttagcagtaaaaatgtatattatatgttttataatcacaaggaaaatacttttcaattcttttcaacagggaggggtaatacgtgagtggggatggtgattatactagtccttgagttatttttaaattttctaaaagaaaatcatttttgtgctagaaaaagctgaacaggctaaataaagacttcagatttaactaaaattatatccattcagtgtgaaacactgttgctctcatagttatcaaaagctctgttggcagttgcggggaagttaattacttaaactcactttggtagacagtctgtcaaaacacaggatctgtcgggaaaaataatgaagagagtccttcacagcaaagaagtttgggaatcagtgatcgaaggatcccagccatttagagccataaaacccctgagtggctggtacagtggctcatgtctgtaatcccagcactttgggaggccgaagcagaagcatcgcttgagttcaggagttagagaccagcctgagcaacatagtgagacctcctctctttaaaaaattaaaaaaaaaaaaaaaaggtagctgggtttggtggcacacactgtgctcccagctgctcaggaggctgaggtaggaggattgcttgagcctgggaggtaggaggattgcttgagcctgggaggtcgatgctgtggtgagctgagattgtgccactgcactccagcctaggtgacagaggaaggccttgtcttttaaacagaacaaaacaaactcctttatacatcacaccaacacctcttacgaagttccactgtagacatatagttaccagagtgtttattgggaaaatttcagccaacaggaagtactgtcagttatctgtgtttttaatataatctatttcctttctacttcttttctcccacccttcaaaaggtgcctgaatgaaatcatatcaagaaagagaggggttttttctttattttatttttgagacagtcttgctttgtcacccaggctggagtgtagcggcatgatctcggctcactgcaacctccgcctcccaggttcaagtgattctcctgcctcagcctccggagtagctgggactacaaaatgcacaccaccacacctggctaatttttgtgtttgtatttgtgtttaatttttttgagacagagtcttgctctgtcacctaggctggagtgcagtggtgcgatctctgctcactgcaacctgcatctcccaggttcaagcgattctcgtgcctcaccctcccaagtagctgggactacaggtgtgtaccaccacacctggctaatttttgtattattagtagagatggggtttcaccatgttggccaggctggccttgaactcctgacctcaagtgatccacccgcctcggcctcccaaagtgctgtgattacaggcgtgagccaccacgcccagccttctttattttatgttactttattttattttttgagacaagttctcactctgttccccaggctggagtgcaggaacacgaccttgttcactgcagccttaacctcctggacttaagtgatcctcccatgtcagcctcaggagtagctgggactacaggcatttgccatcacacctggctatttttttttattatttttttctagatatgggagtctcaccatgttacccaaagtggcctcgaacccctgggcgcaaggaatctgcccactttggcctcccaaagtgctaggattatagtcatgagccactgtgcctgacttctttagatatatatatttatttttggggggttggggggtggggcagggagttatataaagcaacagaaataagagctgaaaaatcaatagaaaactttaaaatttgcatagcacaggaagtacctcttggttggtgtgggaatttttattcatacatacatcatctgctggcatattcatctacatgggaaatgtgtttggatagaaggatcacacttaccttgtctattcaagtcaggaagaaaagaggtggagtaagaaaaaggaataggtagggaaatagtgttcccaaagaagaaacaaataacttgtggtcctagcttctcccaacttgaagtaattttaggcagacataaaattacttcaatcactaaagaacccttcattcttatgctttgatttttttatttattattattattttttttttttttttttgagatggagtcttactctgttgcctagtctggagtgcagtggtgcaatctcggctcactgcaacctcttcctcagttcaagtgattctcccgcctcagcctcccaagtagctgagactacaggtgcgcatcactgcacccggctaatttttgtatttttagtagagacggggttttgccatgttagacaggctggtcttgaattcctgacctcagacaatttacctgctttggcctcccaaagtgctaggattacaggcatgagccacacctggccatgctttgattttcgaaggagctgactcctgagacctacttgctggctcactttggagagggtccactttatttggcaagtacataagacaagtgccctcttagaaaaactccgtggtttatgtgtgagtgtatatgttttattaagaaaaatctcaaacataaaaatagtaatataatgatcccccatacccatcactcaattttaacaattatcaacacatagctttttctttgagatggagttttgccttattgcccaggctggagtgtagtggcgctatctcagctcactacaacctccacttcctgggtttaagcattctcatgcctgagccacccgagtagttgggatttcaggtgtgcgccaccacactcagctaatttttgtatttttagtagagacggggttttgccttgttggctaggctggtctcaaactccttacctcaagtgatctgccagccttggcctcccaaagtgttgggattacaggcatgagccactgcacccaggctattttgaagcaaattccagactggatattattccatgcctatgtgtcatacttccacgtgtgtctctaaaagataaggaaaaaaaattctgccacatctagaatgccattatcactgtttaaaatcacacaattccttattctcacgtgtttgtgtaattttttttccataattttttgttgtttgtttttgagtacttatgttgttcaaatcagaatccagacaaagtccacacgttgctcgtgatttcatgtctcttttcagtctcgttttaatccaaaagtttccatcctgttttggtttttcccagccagtttatttcttgaagaagccaagctgttcgacctgtagaatttcccacattctagactctgctgttgcatctttgtagtgtcatttaacatgttcttctcccatgtattgcctgtaaactagtggttggattagaggcttgttaagagtcaggctcagttttttggaaaaaagacgaggtggtagtgtggtccttcctattcatcaccattaggaagcactcaatgtctcatagtaatatattggcttttgaaataatgattctagcccagcaattgatgataattgtcaaatccattacttcattaggggtttatctgtgtttcctgtcagcttcaaggtactacatttgctctttcaagtccaggttactcataagatcactttggtctcctagatgcttcctagtgattgaattttccaaagctccagctaactattctctccatgagttctaatggagcacatgcacaggggattttctcaaagagactttgctctttgaaaaaagccaaggcaggtgctgtggctcattcctgtaatcccagctacttgggaggctaaggcaggagtatcgcttgaggccgggagtttgagaccagcctgggcaatatagcaagaccctgtctccaaaagccaaggtaggaaatattttatcagagtaaggcgttaggggaaggggaagatataaaggctgtcagaatagcttctttgggaaaatagagaaaaagacttttcctttaaaactctagtcttttgttgcctggtggttttgatgaattggcagggaatgtgatcatatagttgactaaattggagaaggaagtgttcatggaaaagagattttaggccaggcacagtgactcattcctgtaatcccagcactttgggaggctgaggcaggagaatcactttaggctaggagtttgagatcagcctgggcaatatagcgagaccctttctcaattcagaaaaagaaaaagagattttaaatccatcacttggatcctaagtttcaacatgtagctttttttgtgacaaggttaggagagttctttccccattacaacaaaaaacctcccaatttgagtttttcaggctaagtgcagagagtgcctttaggctctcacctgcacttaagacctcaaggattatgtcagccagtcatctcaataggttgaaatggtgcagtgttgccgggcacagtgactcacacctgtaatcccagcactttgggaggtcgaggctggcggatcacttgaggttgggagttcgggaccagcctgaccaaccccatctctactaaaaatacaaaattagctgggcgtggtggcacagcctgtaatcccagctactcgggaggctgaggcaggagaatcacttgagcccaggaggcagaggttgtggtgagccgagatcatggaattgcattctagcctggtcaacaagagcgaaactctgtctccaaaaaaaaaaaaaaaaaaaaaaagaaaaagaaatggtgcagtgtcatgttgaagtttgctttctagagttttaatgtccagaaatttaagtttcagagactcgagagctacagcctcaaggaaaaataactccccattcgacagccttatgattatctcccatttcggattgcatccctcagccacataaaacaagacatcctagaactgtttctgttgacacttccctgtgactagttacccatccagggatgctgaactaacccatcttttttctgcctttgtcttcaggagccaatgaagtgcttttggtggttgggggctttggaagccagcagtctcccattgatgtggtagagaaatatgaccccaagactcaggagtggagctttttgccagtaaataatggtgaaaccattcgttgggagggatgttaaatgtcctcagtctctgcctccagatcatagctaatccagccttaagagtagaaaagcctaataacaggatgtttcttacaacagtcttgtgcatatagtaggtacttacttaacagtttttgactgtttagattagaagattatgccttagaaatgtcagtggccctgtgtcaaggtaaactcagatggccaccactagttaggtgcctttctaagctgtctgtataattcctagcacatttcattggtcgtgctgtgttaaactgaactgaatgttaaattgtgttgaattgaacccagtgttcagttgagctcagaagtttgggctgggcgtggtagctcacacctataatcccagccctttgggaggctgagatgggaggatctcttgaggccaggagttcaagaccagcctgggcaatatggtgagactctgtctctacaaaaaagtaaacaaaaaaattagccaggcatggtggtgcatgcctgtagtcctagctacttgggaggctgtggcagaagattgcttgagcccaggagttcgaggttgcagtgaactgtgattgtgccactgcactccagcctgggtgatagtgagatcccaactcagaaaaaaaaagtttgtatctgtctccctcagcatgtctctcagtgctgaatgaacaatagtaatttctgagaaaacatggaaatccaaccctcctaccttttaaggttcttataataaatcctcatcctttgattagcaatgtgggaatacttttctactttatggaaggatatcagtctcttagcccagtgccttatggaagagaaaggagtcagatattggataacagaaagctgttaaatcttttggaagccttggaaagaggcagagatgcagaaagcttgtatctttaagagcaccacaacaggcatttcgttcagtaggtagctatttgggagccacttgaggatgaaccacttaaggagggttcatgatgacaggtgaagaagcagagaggtgtgcagatacaacagggaagatagcaaaaggtaaggcccaaaacttgcctaactgaaatgctctgtacctcttctctccaaatccatagagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggaggtaggctggatgtgcagggcaattatttccatcttactgtggctggaccagggtttttaacctctcctgttgtctggcaggagcatgaaatacggagaaaaaattaaggtcaaatgttattattatttgagacagggtctctctctgttgcccaggctggagtgcagtggtgtgatcacggctcactgcagcctcaacctccccaagctcaagcgatcctcccacctcagcttcctgagtagctgggactacaggcatgcaccaccatgcccagctatatttttgtatttttagtagagatggggtttcgccatgttgcccaggctgatctctaactcctgagctcaagtgattgacccacctcggcctcccaaggtgctgggattacaggtgtgagccactgtgcccagccgacaaatactcctttttgctttcagaaatatcagtgtaatagaagctgttcaatattcatggatgtttcattattgactacaaagttggcaaatcaagttccaatgtgctgggtggggaactggcactagttgtgtttttgcaaactcctaggtggtctttgaatgcttttaaggattttgttttaccccattctttttagatgtcttccttgtctataaaacttaattgacttatctcatttaaaaatactttgtttttgctctcagacttttaaaggacccttggaaaatttgtagaggaaagagttcttagaaatctctcattctctaatagtctgtaatttgtttattctgagcagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggtattgagtctgggatgcaggaatgggagggaactcaatgggtaatgggctgtgggtaaggattcctttttaccaaaatgacgttcatagacttcccttcaactaaaaccctggtgtgtcttaatatattttccattaattgggattatctttttcttataagcataatgtcagatttctcttagagttattggaactcttgtgggaaaattgaaactaaaataattagttgaagcactcagaaaaaaaccgaccaggaatgggcatgaggatttaccactctttctggaatggtctctgtcttccaggaggatatgacggcttgaatatcttaaattcagttgagaaatacgaccctcatacaggacattggactaatgttacaccaatggccaccaagcgttctggtaagaccagatctgagggaggggacaataggcgatgctgtcagacctttacatatataatggtggtgcatgggacaaaccgtagattaatgtaaaaatgagattctgctctcctccttgtctctgttttctctaaatactaggataaagacagttgatacttacaactagattataaatttgaaagcaaaagccttcatgtctttgttctctccctacgttttagaatatctagtacaattttgcctgtgtagtacatgcttaataaatatctgttaaataaagtctctaatgcataaggacaaaagagtagctacttaccttcaccaagagctttttgaagtggagcaggctgggatatagaaaaggagagagcactgtgctgttctagtttacttactctgggtaaaaattgcttcagaaccataatcacaactcctttccctccatctacctttattgccacctttttttcacttcctccctttctcctaattagaagggttgggctctgagttaatgaaagtaaagaagagaaccatttttattatttatcttttatcatttcaagtccaagccaaagggtttatagatggaataacttgtgctggactagattattctaggcccgtgtgggcccattccatatccctcatctactgtagaactcagctagtcattagtgaccgtagtttatttctataattcagattctaggcttagtaccatacatttgctaatgcattcattttccccaggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcagggtgaggatttagaaacgaatccagactcaatatgtagccagagcaagagtctatgtgatctgatcctcatttttggacagagacaagacttgggtaggggtagacatctccagtggcaacttgattttttttattagattttttttattttttagagacagagtattgctctgtcacccaggctggagtctgagtagagtagctgggaccacaggtgcacgccactgtgccagactagttttttatgttgcctaggctggtctccaactcctgggctcaagcaatccttccacctcagtctcccaaagtgctaggattacaggtgagagtcaccatgcctggcctccagtggcagccttaatgaaggacttgtgtggaaaggaatagaaggctaatttctttctttctttctttaaattttattgagacagggtctcaccatgttgcccaggctggtctcaaattccctcctgggcttaagcaatcctcttacctcagcctcctgcatagttgggattacaggcacgtgccactgcacgcagctgactcatttctttcttttgcttctttcccactcagatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtctttttttttttttccaggaacaactacattttctcatatacaggtagctaggggcaacacagttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgccgagagtttgtggct

SEQ ID NO: 38584 - DNA, 45047 bp, Homo sapiens
cttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacggtagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggtaggtccagccgggatgcgggggtcccagcgctgatatcaggaggtaggtagaagggaatcttgctggtggctttgcttctccctcaaacctcctgcagctgtggatgtgtttaactgcttcttgcaggaaatccaaccagccttcaactctgctcctgtattcacgttagccccgcagaaatttttgccttaaatgccaagacttgcttaggtgatgatgaagacccagtagtgctgcatgtcatctagtctgaggtgttgtggcataggaacgtaaacataagaaggcacaaggatgcttggggaaatgatacagttaaatggggaaaaggaaggaaaacaaagttgcctttgggatcatgggtcttcttctttccagtgaaaataaaatataaccttgtcccacctaatggaaagggctggatggttcactcacggtactcactgttatccgatgaccttcttttgtaagtgtccacacctttttactagaatcccttctgttacacagaggatgagaaaactttctcaaggactctttttccaggttggattcctaatggagttcttacatgtccaccttggaatctcagttcctgggaaggaaggaatgtgggcgggccagcagggtacagagacccaatcagatgagaggacaaacttgtgaggttccttaacaactcctttgcttagtcgaccagtgcgtcgcaagcactgcccaggccaactccgccgcctagggagggtcacatcccgtttgcgtgtttgggttttggatgaatatgtttccgaagccccagtgcagaagatctgggcgaagagtcaagacagaaggaagaaatgttttcccagcatttcccccttttaagaaagatggttatggggaagcaaagaaatggatctttaaggctcagaggctcagggaggaacgcagtatctatttacacagtatttgaccactacgttagtgtgacatttacacaaaaagtctgggttggtttggggcctggcttgcgcatagttctaagcctcagttgtcacaactcgactctgattggcagttttaagttgtgcctcttaaatgcctggtaagaattgacttctaaagctcattctttaagtatttgagacccatccagaatagattaaggattacaaactttgaagtattatgtaaaatcatggtatgaaatgaagcaaacagaacaaggataggaaattaaatgatggattgcagactttagaatcacacagcttcgctacctaattcttctatttttactaaggcacccctggtatgaaggaaaagtgttgataaatttggagtagagaaacacttgtggttcatagggtggacattaatgtaaaccacatgtaaacaaagatgctggagggcggcagtttagggagagccaagcagcgcgcagtgctgtgcacaatggaaaacatttttttcctcattaagtgattttctggaagccatcctttaattcctctgcacaacattagtctttgaagcggtagaacattcatttgtagccttctctgcaaaatgaagttctgtaaaactatccatttcttgttaggtttccaagctcttttttttttttttttttttttttttttttttttttttttttttttggtaagcaactttccgtgtctggggttccttgctctgctacatcacaagaggatgccaagaaggaggctttggagagtttatggaaggaggttctctaaaggaagaggaagaaatacttttgtaagcatactgcgccaaggagtgggtcattttagtagttcactttcatttttaaacacaaatccacatttcataattttaaaataaataaaaattaatagaaggtctgttacttcctacctcctgccccataacattcctaattgtttcccagaaaacaggaaactactcagtgattctcaatgatttgtcgattactttttccgaatttgttttttgtttggatagttaactgtccctatttttccaaagtctgaaacttaacagcatattttaaatagatacaaagcaagggacaaataaattaatggtccatcttaatttttgtcagtattataaggacatgcatttttcaaactagtctacacatggaaaatatttcacatgggccctctctggtctccttgccaagcagaagcatacttttaggaaaacaaatttcatttgtggttggccctgtagtatacacatctaacttcacaagaagcaaatatttgaaatgcatgtgtattttcaatagatgcgcccaatttaaaagagtgttactaattagggggttgaaaaaaatttcaaggcatttatgcagcattcatttgagagtatttcacaatgcaaagtgaactttgcctaatacttcagagcatgaaaaaaaaaaagaagtctggaggagagatgatctgaggtcttccatctcatgaaaatcagattatcttaaggcccaaagaaaagctttcagagctatttccttttcaatgagaaatacccagagttggcaccaagattctacttttacaactctgttttgaatgtaagaagtgcgttgcttagcagccagacgccaagctatgaaatccatgttttgatgggctctgagtcctgctcaaatttaggtccagatgtcttctcctaaattgcttgttttttaggcatgaagcgaatgtacgaggatatgttttctacctctgtttactagctgaggccaccttgaaagttgcatctggaagtcagcagaatagagctagtaactcatttatcaaacgatcacacttcactgtcaggactgtacccagcactccagtactattctaattagagagagttagcaccagtcaatttcctggcataaaagctgttttcattctgaaatggcactaatgctggaattcacaccacttctgccatcaaacagtagaaatccaatctccccaggatttagctttgctttccagaatcctttccttgttctggacgtcctcttttatttcaagataatttcttcaaagacaaactcttacagtcgtttttttttagaccatttgctctttagaaacaaaagcctacctgcttgataacaaaataggaaattgtttaatatccctccaccccttcatgaaagcagcaaaaaccttactctttcatagattgaaacactgaattaaaatcgaaccaactaagagattgtgcaatataaaaagataattccctttcattaactatcaatatgccagttgatagatcactgtctcagctaaaactctgtacattctgccttagattgctgggaccgggtctccccacacggcatttctcctttaccacgtggctcctggcttgattctgacaacagggggcagtagaggaagaccagaagtttggaagagggagagggatgggctttttcttattggcttgctgcctggactaattcagtcacatatttgagctgaaatctcatttaaagtcaaaagtgaacccttgtcaaggaatcagagcctataggtcaatcctaatcaataaaaggataaataactcagaagtggggagactggtagcagactaagcagctctaattaacatttttacaataaactgtgagggatattatgaaaaatctaaaatctgtgcagtatctgcctacatgcacctcctatgtgtgagactcatgtaggcagtttaaggcagcgaggtagaaatacctgctccctgcccactaggcgtatccccagcagagtggaaacagatacacgtggaaatcacactactgttaggaaaactctgataaatcccatactgagatataaacaaagtctgtgaaaggaaaaggaaggtaacagttaattctgcctatggacctttctgtaggtctcattgcaaatgtagaattgaattggtcctcaaaggatggatagattggatttagattcagccagctgctattgagcatttcttatgtactatccatggccacaaactattttacaattaatcatttcaacaatctgtaaccattgtgtaattatcttgacagaattcatgtgaagagaaacaaagataaacttcttagactaacagctaacaaatggcagacagagaagacagtcctgtctagtgctctctaaactaaaagcattatcactaatttattcaaacctttaatatgctcctcgtaggcaaggagggattcagagatttaaaaagtagcccctttcttaagaatctattcctggaaacagacagggaaatggtcattgctgcacagcatgatggctcttacagtagatgtatttgtaaggtattatggaagtgcattagaagattgctcactccatctgagttcaattttgaagaaagagtgggagttagccagatacgtaaggaggagataggcattgcagacatcagcaaaccatcatgttcaatgggaaatggtaatagattagtttggagaagataataacaacccaactatggaaaaacaaaactatacactatgtctgctagtctgctcaggccaccgtaacagaatattgtacaatgggtggatttaaccaccgaagtatgtcttctcacagttctggagtccagaaagtccaagaccaaggctccagccaatttgatttctagtgagggctctcttcctgtcctataaatggccaccctctcactgtgtactcacaaagccttcccactgcctgcaagtagaaacagagtgaacactcttgggtatcacttcttctaaggacactaaccctatctgattagagtcctgtcctcatgacctcatttaacctcatttacctccttgtaggccctatctccaaatagatgagtttggagaggacacaattcagtctactccaccatgctgacaagttttaattgtaaattaagtgcaatggcaatcattgaaaagaacattagtaggaagacagcaatgatcagaggtgtgttctgaaatgaaccttctggtctaagtagtggactggatcctgggtgagcaggctgtttcagaaatcttcaagaggaggctcaaggtggtctaaactaaagcagtggcattaggaattgagaggcatagattgggtcaagaaatgttaggaagaggtggatgtgagtaaaaattctttgtagcagaaggaatgtcttgggctgagcttcagaggccaaaatattcatgagatatgcacaaaatagtggacagaatggagcaggaaggtacagtggaggcagacagaaagactgaggctgtagtgtgccaggttttgaatgccaggctaaggctgacatgaaggactggaggaatctaataagatctgtgctctaagaaggtgactgacttgagcatatagataaggaagttacaggaggaaaagggaccagttagaagtctcgggttataattcaggcaggaaataatagtagaaaaaaatgagaaatagaggacaactacagtgacttacagtggctaattagatgtgacaggtgagagaaggaggcgagttaatgatgtcaccagttttcttatccagtgcttccattttcttgttttctggaatatctttcacagtgtatttcatatatttagtatacctctaaattatctagtttttccaacacagcatagagagaaaaccaggatattctttatttgctgcaagaaagaaatttgcttaatcaagtgtagattatgaatacaaaagataagattaatgtcaagaataacgtatgtgatgacttaacaaaaccatggtgaagtaagttcaggattctgagtgtttagatacaggtttgaatttcagcttcagtatggacaaacttgagatttggagcatttaatgcccctgagctttaatttctttataaattggaatgcttttagttaatatcaggacatgtgtagctggaacaaaccctagagatgacctggaccaaactcctgatgttaatgatgagggaactttgtctcaaagcatgtaaatgatttacacagtgcttctcactaacagcattgaattaaaaagcaatctaccttccattcactctctaaccagcttccatttctctttaccagaatgactccgtcaagcatctactcccctgctccctgtctccaacttgctccatctcttcttccccttcttacctcacatttgtcagagaaagcttcctgacttggaactctgggcccagactctctttccagcttccctgctagccctctgctcaacagatcctgtgttccagccaaaacaaacttcttgtcattcccaaaagactctgccttttcccattccattatgtttccactagtccttccttgccagagtatccttcctcccaggctatcagatccactcacttccgtggagacacctttatggattccctcaaggagaattcatcaatgcctcttctgttctccctgaacaatctgttcataatggaagtcacagtttgctttgttcttgacatatctgttttgctccttagagcctgatgttccctaaagctcaggatcagatcttatttcatctatttaccacagtgtcagcacttccacagtgtctggcagattgtaggcacacaataattgttttaggaataaacacgtctggatctctgggaccctaatccatctgggctctgtgtgtttggtatcccttaggtgtatcaagagacaaggatagagattgtataaaatgggtcatcgtaaaggttggcataacagttccaattaatgtagtctctgctgaaatctaaaattaaaacccctattattggggactgctggataggtagccagaaaggcaaaggactcctcaagaatcaagaatcagatccacagaacaaatatgcatgcgtttgtgtgtgtgtgtgtatgtgctcttcccttgagctccatgcttgcccttaccaaggggtaagatctatagaaacagaagttgctattatttaactctgatataaggtgttcttccttaatttcagctgctgtggctgcagctgtgatggtatctacctgtgtcagcatttgtgttgcctctggctccctccctcagcgtatttgcactgcatgtgaaaacaatctctcagtcaagacaagaaatcctatgattcctgtgatttgtccaccttaggacatttgggtctgactggttcattttcaccacccagtactgcccactgggattttcaaagttcacactatcttctgagcatctgcttctcaaggcagcatcctttactggctccctgtcccccatcccatccccaagaagtgcccagtagatcttgggtattattacggcttcaaaattctgtgataaatcacaagcttggccatatttatagtctcctaaaaggtcatacctggtgaatggtcacagtgtcaatgaccttcctatcgaatctctgctggtggtgcagaccaccatgaatacacttctgagttagatacaatgtctcagtcttgtatcctggccaacaccataccacaaaaccactagataaatctctgcaacctttgcaaccttcatattttactaaatcttccactgcattactgtccacacagtagtgataagatattgatcttgcataaaacaagccttatttgatatgacaaagataatcacttaccttcagatctacactgaacaagcagataagcttttgtcagaacttttaattcgtttacctcttacatggtattgtatgtgattcacatctctccagtatctcctgcttccaggtctagattatatctatctatctatctatctatctatctatcatctatccatctatctatagacacacacacatatccgtgtatcacatatatgtgtgtgtatacatacacatatataatagcaaatgtgtatatatgtatacacatatacacatatactattgccccaataatatctttactcctgctcagaatttaagaatttaagaaagtattctataaacttcaaataaggtttacacctataaatgttgttagaaatcatcaacagaaagtagacatgaatgcgagatgctgtattcttaacaatttgacgcacattagttttaattcattgaaatgaacattgttcacaaagaaattcagatgttcattataagccttgaggctgaaactgtaactgtttgccaagatttgaaattgtgtgagtgaaatggaaaggttgccagtttacataattatagctacagaaatatatagtgtggctgagtagtcaaggagtttaatcagtgtggttaaaaaaataacaagtgcttctgttcataattttgtcacatttccgtggcaaaaggccaaatgcatttaatccaattcaaggatgacaaggagggttgatggcctctaatgagcaattgattagcagtaaacagagagatattaagaatctagtttaatctctatcgagaagaggagggtcatttccctttgctgtggctcttcatcttagcttatttatagagtaagaagggaaaatgtaattcttggattttattatttaaagataaataccccaaattgtgatataaacataaatcttgttttaaaaaaaatgtgtgcagatataacctagagtgtctagcagctcccttaaggcatgacctaggtttttggtcctagagatagtgaaatgattgtgggggaggggcttaaaaatgtattgtgctacattattatctcaaagactgattattatgcaaaagtgtgttccaatttcaatttgaaaaactactgatttgtactcaacagctgtaatttggcatcccatgggatgacatgggaggatatacaggaaactttggaaggctgttggttttgtgacatgattaaccaaggctatttggctgagatttccagtgtctaaagctacagtaacttggtggccacactgtaacttatctcagctgggaactcataataaacagaacacaataaggacctgagaatgaagttaagagaagagaatacagctgagtttctaaatactcttcaccttggtaggatttttatgcagcaaaatagcaaagggttagaagagtatgttgccattgagtatgtagcactggttatgtagtcacactgccttgtactggttgtctggagcctgctgaggtcctgctggcatacagcatattaaagatgtgggagcactataatgtatctgactgtaggtcacaactcaatgaaacaaatgtttgctgagttcctactatataagctggagaatatggaagttgggcatacaaaaatgattgttgtataatagaaacatttattattttaaccaataaacagttgtctttacaataattagtatatttttaaaacttttccttttagagttcctaacttatggcttactagaaacacgatcttgctctttgggaatataaatgagcacattgttagtaaattttcatggaaaattgtggtcaagcacaagaaatgctaatgtccattaatactcaaatagcatttaaagggaaagtttatcattatgaatctgtcatgtcaaaaagttgcggcttatattttctctttatgtttcatatctcaagaggcttgttgaggtccctttcatctaaattgatcatttttcaccattattggggtggaatcatgttcctatttgagaatctcttaaaagattacatgacatctatgaaaaactatgactttttaccagaaaaatgcatatattcatgtatacacaattaatatatgacatatattttctgcagattggtcaggttgagaaatgctacattaaatgttatgagtaagaaggtacagatttcagaagacacaacctatgaaattacagctcatttggggagtaaaagatgacctttcctcaaattatgaattaaaatttagttttctatccaaatttctaataaatttatactctgctgcagacgtctggctgcagtttgcccctgtaatagaaaacaaattataaggccagattttgataaatttagcatgaatttccatcagaattttaggactttcctaagcatgaccatatgggaaggtgatcagagacgtatctgcattacggctttgttaaagctgcgggtgctattgtaatagacaagttacaatcctaagacatctttttaaatgtaattgagttccattatccttctgtgtttctgggccccagagcagttcagaagagtctctgccttgagtttgcctttggaacgtttccagagaggaacaggtgataccataaacatatccctgttgccatttggggtaagcaagtggctctatgtggcggctccttctggatgtaaattgattttaatgatttctttctttctcctgggcaggatttatgtgggcatcattcatgtgacaccctgggaatggcagacgttgggaccatatgttctccagagcgcagctgtgctgtgattgaagacgatggcctccacgcagccttcactgtggctcacgaaatcggtatgcagcgccttttcttttccctcaccaaatcaaacacttgtaacagctgcaacaggaaccaaaatacttagcaattaattccagatttctcctggttcagatgtaccactgggaattaaatttgtttatatctgcacttttaaggttaactaatacgagcgacagggaaggcaaagtcagcaacacggtggatgttttcttctgacagtgtcatttaaaagttcaagagaaatttgctactgctactgccttcttactatctttttaagcatccgtaaatgacccctggatgaaatttgtcacaggcaactttggtatgcagagatgtccttcttagaagttactggagacagtactggctcatccagggctaatcagtttgcacagaaatttaacatgttttatttcattgtcagtgataattgtaggctcctgtcaaaggtcatcaatggcttatggtaaatatttctgtcttgttcttaatagcaaggaaaggaagccaagcctgacactcaacagggtttgctttaaaatgtcacttacctaatttgtttgttgtaagaaacacatctaaatcctacatctataaatagaggactgagttgattgctaaaaaatatttccaaaataaagaatatgtgcttcctaattattgacctagattactaggtgtatgagaaattggcttagtacatttaggactagatgttggaattagacacaattttttgtgtctaacttttttctgtctaattccaacatctagtcctaaatgagcccaatttttgctaaattactttatacctatgtcacactggtctaattatttaaactctctgagctccagttttcatatctgaaacatagggataatagtgcctatttcagggaattattttggggaatatattgggtagagtttagatagtagatgttatttatatccacatgtacttatgttttgctttttagctaaatagttcatttgcttttgaaatgtatgtatcaactcagcatcacatttttgggagcaaagcatggtttgataattatggtaccttttgccatctatagcaaaaaagattttgatttaaacagattttgatttttaaggttaaaattataacttttaaatgggaattaaaactacttttttacattcctaataggcagagaatattttcacaaagcatccatttctaactgctatgttttctttggggagttaaataacttctaatccaaggtacagtgtaattgcataattcacaatattgccgcagtaaaacagaattcagtagttaaatgtcagttcttaagtatggcattaatgttcctgacacgtttcttacctcctaagcagaaaaacacaaatataaaacctaaacgtaaataattatccaatagcatcactgagaataattcagtgttttattgattaggcgtctttggcttcagtagtcaaagatctgagtggagtcccagctctgtctctgggttctctgttttatctcagacaagtgatttagatactttgagtctccatttcttccctataaagtgggctaatgaggaggcatggctgtcttctcagctgcactagaagaactggtcagcctgaaagcgtctttataacacatgccatttaggctccagggtagggatcatgtctctcatttatgcctattaatccttactgataaaaacacagcctaatacagaaccttaatcaatatttattacgtatctatgtatgtgcttgactgcgtaagcgggagaaagaaacatgagacttgctcaaggcaacattccgatctgcaccggaaactaagaggaattagtccaaatactcaggaggatgtaattaaatagaggagacttttaaagtacactggtaattaatcaccatcattcagagtgagaggagtcccataagaaaggttctaagtccctggaaaggcagaagctgattcgtcacaggtcaagcggagaaattatggggaataagcagcagagctgaatgttggcgtcatccatccacaggattatgggctccaaatcttgatcttcaaaaggaaagattccacattccttaaaggaagggcagtttctttcctttctagtgattggttttcacacattgactgcatctgggagatttccctgtaagacaaacactgtggcaataagtgcagcttcttcagggatgctttgacctcaagttaactagggaggattgaagagccctgcagggtcacctttcccagctctcctgaattcctaaggcaatcttgggttacaaggctgatgcagcagtctgagaggcaggaagccagatgctgataagcacaaacgttatattaaaactaaatatatacatgtgtgtgtacacacacagtaagaacttttctcaatagtacaagaatattagacatagttatacaaggaaacaacgtaggagaaaggtgggcttctgtatgaaaactaaaacctaaatctttgatatatgattatgcccttctgtgcacttaaatttttggttggatcatctttgtttatttctttagaagtccctgtaattcattgcccaatcaaacactctctatttaacttcccttttgtattacatatgaactaatctgagctatttaaggtctggaagtgggggaatatggattcaattctgctttcataaaagaatctggttctcattcagtttattttctaatctctttattattctttaatttcactttttgcctaaatattatgaacatgtgttataaaaaataagccttcaacgtttaggaaagatagcctgacaaaagatttcctgatcatctgtgtattattacagagtcttgcccctccagccagtgtgatcttggataatgcagcttgctggtttgtttcccgtgctgtattttttggattgctgtgtgaagctctcagtctgagctaaccatgctctcgattctaattctcaattcctgcaatcttctctcttcctaattttttttttttttttttttttttttttttttttttttttttttgagatggagggtcactcttgttgcccaggctggagtgcaatggcgcaggctcagctcactgcaacctctgcctcccaggttcaagagattctcctgcctcagccccccaagcagctgggattacaggcaccaaccaccacacctggctgatttttgtatttttagtagagatggggtttcaccatcccccttcctttttactagacatttgtgactttctagatttggaagatgtgtatatggtcaaagtatggcgatgaaaatgacgttttgaatgctcagttttccagtgttttaaatttactctagcctcattccaaaatgtgtaatttcctttatgcaaacagtgtgaatgtgttactgtgctcaaaacacaagctaggagagattcccaggctgttcccataatttttctactttatttcttctataagcagtaaaaggatatatttgagcaagaataactcttccattaacctacttacaggttctcgtggaaacgcacaactgtttcctctttctcttcacagtggtttaaaatagaaagtcatatctattttgtgcatgaataaactgaatcaaaattttctttttagttcattaacagcctgggcaacatagggagaccctgtctctacaaaaaattaaaaagaaaaaatagctgggcatggtggtgcatgcctgtagtcccagctactcagaaggctgaggtgggaggactgcttgagcccaggagacagaggataaaatgagctatgattacaccactgcactccagcctgggtgacagagtgagccccccacctaaaaaaaaatcttaccttgataattaactcataaggtaaatagaggcagagctgtagtctctatctgacaccatttctacccacggcattaaattatttgaagtcaaaatgacacaggttaaaaatgaacaattatgaaaacttactcttttcatataccatttgaaactagaacacttctttttttctgctaattctttcaaaaaagctgctagattttgaaggtaactaatcaactgatgccaatacagacttctggaagatggatattgattgacattgattctggataggcagtcaaaaagtgctttccttcttgtgttatatgcatgtaaatgttggctaaattgttaagacatttcagaaagtcacttcaaactatcaaaaacacagtccccatccatgttcctcgagtggaggcaggaatgtgtttacagccactttacaatccaaatgtgaactgcagaaagttttcaagttagtgtaagtttacattttgagtttatattttaacttgtcaaacttttattattgacttgtaataataaagatttcacctgctgcacatatggtccttaaaaacaataattttattgatgttgggccagcttctaatacactaggaggaacaatctgattttatttagacaaatgaaatccataatttgcaaacatgccgaagctttgctttatagtggttaattataaaatgcactaagtgaatctctctactgtgaaagactccagtgtgcttcctaagctaaactcaggcaacttaacaagtcaagaccaaatattcagctgagacttaggaagtggttgagacacaacagcaaagccgcctgtgttttggtgtggttaaaaggtgttccctggttgtgctgatctgtgtgtgactctgcttctgtagatgattagattaaacacggccatattttgaaaagctgcagaggttcttgaaacaccacagaccaaatccaaatacacagaatcagatgtccaggcttgttgtaagatgtaaagttcgaaggaaactaggattaaacttgatattttcccgcaaacccattgctttaatcaacaagcagtttggaggaaagccacactatgtctttcttggcccccaaataaaatgtgggaataagtttttgctatatgttgaggaatattgagagattttgtgtctattgtcagtttttaaaaacttaatcccaattcatgtttctctagggagaaacctatagattatctagcacatgtgtggaaaccagcaaattgaaggtggcataaaaagtaactctaacacacacttgctgagtgattttttttcttttatgtttaggaagtttcctcttccctcccacataaagagtgtctagtaatatcaaagcttgttggctggtgtggtggctcatgcttgtaatcccaacagtttgagacaagccctggcatcatagtgagaccctgtctctacaaaaagtaaaaaaataaataaataagtaataaataaataaattagccaagggtggtggtgtgcacctgtagtcccagctagtcagaaggtatgaggatcatttgaacccaagagatggaggcttcagtgggctttgatagcatgactgcacaccagcctgggtgatacagcaagactctctctctctctctctctctctccatatatatatatatgtgtgatatatatatatggatatatgtgtgatatatatatatatatatcactgattactagaatactcataagtaaaagtatataacaatcccagaatatcaatgaggacaataaagttagctaacaatcactggtcctttgatatatgtcaagcacatattctaatcactttgcatgttttatatcatttaattcttacaaaatgccatgaggtaagtaccattagtgggtcacccaagagagagaatgaagctaacacacagggtactttctaaacccgtctaaggtcaacaactaatatactgctaaagtgagattaaaacccaatccatctggctccagagctcaagatgtttatatgcttctagaatgtttttttagacagtttttactttaaaggctataattctgaaatggattcaaaaggatattgacacagctagttataaggtgaaaaagttagagtttcttccttccaaattacataattgataccacatttaccattcatgtttaatgctttcaaatgggagttataagagttttatcacatctatgtaaagattcgtgtttgaataagcatgcatgatccaatgactggagctcatggttcccttcttcaaggattctagattctgattccatgtgagcagttgactcacttttcaacccctggcaagaccgtgcacctccataatcccagctggaaaattaggtaaaataaaaacatgacctcattaagaaacagatgcttcatctgagcagtgctttcccgagtaaacacattacagagcttcttgtgacatttttttaggatgtggtactgtgtccccttgaccattggtcagtttgggatcaggagacaagagcttgaaattctgtttaatttgcagaccaaagtttagaaaaacaaccaatttccttcctgaggttaatgttataagtcagccctggttgtacagtaatgcctgggttgaataagaagctgaaccaacagtttcctttaaagtgatgtgtcttcatctggctacacattatcacagattttctaacaccagattctcttgtgaatttaatgaagcaaggtgttcttaaaatctgtattgggaatatcaaagataacatttattttataaaatgtcacccctttgccaattgaaaaagagaattttcataccagaaaagttatcaggtgacgatttgtttgctatttctgagctaacaatgtaactcaaactctcagtcctatagactttactctgacataatttatcattacatttaatttcttagattaattcaaataaactcctttctgatgttacttgctgacagacactcagcatgactgttgtatgatttaacatcaattaagaataggtcaacatcatctaacacaatttacaccttagcttttactaattatttcaaacagcgaaatacagttctgatcgggcgcagtggttcacacctgtaatcccagcactttgggaggccaagacaggtggatcaactgaggtcaggagttcgagaccaccccggccaacatggtgaaaccctgtctctactgaaaatacaaaaaactagccaggaatggtggtgtgcgcctgtactgccagttactcagaaggctgaggcaggagaatcacttgaacccgggaggtggagattgcagtgagcagagatcttgcctttgcactccagcctggacgacaagagagaaactccatctcaaaaaaaaaaagaaaaagaaaaagaaaaaaagaaaataaatatagttctgaggtaggcaccgcttggaaaatactcgtggattagacagttgcattattctctgaatttcactctggcttctatctcccctccccagttaaaaccctatttagcatataaatacagaggtcattaacaagtgcatctattacacaagtgtgtttggtccttagttgcctcagggttttaggtgaaaagcttccaattacatcatcaagaattaaagatagctgagaaagagtattgtaaacaaaattgctcaagcaaactgcttttcgatcttttgcatgtctgctgattataaatggtcctaaacacaaacactaattcttccctaaagcaagacttcactacctctgctttaaatcctgacagcagatagttacctcgaaacccacctctgccttttctctcactaggagtttcacgtcctattttagtgagggagcttcctcagatctctgtcaaaatggctttcagtcctccccacccttctcttgcaacactctgactctccaaaaaagaactctttctctttttccaagggtaaggattgccattctatgtggatttctcgattccatccccctgcctcctctaaaacctcaccctcaactaactctgttgctctgtattgctctaaaaactcatcatgtaatacaatttgatgtaaacaacaaattacttttggcattgtacacattttctccacactcttttatattcttcatgtgctgttttactctctgagacagggatatctaatcctatctgctgctaatgctcctggggtctgcttgtccaagaaatgcttaatctccaaaccacaccattcattttaaacatctctgtgaatgatttatgaacaaactctccctgaaaaggcagatgtcttcaaagctattagcttttccaattccccttcacaatccctacttaaaagacagttgtcagctgtgacactgtattttaaattccccggattctggattttctctggtagttagcttttggtatcatagcgtgccgtctttaccgtgagcactcctttaaaattgcttatacttttgtatacttttgctatttcaaggccgatttcaactaagagtaaatgtcttagcataattgactgggggctcgaattacaaaataccactccttttgctgtttgcagcctttagaatgtgtgtcacgtctttcctgaagagcatccaaacatccctcacattgatcttccctttcatatcctgtccagctcctgaagggaagtcacgcggttctctcgccatgccctggttccagctactctggaactggctgcctgttactttgggtgcttaagtgttcttcacattgcccaggactctcgctgcccttgagagagcatgcctctcccagagagctgacaggctttcttcatggagcacagagtgttcattcgccctcaaaagagtcgatctctttcagttgactctaagcagtctgtttctgcctgacttttggagatcttacaaaagtcacatccccttgctgaggtgaagcaaagatttgttcatgcttgaaaggcagtctttcgcagtgcaatttcctctatgcatcttcagtggcaattaagtttcagtggaaaatgagcaaatttggggagcatagaagtcataatgttatattaactagtattccaaaagattcataaatgatgctgaaatatttcaaaattaaattgacttgcttacataattgaaacctttaaaattacatgcttcacctctctgaaagagagaatgaaggtactttctcaggtccctcaaagtgaatttcgtgtctgccatgtgtcctatattttaaatcagaattctaaaatctaccctccaaatgaagtgaaaatctcttgatacaataataaaaaggcatatggaaagtgctatgtatttatatagatttggaggaaaaggccattacttcattaaataaatataaatatcctatgaagtagaatgtatacatcacattttttaagtaaaaacctggattcaaataaatattatgttgcagaggtcacttggggacacttttcttctatgccagaggaaaaaactcaagagtgaaatttccaccatatccctcagtgttaactgataaatcttctatcttggaaaatttcgggaagtgtagagtgcgatatcagcaagtatttcatgtactaagtaactttaagtcatttctaatagtacatgaatgaaagattgttttttttttttttctgtgagctgtgagtttcttgaaaaactcaacaaaccactcaaaaattagatgagcccctgctaatttcctttgcaagttatttgggacatactttatatatagactataatgcacacttatgctactgaccaaacaaaatgttaagtggtggtgggagaacttcccagagaaaacttgtaagcctagtaaatgctgtcgaagtaaatatctgtataaataacataaaaatgtggaggcttggaaggtcaccgagccctagccacttattttcagccataacagcagtcagttgctcagtggacaattttgttatgaggtgttggtgatttaacaagttggcccaaagtagtcggaatataaagtgaaagatttcatctctgttgggttttattggtgcacactggactcttttgctagaatggccaaagttttctgcgtttggcattcaagatcccaaggagaatgtagtcatcagtttgctacagtgtttcctaaatttgttttagtggtttgtgtatgattctagaaagctttgttaaaaacaccactaggatgatttgctgtctactttttagagtttgtaattgctcaaactactgtcctagatgttttaaatagcattgtaaatttgttgtggaatatcattttatctttagactgcatgaaaattgatcttatgtaataaaaagcaatttacttggattataagaatgcaattatgggctctgtgaaataatatctagcttgactggaacttcagagaacattgttggttgagaggcttaagcacaaatatcacctggctgagtggttttgaacactcacaactatcacttgggaaaccaagctgtcctttcttcaagctctcaaactccatattattggtattttgacattttaaaatgtaaatgggtatgttttcaaaatgagctatatgtttgtgacaatagtaaacattcataactcactaaatcaccaaaagaaatgaacggatgaagcaagcttagttttgcaagaaaccggaaacttcctcatttcacttctctttctttgtctcccctagtcctcccttttattagccacctatttacttgactaagaaaataagtcactgacattcaaaaaccatctactaagtgtttgcaacttgcacagcactaagttcaatacagaggtttcaacagtatatgggagcaaatgcactttgatctcatggggcttgatcagagaaggcagaaaattagacaatcaaaatgatacgtggtgagggctatgacataatcccacaattgtctcgcaaactctagattctaaataaggctttgtttccacatgacattaagcatatgtgatccagatgaattatgggaacatctactctttagtttttcagtttccatcgaaatgttcaccaaaagcaactgctacactaactccatgcaacttttatttccctggaggtccagtctctgggtgagaaagcagttaaagtgaactcatctacaattaggggaaaaaaatcaagccctagcataattgtcatggaaagatagaaatacacaatcacggattatttgtacttcctctgttgtctcccttaggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtatgtatcatttaggagaacacagactgagaaacaaaatttgggattcttaggagtttgacttcattatatcctcataatattcatcttgccctctaagacaatagttgtgtggatagtgtcagaagaaagaccaagaaaattgatcatatgtgggtatgtactgccaacgtccttggtggcattttagctatggtattttggcttttgaattgaaaaatttcaaaggagaagcagtgtggaagaccacacagaatgcctagctagtgccctgaaagtctggcttttattccttcttttaccactagcttcctgtgagaactttggcagacatcttggtttccctgctattaatatgactctcagaattatttgttacatgcctattataggggtgcagttaaggtgtaggtgacaattctactggattctctttatggcaacataagcccagaagaggaagctttctagatttgcactgactagaagaatttggttttattctgataggagattctcctgaaagtagagtaaaaactgcataacagaaatagaaaagcaatctgaatgatgggaaaacactttaagaacttcaaaagaaaatctttggctttatccttcaaatatagttcaagagcacaacatactttattaaattctgtaagactaggatcagtgctgtaaattacattgaaatactgaggaagttacaatttttagaaataataaattctgacccctaagtaatctttgaaacaagctgttgcaaatttccaagcattcttcagtactttaaagtaataaaaacacaggaggatagatgcattagcactctaaagaatcatcagacattatgtagctgaaatttcctatgttacagaaatggacatattctcatttattttatgttctcttaaaatttatgtttctaaaactagtagttaaattgaatgtgacagaaattattgatcataataattttctataaaattacctcatgatatacggttcaaagttgaataatctatggcaaccgtctttttcccagttccacaaagtttatgactcaatgtcccataattttttagtatgttgactgtttggaactgtggctacataataccagaacaatggacaaattcaaattatttcagacttaaagaaattcagctgcacagttctctgataccatggagtcaaaatatgttcattaacccattcttgctccattcgtggtgaacaggtaaggctttagctgcctgttactatatatttgcttgtctcattttgaaaagcaatctgagtccagcttggtttaaaatatatctcaatacaaaaaaaaagttcctttttagttgaaaaaatatgtcaataatttaaagacttggaaacaacaataagaattaacgtatgaagctttttccttagaccagtaatacaatggtaattttatgtttagctcagtttacattgtggattaaatgcagataaagtcctaaaatgaatgttaccttactatcatcctatctacattgatcaggtcagtatctcataaagtccttcttgggtggaatcttaagtctccacgcataatattgcttttctgttttacttcttttcaggttttctgaaaataaaataacattaatattttatttcaaaatcacatgttacacattccaagaagttgagctaaaccttgaatcactaaatgaatggatttagttgctaaggcagcaaatacttatggctaaaatgagaccaaatttttttccctgtgcaaatattaggtcagctaattacaatgctgtggagaattttgttcctaattttggaatgattcatttatttcatgtttatggaatttgtgatcttaatttctatgcagtaaatatgctttcagcattgtcttcatttttaacattaattctatatttaaaagagtctatgctctgattttttaaagattttataacaaatttacatatttttatatctgtttctgttccaaagggctcatgatagagaacaactaagaacataattttaatagaaatagatcttgttcatttgcactaataaaaaagtatctaaatttctcatgtatatatattaaataaattcaattatcaaaattccttgagcagaaaatgcttatagtttacttatttgatttttttcatccaatctagactttctcacttttgaatatcttggtttggttaggcagccttttgtttcaataaaaataatcctattttatcagtagcttataacatgaataaagtgatttcagaataacaaaaaccaaagaaaagcagtgtggcacaatgacaaagctcagttatgtctgtcttactttgtttcaaaagagcatactcagattcagaattgaaacagtggtactccctgtagtgctattatttaaagatgaattgaaataacttaataacttttaaattgtaaccaaaaagctcacttaagtcaatgtaagtgaaagtgtggccatagaaactaccaaacccactttagagatgattgaggtgctaacatttcaactacagagcatgggagagaactaagaagacagtcacagtccaagatgatagaataacaaagatgcatctttgttagaagactaaacgatgtcacaaaactatattataaaaccttttaactttactcatagaaagctacacaggcttccactcagagcccatttattagtattttacagttctaccatttttctgttctaattttctaggccactcaatttttttaagcaataaaatagtcatgatggatgagggtggggagactttagacaggtaatctgagaacaagaaatgatattatttaacaataagagaaaggctataaatagcctgaaaacatgaaaggcacagtggtctggtaccattttctaaaggtcaaaagccctatctcaccaacatggtccctcaagttagtgctatatttcagcatgatacaataattgacacacagaaaaaaatgactttcagttatctaggaaagttaaactgtgaccagtataaaggcagaaaagcaatttgctatttttaagcaggtaatctgacaacacatatacaatttttcaatggtacctaaagagtacattataaatgggaattccatttatgtctaatatcttaccccaccccctctcaccttcagcaatactggagaaatgaggtcggagagtaaagttaaattcaaagcatttgatttatttttaaaattattagccataagtagctggacatttgtagcactcgtccactgccaaatgtaaattcattagtactgagtgtttcctgatttagttccaacaagaaatatgcagcaattaggttatggttgaaaaaccagcgtgctcactctaaagtcactgtgtctgcagatttgtgattcagaaaaggagaagccatgtctcatgggacccccctcctcccaaccttggccaagatacttgtagacattctgcagtgtttatacaagctagctctaggcaagctggctaggagtatgatcctcaaaaataaaggtaagcactggcaaagaaattgtgcagtgaaagcaggttattgaatttcctttctcaaatgtttactaaccttgagtccagaaaagatagctgtgtctgctgtatccctgagtccacagtgccagatgatgagaaaggccatgacttatgtagatacagctcaagaacactcacaacacaggttgctaaggaaaatctatggatggttttgaaaattcgtcatgtagtgtaaagagctaagtttacagccacttactgaacacagaactttgcacataaaatgatattggaaaaccagttctctgaatcttttgttaagtatatagactaaagctagccaggagagcttaacatcagtttttaaggtggcattaataaaattcaaagccaacactatggttgtatcttgattttcatactaaatatgctctttaatagagtgtgaaaataagacatatagtttaaggccacggtgacttatatttttaaaaactttcctttatcctctatcacagggaatctttaatttaatttccttgccattacatctgctcaacaatatacctaatgcatctaacagcttcatacccagaccccttgaattgctttttgacaacaattgtctggttttttgaagtgctcttgttcattcttatatcactgggcccagaatgagtgatcaaagagcaggcaaatgcacccatttttcttttaacattagacattcaagtaaagacctaaaagctgaggggcaagggcagtgagatgaagagtggaagcaaagggagattgtaagcagtggtgttaggcttcttcggatgagtttgattaggaacattaattgatttctcctgcatcatgaatatttgggtcatgcttaatttcatacctgcatattgaaaaggaagagaagatggaaataatgttagtgctagaaatagggaagaaaaatttgaaaacaataaagaacaacaactttgagaccgggcatggtggctcactccctgtaatcccagcactttgggaggccaaggtgggcggatcacctgaggtcaggagtttgaaaccagcctggccaacacggcgaaacatagtctctactaaaaatacaaaaatcagttgggcatgttggcgcatgcctgtaatcccagctactcaggaggctgaggcaggaaaatcacttgaatctgggagatggaggttgcagtgagccgagattgcaccactgcactccagcctggacaacagagctagactccatctgaaaacaaaacaaaacaaaaaaacaactttggttaatcattaatatgagagacaaatagtgctataagtcagacatatgaaactagagatttttctgttccatttcctggaggcgtggcattccttccaacacctttagtggaattctgccaacacattttcttactggttcgcctcaaatcacaacattttactttttatttttttgccttattttaagcatttagtttaacatgaatggtaaaaacatgtatgcaatatgcacacattcctattgactttctttcttttctttttttttttgagacggagtttcgctctttgttgcccaggctggagtgcaatggtgcgatcttggctcactgcaaactccacctcccaggttcaagcgattctcctgcctcagcctccctcccgagtagctgggactacaggcgcccgccaccacacccagctaatttttgtatttttagtacagacagggtttcaccatgttggccaggctggtcgcgaactcttgacctcaggtgatccacccgcctcagcctcccaaagtgctgggattacaggcatgagccaccgcacctggcctgactttattttatagtctatccatttataaatatacaatgttaaaacaaaaggaagaaggagggaagggtcaaagtgttcccaggaagatccagatcaaatttcagactacgatgaattagaaaatatgtgaagtagatgtgaagaagtggttgagaataaaattaaaacagattaagaaaaaaatcagcactaggttggatgcctctagagctcactagaaatgatactgaaaggttgatcagtttccccttttactccttccccaaactgtatacatttcttaaacatataaaatgtatatccaatctgttattacttagattttaaacattttatactgtgagtttcagacttaggctctgtattgatttttgttactgtttcttggcaccattctgccatttggtagagatgcttgtacctattttgttgcaaaaggacataattcaatgtaaaaattaaattatatatgctttggcataaacagaaattgatgcagctacaaatcctagtactgagaacattggcataacacattaattgcaattctgaaataaattattttattttaagcaagagaagatcatctccacatgtatgacctctaagggaaaattatagagctgatatatcttattttgaatagaaagctaatgtgttatttatttttaaaacttacagttctaagttaagctttttaaagagatgccacatcttgaagtctccttgttggaagccgatttcaaattgcattacacgtttctttttcacttgtcatctactagtgaggtagaacaggtgtcagtgactgtgtatgcatagtcaggtggtgagttattttgactccagaaaaatgagatagatccatgccatgtgcatgcacacatggtaaagacttcctagctaatatttagttacccagtcttatggtctgtgctttttagtaaaattttttttaaaaactttcttaaaacagcacttttgaagaactggaaaacattattgcagactcagagatttgttgacagtcttctaacatcagcaatctgccaagcatcccctagtttacacagtacttcttttttgattctgcaatgaagataatgtttttcgtggagttctgaagccctaatcgcactctgtcttataaacaaagcttagtgagcttttactatcattctttcctatcggcttgatgttcgtgtttttcttttaacttggtgtttttctcccaaagttctctttggctggattcttatttttaatgctttttctggcttgccttaagaagctttacctcttcaaacgttctggctcagaagttaaataggaactttgctctttattcatttttatataatgcccccaacacagattgacaaattctaaggtattcactttgaagaaatttgaatgtagtccttaaaaatttacagtatacttaaaatatgctgaatattctatttctcagtggcacataaggatttgaatatgacttttttgttgaataaaaagaataactgtagtacatctaaaaggctgttaaatatactgggatacaactaccattgctttgtatttttctggtcacccttaagatctttgttagctaatttcacatttacagtatcacagtgagaagagaagcattatgcagatcttgaaaataaattagggagaggttagctaacttagccaggagcactcaaccatttagtatttcaccagagtaagacttcagactgggtgtttcttccattaagctcaatatctaccacttaaaggatccttacacatggctgcccttcagcaatacaatcaggcagctactcacatgctaacagaagccatatggcatcagaagaaaagggcaggctctgagcatgaaaccataacagctgtgtgaccttgggtaactggtctgcctcctatgggcctcagtttccttatctgtaggataaataaaatatgcactagaatctgcctgatggggttgtggtgaggattaaatgagctcatatatgtaaagaatggagaatagtgtgtgtaacaaatatttgttattttattgctattataataattgtgtaaatcctaaaataaagtaaacagaaaaatacagaaacagatgggcaatatgcatgcatatgtgggtgacaaaagaaaattaatgatgttaactcaccggacagggattcttagggaagcttttgcggggaggggaaggagaggaagaggaagcaaatttaaggttttggattctcatcgtccatgttccagcttttgtggattccccatctcacccctctgcctgtacaccctcatatatgatgcaatgagatgcctaccttgtttcggcagatagatccaaatactcaacaaacaccaattccattaaatagacataaagcaaagagtataaagactaacttaatcctaaattatcaaagactattttttcttttttcactgctcctttgttctgtgaatcttgaaaactttttattaaaattatatcagtctgagagaaatactttatctctgtgactttattggaaggccttcaaaggtagatctgggtcatttttctgtatttcagatacctagtgtgttttctagaacattgtaggtgctgaacaaatgcttgtcgagtgactgtaagaatgaatgaggagccagcttggctattatttatggaattagtggaaaggagacatgtgataggcacatggggaaggggtgagttagaaatgggtaatgggttatacagatagagtgccaaggacaaactctgtttctcaaagtggtagagtaaatgcttcattatcattattattattattattaaaattcaccatctgattttctctaggtccatcccaattttgtttagtgccttagcacaagggctattttcacaactaatcattacagaatcattttattccatcacacccctgccaacctcacctctgttgttacagacactccggagcgcatcactcctgagaaccctggagggtctggtgcgtccaagggggctcccagccttgtccccatggagtccctctccagagcattacactacagattcatgggtgcctcgtgctccaacaccagccggggcatttcatttttagatccatgattttagcggtttgaaacctaaacacagagccgtggtcaatctcagttattcttgtaggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcagtaagtgattttctcatcagtcaatgcctggaggcccaagaagtgaagtgcattcttgtgatgggtatgggcactgttctcagaaggctttattttctaatttaaaaacttttcattttgaggtttatttagagcttcttcttttacccgcagtagccattctcagtgatccgagatttactggggaaaatgcagatactgggaatttatttgcagtttacatcttttaacaaatacttatgtaactcagattctgtctaattgagacctcaggtaggaccctattaattgcttttgggaagtttactttcaagcttctcttgctaaagttatcagaatataagtatttaaattcagtaaggaggtaatagcagagccgatacatgtggtgcttgtacatatttggtgagctccaaatggtcacttttttccccttgacaataagttaatctaaatttaggagctaaagtaacttacgactgctccggggaaacacgtctgccactatatacacagtccagcttcaggtcagcaactgccctattaattttcgaggcctaagtaaaataagtgctcgctctcaacccacaagatttgcaaagtccctagaagagaattatcctgtgcccattgcctgtatctttccagggcatcacccaaccattcatcatcagataacctgacacagtcagccagaggcaattcacagattccctcagcaaagcagctgatcatattcttcctttcagaatctctaagctccctccaggaatgtttccagagaaacagacttaggttgccataaaagggctcttccttccctaaggggtgtgtctgcatgtatggcgtgagtgcatttcagtatctgtcacatctaattaggaattaagccaagttgggtccggtacatttatgaacgtcatggagtcggtcacagacaggatgtgggatgtcaacaaagggactgcagagttttactgctgaagagatgcaaacacaattaaataatgcccagtgccatgcagatccttcagcattatacgtttcaataaagatccaacatcagagtggacaaaaagttaccatggttcagtgatattaacagagatggaccatattagaagacataatttacaatggtccgtagaaaccaaaaggtgataatctttgtggtgtgctcagtacttaggatgatgctttcagatcttctagtgctggagttgggagggtggaaaagatgaattgcttagcactggaaatgtgttgcatttccaaagcatgatcatgttaaattcagtgaaaatataactgtatctgtgacaaagtttccactttgtcattaaatgcaggtgatttccaaatgcacactttcaatgtttttctctcattggagttaaaatatattctattctctatttcagacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccgctcctgcagtctcatgccctgcccacccaatggtacgctgctcccaagtgtcagcaaccatcatatgctacatgtcatttgtattctagcaataatgaataagggaagctggggaaataatattaatcttatactgcacagttccaccaatatgcagatcaataacaaacacctatgtgtttgtttttttttgagatggagtctcacactgttgtccaggctggagtgcaatggcacaatcttggctcactgcaatctccacctcctgggttcacatgattctcctgcctcagcttcctgagtagccgggattacaggtgcacaccaccacacttggctattttttctttattttttatttttagtagagacggggtttcactatgttggccagactggtctcacactcctgaccttgtgatccaccctcctcggccccctaaagtgctgggattacaggcatgaggcaccacgcccagccacatatgtgatttttaagttttattataagcaatattcagagaattggaataaataatcaccattttgaactctatgtatagataaaatccatcagcattggtgagtaaagagactgtgggataaaaaaaacacgtttgcatcttccccttaaaattaactatttaaacccacaagaatatatctaagtttcagaactgataaggtaatactgaaacatgtttgttttctaggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtaactacacaccaactgtccagaagcagtaggcgtactggtggaaattatttggtagaatgaagcctgcggacgccagacgtaaacagttattagtttggggtcagttagattttggaaggtttttattttcatctctataacttctatattttcaaactttacacaatgaataaaaattattttataaacagaacaagtaaatgttttaaaagctatatttaaaaggtgtaactcactgtaaaaggtgtaactcactgtcaaggaaggcaaagtgtgaccttaactttaaagtaaccatgaaaacaactagtatttcctaagcagcattgtaaaggagaccataaagcaagaaaactttttctatttttctatgatttacttaagaattcctttgatgagccgtggagatgggtttcaagatcatatacctctgactcaggcttttgaataagtcaagaacccttaatatgaatcaatgtccctctagttatatatgttataatccttgtgtatgtgtataatatttgtgtatggaacatgccttatttttcacaagtgagcattttctaaatctatagcagagttttattcttatggtcagtgttatacagcaatttacaaatttgtaaacagttgctacatttaaaatcacctatggctgggcgcagtggctcacacccgtaatcccagcactttgggaagctgaggcgggcagatcacaaggtcaggagatcaagaccatcctgaccaacatggtgaaaccctgtctctactaaaaatacaaaaattagctgggcgtggtggcacacacctgtaatcccagctactcgggaggctgaggcaggagaatcatttgaactcgggaggcagagattgcagtgagccgagatcacgccactgcactccagtctggtgacagagcgagactctgtctcaaaaaaaaaattacctctgaaacttggccttcagatatttataatatgttattgaaaaacaagctaatgtcaatttatgaaattttttaaagctcatgtttttattagaaaataatgcattttcattcaaaaatattacacagaagtaaaaacataaaaatcacctgaaaataccaccatctacagagctattaacctgataaagtatattctacttcaactcacacacacacgcattcacaacatactcatacacatgcataaaaagagttttctatatacataaatataaaatttacaggcttatttatatatatgagtgtatatatattacatatactcacatgcacaagccacaatctatatacacactgttttataactagcttttaaactatacactaatccgtttattcaaaatatattcagtctcttccagtaagtccgttcatctaacttccccagactcctttttctgcactaatttggttgtgtcgatttcagtgtctgacagttcaacacacaatagggaatgctctccaaccatgacacagttttgaatgtcaagtttagattttcaaatttgtcattataataacaactatgcaacaaagaaggatctttgcattctcaagcctgctcatattcagttctgcacacaaatgatagtctgaaacactaagtgaaaagattacttctagtgagaatgtattatgcatacaaaaacgaagatgagtaccttgtgtctcttaacacattcagaggtaaggttaagagagaaaatgtgtaacctaggcttatccaaaatctgctttctggcaatatgacaaggatttttcagttagctacttctggaaactatgtttttttggcttttttttttttcaatggactgtccataccaatcaaactcaaaaaatcacaaatgagaacttactagttgaccaaaggagcaaatactgatgcaaacatttcccactcctaatgcatttgccatgattcaggtgaccgatggcactgaatgtaggctgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaaggtaatatgatagaacctttgtctttatgtgaattgaacaaagctttagactcttgcagaattgataaaggaggattcatattacatcataagctatctgtatgaggaggtctaacgtggctctagaaacacattttaaatatgagaaggaagagacaggagatgaataaaactctggttgctcagggaaaactcatgctgcctctggaagcagataaactgcagtagccatgggaatcaatagcttgtagagtcagaaaactgaaaagaaaaagtgggggacattccactttagtgatatcttgcagatctagtgttattcctaaaacataatttagggaaggttggttggttttgatcttaactatatttttaaaaacaaattatccttacactgtgttttccttaagaaaatatttccccttgcaaaatgtaagttcattgcaatggtgtgggcaacagtgaagtatcctggtttatatctactctctaaagaaatatatacagcagtgtctctctcctgcttcctcttatggtcctagatttttgctttaaatattcaagtttatgaagtaccaatttccggcataaaatatgctatcaggtaggatgactgagttgactagagtctggtaaaatacaggcttgcttttcttcccaaaccactcttaggctgagtgttattagtcaaatgtatctgtattcttgatgtacgtgctgtgttgtctgtaacttgagagtaatatgcaaacgaaattaacaataggatttattaaaataattaaacatgttaatgtaaaaaactataaattttctctgatgtgatttgaaaatatatggctgaaaaatttattctgagttaaaatatgcgttactaattctatttgctaatgaaataattattcacctaattgtgttagaccatctatgtcaaaaaccctgcatgcccaattatatcctgcatttttatatgtttcaaaggtataaaacaccttggagatgatcagtccaaccttctgttttaaaaatgagttggactctgaaaatataggagttagccaattatccatggctgatgaatgccagagaagagcagacaccataactgaaatcctagaatacacaggtcactttgaaaaaaaaaagaagaaagagagatagaagaaagagagaaagaaagaaagagagagagagaaagaaagaaaaagaaagaaagaaagagaaagaaagacaaaggaaagagaaagaaagaggaaggaaggaaggaaggaaagaaaaaggaaaggagggagagagggaattcaggaatcaaattagaaacaaaactacttttaaaaagtaataccttatacactttatggtacatattctcttctatataaagttataaaccagttttaaaattgctaaatttagcattttaagtatttttgtgctgacaactaatatctgcacattttttcacatgaaaaagaagaaattcattatagcaacaagtggtatgcaatgtaaccacctgaaaattggtttgaccaagattctactatggtacaaatgacatgtttgagtagttcaaattaattacctagggaggccatagtaatttatatgatttatgaaaaagaacattgatctcatactgcaatatttgtaatcaagctttggctcaatgattccttagacatgtgatctttgaattgtcacctaatttctttaccaggagatttctcaaaagtaaagtggaaatactggtaattattatcatatggttaataaaactgttgtgaaggtgaaatgaggtaatacatattaaaatatttcatcaattttaagcccattcacaatatgaccctaatcttaactcgctcctccctcagttttcctcatctcagtaaatggcaactcagtctttctactattgaggccaaaactttggaggcatggttcacgtctcattttctctcacaccccacatccatccatcagcagatcctgtcagttctatttccaccacatctccagaatctgggtgcccctcaccaccgtgaccgctcccaccgcaatccaagtgttcatcagatcttgcctggactaacactgcagtcttctcgctgacctctggatcctttgctcctcaatctcatcttaccaagcaagggaagccatggctattacctaaaccagatcattgcattcctttgatcagtagcctccaatggcttccatcttacttagactcaatacccaagactgttttgtaatctctaaggtgctaaaagatctggccccttccctcctctatgtcttttctacactgtccctttctcatgctctgctctgaccagaatgcactttctcgcacttcaaaaacatgacaccaggtatgagaatgctgtttcctctgcctggaacactttctgctattaatgagcagtacactttccagaatctctttaggtctctgtcaaatatcacctccccagatggtggctaccgtaaatgtacaagaggacatctcctccactcccaccactactgtgcaacttcttaccttactccgtttcttcacagctcttatcaattgatatcaccacatattttgtttgctgggagcggactaaaacatcccttccctgagagcatgcttgaatataaatgaatatattttttcatgacagacattgtccttggcactgtgcagatagccctgaacaaaacaagattcctttgccctgccagccatactttgtaagagttgtatgaaaattgcattcacttatggtagtcgggaaagctggttagtgtctggagtttaaatgataccaagcaggatgtaaagaaaaggaatcaggaatatcaagagaatcatctcttactaaggcactaaaaaatcagggcactaatactcaggtttactagtgcttgtgaaactcagtttgaagacctgcagcaatactgaccatcatactaattctcatcaagatgagataagctctaaggaacaagggtaaacacccaaaaaagcttcccttaccctttattctttattttacttactccttactgggcatcatttaaactctgcacataaccagaatttaatttcatttaactgctataacatatggctggcaggggtcaggattttatgcctggggatatagtgaaaaagagcgctaattgggagtcaagagcctggctttttttttttttttttttaagacagggtctcactctgttgcccaggctggaataacaccatcttggctcactgcaacctctgcctcccaggttcaagcgattctcctgcctcagcctccagcatagctgggattagaggcacgggccagcatgcccagctactttttgtatttttagtacagacagggtttccctatgtttgccaggctggtcaggaactcctgtcctcaggtgatccccttgcctcagtctcccaaagtgctgggattacaggtgtgagccacggcatccagccaagcctggcttttaagcctaacactgccactaatcagctctaaagtgaacttgttcaaatactgtcatatatccccatttcatactctttttgtgtaagatgttatatttatctccaactaccttctgtttagacaggatctcattctgttactcgggctggagtgcagtggtgcactcactgcagccaagacctgggctaaagcgatcctcccacttcagccttgccagtagctaggaccataggcatgcgccaccatccctggctaactcttttactttttgtagagacaaggcctcccctgtatttcccaggctgctcttaaactcctgacctcgaggaattctccaacatcccttttgactttctttgaagccactatagtttcatggattatttattaatattaggtactacaaaacacatctgtaacaaaatctgatctgtaatgtattacaaaaataaaaataatgaatcgagttagacagaataaggaacgccctgagcattgcatcatctctcttcaacactgtaggaagctttaccacctgtgtggctgtcactgtagaacagattgccctgcagacaggggacttccttggcgataagcttcctttccaattcagaggaaactctggagtaagggaaacacacttggatttttagcatgtgaatgagaactggaaatgagacagttcagctccacacgtcagtcaaactgctcaagccaatagtattcctgtttaaataactaggaaagtgaagggaccctattatgaaattacttaaaaaggcaaaaatgtggacaaaagttgactcgtcatttcacccttggtgcttaattagcatttccatcctagcattcctcacaggtttatgggtattaaagatatttgtgtctttccccatttttttgtccagatgatggctctttgaagacttatatgtcactcaccataaagcctttctcaatctatcgtatcttatgggcactaagaattcagaaaaattctctaagtcatttaaaaaaattccccttttatgatggtattagtaatatcattacccaatttcagaattgcatgcttcatttatggcctgtcccaccaaatccagaattctagtagaaaggaatgcagagactctactcacctctagtccaaaaactaattaattctgtgttcccaagttagtctgcacattggaacaatgtgagaagtttcaaaagtgctcttgactgtgcccgaccctggaagatggggatttaattggtctgaggtgtgggtaggctctgaaagatttaaaagatccccacgtgattctaatgtggaagcaatctgagaaatattaaagaattatgtgagattaagtgaaggcatatttttgtcagtttgtgtttaaacagatcccattttgtgccagaaagaatggaaagtagatttgtaaagatgataggatctgataaggatgaaaatggttgtataaatcttgaaagttagtataaatgttttaaatgaaggcaggttgctagcatcatcctaattttgaacacctcaattaaagtgtatacaatactgtagtataattgcaattttctcataaaaaataatttttaaacccaattttaaactaatccattaaaactgtgtgttaagagaagactttttagagaacttctgtttgtgtatttatttgttaagtgtttactcatttttttctccctttttttaaccaccttcccccacttcctgtgaacattcctacttccagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcactgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttggtatgtcactttatatcccctggttctattaaaatatccatatatatttctataaaaaaagtgtttgaccaaagtaggtctgcagctatttcaacttccttccgtttccagaaagagctgtggatattttactggaaattaagaacttgctgctgttttaataagatgtagtatattttctgactacaggagataaaatttcagtcaaaaaaccattttgacagcaagtatcttctgagaaattttgaaaagtaaatagatctcagtgtatctagtcacttaaatacatacacgggttcatttacttaaacctttgactgcctgtatttttttcaggtagctagccaaattaatgcataatttcagatgtagaagtagggtttgcgtgtgtgtgtgtgatcatactcaagagtctaaaaactagtttccttgtgttggaaatttaaaaggaaaaaaatcgtatttcactgtgttttcaatttatattttcacaactactttctctctccagagctttcatctgatatctcacaatgtatgatatacgtacaaaacacacagcaagttttctatcatgtccaacacattcaacactggtatacctcctaccagcaagcctttaaaatgcatttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatgataaaatgtacacccccccatcaccaacctcacaacttagaaaatctaagttgtttgatttctttgggatttcttttgttgtgaaacactgcaaagccaatttttctttataaaaattcatagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagaaattgcttttaaaacaaataattgttttacaaaaccaataattatcctttgaattttcatagactgactttgcttttgacgtagaaattttttttctcaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgcaaagagaattaggagagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttct

SEQ ID NO: 38585 - DNA, 41087 bp, Homo sapiens
gagagaagcgagatttattcctacgtaccgggccgtgctgcttatggcggcgctggagagggggcgctgagctgttggggtgagtacgacctcagggtccaactgggggtagcagaaacccaggggaagggctgagaataagaccaaggctaacgagaagccttctgagtcaaggtgggcactcgtagagctctaggtggggaagaatgcaccccgattccctgccctgggctttttcatacgtctcccgttcaactgcctgggcctcatgtcaggtcgcagagctgaaacgaggagttgaggccagccggctgcgcgtggtggtagtggtggtggtgactaaagtggggggagggagcgaaaatggaggctccgacagcagccaagatggaggcagagggtgcggggctcgggcgcggaggctgctgggatctgtagtctggctgcttccccatctgcggcttgtctggggaaacgggaactacatgtcccggcgggcggggcgagggggtggtggcgcggtcctttgtgtgaggttggaagagcctgagaccgagaagaggggcctactttgactctggaccctgtagtttcctggccgttacctgcttgggaatctgactaccagtaccagagcgcagtgcggcagtggcgccttctttgtgtatagactgagaccctgctccatctagatatcttaggggaagtgtttaaagacacctttccccagccacatctggcacagtagtgtggcggaattgacatcgttactccagtcacctagagcagggtctcagcacccaaccttcccctcattgtctccccttcggcgtcttgagaaagggaaccagtccctaatcttttaggcacgtggctcccacccctctatcttggggaatgggcgtgcgccctgaaagctcagtagtgtcctcccttccacctcctgtagttctcatggtgccagcgcctggcccacccacattgtgcaatgaacggcctggcttcgtcattctatgtagaatgttttagagttcccccgtcggagacagcttcaaatttttgccatgctattttatcaatacgaaatcttagtgccaaggttcttttgctttaaggttttcccttagaaacacccagatggcggccgtcttgcttaactcacaggtgaagcagagaacgctccctgaaacaggcttgaatctgcaaagaatatctgaacgttgttgggcaagttaattttcgtgttttgcaccttaaatgagtaaaagaatatggcgctctttaaacagttgggagacagggcggagagggagaatgctcaaaggcactgtggtagttaaatctttttgagaggcttaaattttcatcaggctggtatgaactggcagttctcagccactgctactaacctacttttttagaatgtaggtttcaaattatagcccacagatataagctactctatactaaaatgctgagtaattttcattttgagtaactaaaggcaaacattcttgatattgcattgaggagcactataatacataccttggttttcttttggtactaaccaataatggatatccttggtgtgggtaaggaggggctttatatacttcagtagggatatacctgagtcataaaacttagataaatatttggccttctttttgtttcgttttagccctgggactaaaataaaagagaaggtaatagtttggttttgcagctgttctggatgtttaccatcgagatgattatttatagcagctgagttgaaaactaaagtatttgaggcacagaagataggttttctttttttgtaagtactgacttaagtgtgacctttagcgagtgtgggtgaaaatctggtaaagtcctagcaaatcaaaattgaaagcgtgaaagctgacgtgcagtctggctttaccctctacccttattttcccttctccccacctgaagacacatcgtgtagggccatcgatttttgttttaaacaaacaaaatgctaaaatatcaaattatgctggagcattcataacatgaaatttagtgttccagtgtttttcattgtacagttcagtggcactaagtctattgaaactgttgtgagagccatactttcgacaaggtagttaaaacatggaaattttggaacgatgttcttttggacagatttttgaggagttgaatttcaggactgtattgcaaaatgagataaaaatcttgatcttgttaagtaaacacaaagaattgatgtgccttcttcttagctttgtccttgcagaaaacagaagaggaagcactttgagatctattttgtaagctttaatagctagactgttgtaagtggtgaaactactatggtgagagtgacttgctgttaaatcccttctgcccagtcaggattttaaaaagtcctttgttttgatattagaatgttttccacttgcatgtgtgggtacctagttaaaaacaacacaaaactttttaatattttaatgtccttttatgctgaggtaaaacagtgtgtggctgaaaattatcagtttcccctatgttgcacatgtaagctatccgttgatttgcagctacagccggtacataaccagttatttgcacttctttttctccaatttattaacaacaagcttctatgctagatactgcctacttttattagtgaaaatctttgctcaagacccttacatttacttcctgttgctaattggcacaatagtgcttttttagacccctgctcagtttatacctactctgtggaacatggtagccgccagccacgtgtggctgttgtgcacttgaagtgtgactagtttgaattgaaatgtgctgtgattgtataataacattggatttcaaggaatgtaacagtgtcaatttttttacattgattgcctgtagagaataacattttggatataattggttaaataagacgtttaattaaaattccttctgtttcttttgactgtaatatggttactagaattataattacactgtatttctgttggaaactgctggtctgtggtgttttctgatgtgtctagaatgtttcttcagcatcttcccacactgccatttgtcctgcttaaaactattaggtttctgggtgtatatataagcagttaagtgatagataattttaaatatctcagtagctgtttagataattaatccagcacagttgttactacacagatacaaaaagatagttgtgtcagtttgattttttatttttactcaacagatgacttaggttggttaattatctagagtttatcgtttaccttagatcctaaagtaaaaatgaattaagacctattaagcacttcagttataaaatgtggtgctcaatgaaatgtcaggcaatagagaaacttttcagtcctatgctacctatttgggtctttgttttttcctgcctaaaagaagatactgcctaaaggaagtgggttaggtgagcagacttttgtagactggcttagcctttcattaacttttcccgaagtgagtgctgcacatactttcaaaataataaactaggtagtgtgatacattttagatggattacttaccacataaatgtgttagtttaacctcttcatttagtgcccactatgtcatggcttatgctaggcctttgaggtaaaacagccgaggaagacatgaaataaaacaggtggtggccaggtgcagtggctcacgcctgtaatcccagcactttggggggctgaggcaggtgggtcacttgaggtcaggagttcgagaccagcctgaccaacatggtgaaaccccatctgtgctaaaaatacaaaaattagccagccaggcctggtggtacacgcctgtagtcccagctactggggaggctgaggcaggagaatcgcttgaacccgggaggtggagattgcagtgattaagtaataatactatttccatgctgagcaaagggaaaaggagttgattacttagcacacagtatgattctcagatacacatttaaattgttccctagtgtttttattggtaccctatggtgggtttgtgggggcgattgttttgagtcagcgtcttactctgtcgcccaggcaagagtgcagtggcacagtcatagctcactgcagcctcaaactcctggattcaagtgatcctcctgcctcagcttcccgagtagctgggactacaggtgcatgccaccacacccagtgaatttattttttatttctaaaattttttgtagagacagcatctcaccatgttgcccaggctggtctcagacaatcctcccaccttggcctgccacagtgctggggattacaagcgagagccaccaccccagcccaatacccagtgtttcatgcaacttaagtttcaagcttttagggggatggaggagatgcacttgtgttcctagggttaaggcaaaagaggtggttagtagcaccaattaatgttaatccgggcatgagtggatagctatttatattaaactgcctgaccaatacctttaagttcttcagtaagtgttaatttaattgaaaaacatttagttaactatagaagctgtgaagatgttaattcggccagtaaattattcatgactgttggtgggttcgtttgagctttaatagctcctaatagacctcattagtgcctaagaatggccctgcagtactccagagtttcagttccagaaatctctttttttgtgttactgaatcttggacttgacagttcttaatgtgatacgacaacctggaatgggttaatccagttcaagtgtttcaagataacttgttttctccatgttgagttctttgggttcattaatacacctaaagcattaagataaaaccaatatacacagtctgtattttttaaagaagagattatttcttgattggataattaaaactatataattaaaggtggtataactgtttacacttgaattgtggcataactgtttacacttgaattgtggcgtccttttgcttattaaggattaactacctttttcctttggttgtatatggcagcactggattaggtgcgaaaggaggctgtgataaagaaatttgagtttacctctcagaaatttgaaatagaattggaggaacaagatacataaaaacatgaagtaaacaaagtacagaaattgcttggtatcacttgctgcaaattgcttggtgcaggcagtggatgttactgccccattcattagtaggaattaatgaatgagtctgctggaatggtcaagaaaggcttttttgtcaccttgaagatcacaacatagtatttttttgtgggaagacccatataagcaaaggtggctagaattcaggaatctcccaagagttgtgtttaaggattaggcgaggtaatggacttctggtagaactggaacacagtagagagtaaggatggaaggtagaatagagacacctggaatagtagttcttaatcctggctggaagtcagaaacacttggagcaggggttggggggagataacaaggcctggcacctaacctagtgtagttaaatttagaatctttgtacgggactcaggctttgattttgttggtttttgtttgtttgtttgtttaaggttgctgggggtgggtggatagccaggattaaaaacttcccatctagaatggtggaaaaataactgaagatgtttgacaggggagatgagaaatgaaattggagagtttttgttttgttttgttttttgagacaaggttctgatctgtctcccaggctgtagtgctgtgtcactatcttgttctctgcagccttgacttcccagtcctaagtagctgaggctccaggcgtataccaccatgcctggctaattttttgtatttttagtagagatggggtttctccacgttgcccaggctggtctggagctcctgggctcaagcagacctcctgccaaggcctcccaaagtgctgggattacaggcgtgagccaactcacctggccaaaattcaagtttttgatagtctggtggtggtatgtgacagaaaatggaaagtgtgcacactggaagttggcggatatattagacacctgagctaaaatatgtcacttagtaggataagagatgaatacaaaagatatagcgagggaaatactaacacaacttgcaacattgggtatggtgatggagaggggaagaatcaagatagttaaagaagtggccctacctcaaaccagttgtattactctgagtggaggctgggcataggtttgtttttgtttttttttttttaaagcttcccaagtatttgagcaccattaccctgagacatatatctagtctgggtaataggagaatgatctaaataaagttgaaagatcagacaagtgtatgtaacatttgatatttgaaggaacatgggatgttagagaatagaaaatggccagatcagctgttattgagtttttattttacatgtgaggaaagtgaaacttagagagattaaataacttgttcatggtatttactagtaccagtgattgcgattaggctcttctggtctgagctatttaatcagctctgacctctcacctgataatcattcttctgatgttttcaaatatccatttctcagcacgtacacctttttcttatctctgtagaaataattttcgttaacaccattttgtaactttggagtcagtgcaaaattgttgtttattttatagctaatataaagcagaaatgtgatttttactgataaataaattttatttctcttctatagacatttctcatctatttactgcagcagtgcaaatgagatttctgtttgcttactaagtcatctcctttaggatttcaagacttaataccactttcatcaaaaactaaggcactgtttcctgttacatcacgttgaaatgcttcataatcgggctccgctacacctgtcacactacatatcctatttcacttcagcccagctctctgttctagccaggctagcctgttgattttcctctgaaacaacaagccacacatgttgccacaggcattcatgcagaagacttcacttgatgctgggcttagaaaatcatagaatgcatggtcgctgctctgaagaaagaatttagtggcatattctcgcttgacttatgtgctgtttcatgcctagaatactcagctattttctttctcctagaattctgcctgattttccaggttcacttcaaattccacttatttaaaagccttggttgctttgatggacatgcagttgtggataaacaataaataatatttctagatagtctgtgacataatagatacctagatactaattgagcaaaataatttttggcatttttgtcctatactctgttttttttttccatgtttacatcttgtcttttcagcaagattgtctatgctctcatggcagggacttcttttatgttttccacagagctagatccttataaaatacttgcactaaattaaacattatgccatgtaactgagcttatttgggggaagaggtcaataaagactatggaataatttgaggtcttgggtatgagataccaaaggaggtagttgctagtacttgagagattgctccaaataacatcagatgagcatgcttccaagtttcctgcattacttgcatgacccatgattctaagttaatgaaatgagtttgtccctcttctcacccactgtccctgattattttatgtatgttatacttaatgtcttcattttttacctttagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgaggtaggtttgtaatttcctattaagaatcagttccataattctagatttcctgattatttggtcaaatataaaatctttatttgttcttttctaaaggtattcagaagacagtttttctattctcaactagtatgaaatatcaacactatctcttgttagataaggacagtatttatggtcaaacatttttcataccagattatattaatacatgctgatctctcgacttgctggtctcttagagaagctccgtctgtactatttagaagttaggatttcaaataagaatgtgcattgcagtctttctatgagggtctgtgaaactttggtgatatttgctactgacgtctgtttctttctctctactgtcttcaatgttagcttcttgaggaaagaaccttactttatatccatgcctacatttgcagtgcatatttgtgaacggtatacagtgcacatttgtaaatggttgacatgcctactgtattgttaggcattgctagtgctgaaatataacgaatgaataagatactaatggacttaatgatttagaacaatttgttacacaatatcacaatataggctaaaagatactaataaaatattaagaatataactgaagctgttcccttggaggtaaggaggagggtaaagaaagcctacagaaaagggatatttgaaggtgagtagtaccttgttaagaggtagaagagacattggtagaggtatagaggtaacagaattagcagattcagggctacgtgaaagcacatggtatatattaagttgttcattatgaacagagtagagaatataattttgcgggagagttatgaaagggaagtttgctggaggcttggcccaatgcatttgtctttattccgtaggagagccatcagatgtctataagcaagggcttaagggtttttcccccaaaagtaagatagctttattgcttcacattttaaagtaatattcagaagtgtacctttaaaagacaaatggtgacacttttgagggaaaggctgaggatgggaagacctgtcaaaagcagtggatcaagtataaggaagataaaagctaaggtgtaggtagagaaaaaggtaggtgctaggtgttctgatgatttagaagtgaggacttggggaccaattgaatctgaagataaatgtggagagaatggctttatcaaatccagttgtgcaaactagaaaccttcattgttcataggaatagggaagttagagtagtaacttactgatattaaaatatgttatggaaatctattgtgttcattagatagcaatctgaagttgaaggaaatacactagtatggaatattgaacagtggttaactttgagggtaggcttatgaagagcaattttcctttttaatctttagtttccagattttctaaagttagacataaaggaattcagaaaggagtcatcagtgtataggtaataaaaggaagaagcaccaatgaagagagcaaagacatagaagtcaggaaaaagcaccaacgataatttcaggaagtcaatggtaaacatttttttagatgctacagaggtcaaataaaatgaagaatgaaaataagtcattcagttacaaaagcttcactgctatttcaagaagcgcttaggactttatttccaatttattgaaggattatgtaatagtgtcagtgaccttgctgtgcactagaattattccttaacaactaaaaactatagtaaaattatctatgtctcataaacagacactgttatttaattttaaggtaattgtagcatttagtttttctatttgtttcttcttaccttagctgatttttaaaaaataattttagactaattgttgtggattctgttggattagatagggaagattaacacaaattgaaaccacaattttatgttctgaagcataaaagattagatttttttttttttcctctctgagacagagtcttgctctgtcgccaaggctggagtgcagtggggtgatcttggctcactgcagcctctgcctcccaggttcaggtgattcttctgcctcagtctcctgagtagctgaaattacaggcgcgcatcaccatgcctggcttatttttgtatttttagtagagacggggtttcaccgtgttggccagtctggttttgaattcctgaccttgtgatccacccgcctcggcctcccaaagtgctgggattacaggcatgagccaccgtgcctggcaagattagatattaaggctttcatttcattgacatgatttatagaaatagatttaacgaagtcctttttgtttagtgtaatctttgtattctgaatattagtttactacatgaacattttaatatataaatgcatccatagctgtctaaaaattacatgtttacatatgtacaaagaaaccacaattgggatgaagattattggcagtaaaacatggctgtggttgtacagttgtgaaatagttcagttaaagggggcacacagctaagaaaacagatttggtaatgcaatggaacccccagattttaaaggggggttttgtaaaatcagtaaaaatagtacgtaattaggaacaaatatatatagaagggtagaattagccataaaatggcaagaaagaataaggcttataaagcatttgtttgagatgtgaaaatagacctgaattgtttggtgaatgatttgatccaggttagtctaaaggtgacagacaagagaaaagcaaaactagaaaattcctgtcgcgctcctagttttttctgctgaatgcaataattttcatacttgaaacatagcaaagcaagagaaaactgaggccccagatgagtgagaaaataacaggattacttggcggttgctagggtgctagttgctaggtgtgtgatagtagtcaaatagagacctatgacaggaactgtaaatgtcctgatttttcagtcagatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaaggtaggagaatgaatgattaaaagataaactacaaagagtctgataatttaaaattagtcaccaaattggaatactagattaaccaacagaaggcattttaaaagcattaggttatagtttttttatttgggaacaaacgatccattacggaggaactgaaagaaaacctgatttcgctaatgtgatttgtgaagaaatgatggggatgtgttttagttttacaaagttataaaacttcagtctacagaatcaaggagtgtaatcactcagtactttatattggtcgggtacattaagaatagtagtgaaatgcactttaatgaataattacttagaacctatccagaagacagcaattagtgttaaaaatggttgtgttcagaaaattggaagaaacagtggaagtcaaggggaggtatgtctgagaatacagagtagttttctaaagatcttatggtgaaataggctaccttttccaaattgattgtcaatcagtagaagccaagcagaccagattaggggggaaaaacaacttagatgttgtaataaattacaaagcatagatttccaccccctctccccaaaggaacttggaaaccagttaggtgctcccactttacttttgaggaaaaaatcccagagatgttaaaagtacttgagagtcaggactgaaagccagtcttttgacttttatgttcttcagggaactttaatcaatttcttgagttacaaatgaagtttaaatttgacctgagatttgttccatttctgcttttattaaaggaggactaattttgtcaatgactttttcagtttaaaagtaaatatgtagaaaagggtagaaggtctaaactttatgaggctggagatatttgtctgttgtgttacctactatatgagtagaacctaaaataatgctgatgcattgtatgaacttaattgtggttgaatgaataaggcagtggttaagaatggagtcagaactggattctgttcccacatttgccatttttagcgctgtgcccttaagatggctaagtgttttctcatctgtgaacattagattttctggtctttaaatacatttgaaatcatactgtataaatatcttatgtctcatttcctattacagaataagcattttccacatattgtttccaatgaccacatagcattacataagttacaatgacgtcttgagctataaagtgtgttagactttatattatttccaggaatttgctacaaaaatatatttgttaaaatacttgtgtataaagcttttttcacatttcagatttccccaggagagcttttctgcaatgcagttattaagaaaaatatctccacattttgatacatgttgctaaattgcatttctaaaaggttgtaccaatttactaccataaaagtggtgtgtgtgttgttcttagctcactttttcattattttaaaatcttacgtctttgctagtttggtatatgaaagtattaatttgctttatctggattttttattgcaaaaattcaagtttttttttaatgtttaatgttttagcttttgtgtataaagtttaataattgatattcaagaatgatttatttgctcacttaatcagtaattcaacatatgagtgcctgctctgtgccaggcactgtttatctaaaatctagggatttagctttgaattgaaagttctgcccctcaagaagcttatattctggtaatttaattgtactgatttgccctatctactctggtgtatttacacttttcccccaggtttgagtataaaagcttgtgctttttgtataatcagatatcagtcccttgtgatttttttttaattgatttcaaatctagaaagttccgcccttgcaaagattttacaaatatactcatccatgggggtgtgtgtgtatgttttggggtttttgtttgtttgtttttgttgttttgtttttgtttttgttttgagacagggtctcactctgtcacccaggctggagtacggtgtcaggatcatggcttgacctcccaggctctggtgaacctcccaccccagcctcttgagtagctggaactataggcatccagctaattttggctaatttttgtatttttttgtagagacagggttttgccatgtgcctaggctggtctcaaattcctgggctcaggtgatctgccacctcggcctctcaaagtgctaggattacaaacgtgaaccactgagcctggctggtttttaaatattttttaagacattaaactcggttcatttgaatacatttttacatgctgttaggcaagcaactaaattgtggatttttttcccccctatttaaagaagaagtcaagtaacatttacctactgggtccttcctaccaccacctttgttagcatctttaattttttataaacaaggttctgttaaattatctacttccatttgtcctatactttcatgtaattgtttttgtgataacttccattttgcttgttttttgatggtgctgattaagaaatatttgcaatgccattaaaatatagtttagccaaattattaggaattctttgaaaagtattaacatgtcacatgtcacatcaacttatctaaagttgtttgagtggtgtgtttccctttggaaaaataaaataaaggcttcctccaaatggataaaggctagggaaagagagctctagtcagcaaagattctgggagaaggggaaggctttttcaactcttttggtatgtgtctagggatgagacggagactcgaacagtagagcccagattccaacattcttgttggggaacaacttagagtcttaaaatgctagctttgatgctttctaattctggttcagtctccctttgggtgagaaaaagaggatttctatctcctacctgcagtgatgtgtggcaggattggagacttgagaatggggatattttgcagctttaaggcatatatatttcagatcatatcattgtgttcttgtttaatagtaatcagaactatagtctaaacatgaggccaagtgcagtggctcacgcctgtaatcccatcactttgggaggccagggcgcagtgcaggggccggatcacttgaggtcaggagttccgagaacagcctggtcaacatggtgaaaccccgtctctactaaaaatacaaaatttggctgggtttggtggcgcacacctgtagtcccagctacttgggagactgaggcagagggatcacttgaacccaggaggcagaggttgcagtgagccaatatcgtaccactgcactccaggctgggtgacagcgagactccatctcaaaaataaattaattcagcctgggtgacagagcaagactgtgtctcaaaaataaattaattaattaaataaacaaacaaacatgaaagaagcacagcttgaaagtccctcagtgatctagaataatggttctcaagttaattttatactgcttgtcagttaaaaacatgtattttcgatatgtgtatatgtttacaaattgtgtaattataattctgtgtctgcattgtaaaacacagtggtacaaataggaaaaatgtgaagtgagggatattataaaaagtttacttgtgcagaaatgttctgttagaaatactatgttctggattgctggtttttaagtgtttaattttaaaaagctttataatatcatgaattagtatcagggaaatctacatttgtgtgttgtattgcaactaatttaagtccatgtcatagtcttgatcttaactgtttggcatacttaccatatctcgttagatggtttcttaatgtggaggttgaagaactagtactaggaatagaaatgtcagttcccttgctctttgcatgtgcttgccttatcttccatctgaggttcttctgcgggaatctttcaaccatttgtctatttgggcttttttgtttttctgggatggagtcttgctgtgttgcccaggctggagtgcagtagcacaatttcggctcactgcaacctccgcctcctgggttcaagcaattctcatgcctccccctcctgagtagctgggactacagacccatgccaccatgcctggctaaattttgtatttttggtagagacaggctttcaccatgttggccgtgcttgtcccaaactcctgacctcatgtccaccccggcctccctgtgctgggattacaggtgtgagccactgcatccggcctcatttgtcttatttgtgaaggtagcttagttacactagataactaaatttatatatctccttatcgggcatacggtaatacggtaagagcaaatgagtgaggacttcactgttggcctcttttggagttctccactctttcctcagaatacctgagtaatacatgatactcatagaccatctgacataccaactcggtgaaacctagactataaatacatagtaaatatttataaaagctcatttttatctctgggcagaaaaatagtcccagttattttcttctgcaccccattgggttatcagtgtgtactctagggagactagtgactaaaaatgataggttctatttaaagttgatcggcattgaaaagaaattggactgaatagtctcactccaacaaccatcaagagtctttgtggcattttcagaattgttgatgtcatcgtatgttttaatggctttaaaaaaaatacatttcaccttttatagtaatgttaattctatgtatttcctgtcaatagaaatctaatttatatttcgctaaacccaagctaaaaatatatattgactgtgaaatgtgcattaaattgttattgatcatagttatcaacattatgctatgttataacagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctgtaagtcaggaaagcagtcatctcagcttaccttgctttgtgttaagagcatgacctaggattgccactcattctggttgaaatatcttgccgactcaccttctaacttcccgaatcatttttttcaccttcactcttgaaagataacttcagtagattagggtcttactgcccaaagtatatctaagaatcagaagcattattatcaccttggatcttaataaagatggaaaatttcaaatccccatacctactgagtctgattttatattttaacttctcatttgagaagccctggtttacagccagaccttcttggtttgaatcttctactatttgactttggcaagtcatttaacttctctgtgtctgttttctcattggtaaaatgaggcgaatacaatactttcttgtgggcttttgtgaaagttaaatgagttaatatatgttaaacacagaacagtggctagtgtagaagaattaggacgtaaccacctacaggtgtggtggctttgatttacgtgatttgaccatcacacatatcgttgactcaaactttggtttatctttctagaatttgttactcttttttcctagtgaaaatatatcctttttattaataatgcccaacattccacttaaatggaaatacttataaatcagattttcagtgaaagggtctaaaacataattgtaatgatttagaaatgtcattactgtggtaaattatagacctaggctttgctaaggatttcgtcctgttttgtgcttcacttatagtttttgttgttttactcaaagaagggaaatggaacatccaatgtgatagtattttatgacctaggcagattccattatattgcttttaaatagctcctatttcactaaagaatgggaacgaagtgatagttacagatttcatcagtatgtaaaaagtgaagggtttcttttaggtaaagatttctttaaatgtacctgtgaaatgattcagcatttttaaaatggaaatgcttttgctgtcttggagttttgttgtttcagaagttttctactgcactattttggatagtctttcattaaaggacctaagcatgaattactctgaaattttctagtttaagtattgcatagaaagttcattttattgtgttaatctctactaacttgaaatatgccttccaaatgcatgacttactaaacagtattaaggtattggctgaagtttcaaaatagcgttaccaaatctcttaagagtctttggtagtttgtggtcgctgtctcttaatattaattacctttgttctgaaattgttgttttagtaattttcacttcatgtaaaggcagcatttgctaatgtagttgctataccttaatattaaaccccagaaattctatttttgtctgataagtggaaattctaccataatttggggcaattccccaatataataagttgtttcctctgaaatgttttattagctaaattaatgctgcagtaataaagtctataatcttcccttcattttacttttttttgcgtttttatatggaagatttagtgacttattaaccagacttaatatgctatggagataatgtacagatatgtatatattctttttctttttaaaacagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggaggtaatctgtcagttctcctttgtaaaaatgtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctggctaacacggtgaaaccccgtctctactaaaaatacaaaaaattagctgggcgtggtggcaggcacctgtagtcccagctactcgggaggctgaagcaggagaatggtgtgaacctgggaggcggagcttgcagtaagccaagatgccaccactgcactccagcctgggcgacagagcgagaccccgtctcaaaaaaaaaaaaagtcacctcttagattatatggaaattcattgtggctgacaccatacaaattatttcacaggcctggcatggtggctcatgcctgtattcccagcattttgggaggccagggcaagtggattgcttgagctcaggaattcaagaccagcttgcagcctgggcaacatggcaaaaccccatctctacaaaaaatgcaaaaattagctgaggaacgtgacatgtgcctgtagtcccagctactaagtagactgaggtgggaggatcgcttgagcccgcaaggtagaggttgcagtgagctgagatcgtgccgctgcactccagcttgggtgacagggagactctgtctcaaaaaaaaaaaaaaaaaaaaaaaaaaaaagtttttacatgtgaagtgtttggcttactaaaggactgaaattatgaggcctctgtgcatttttaaaaaacgtttgagaaaagagtcagtataatagctaacaagatgcatgctataggaacattgttttggttaatcctcatggcagtcctgttaggaattattctccttttacataagagaaaactgaggtacagaggagtttaaaaaaaaaactcgccaaaggttatgattgttaagtcatctcatttgtagtatgtgtaaatgccataaaaactaagattaagacatggctatcttagcataagatggtggttctgaaacatttgtgtgtatcagaattagtggaaggcttgttaaaacacagattgctatacttgatccccagagtttgtctttggctaggactagagttaggcccagtatttcttttaagctcccaggtgatgttaatgctgctggtccagggaccacactttgaaaaccactggtctaaggcaattcaaatgctatgttaagtatagcttggaagcaatatatcgtttcgcaaaaatcagttcaacaaacataacacattatttatttttagatgatgttgaatttgaagtatcatcggaccgacggactgggaaacccattgctgttaaactggtgaagataaaacaagaaatcctccctgaagaacgaatgaatggacaagttagtgactttgatgctttgtgtttttttagggccctgcatttgcatatctttcacattagaaaaggaagattctccccatctcctcagtttgcacgaaagagagctatagtatataaagattactattttaaaattaatcaaaagcactggcatttcttgacctgaaataaaaatatggtcaagactcaattgggtttttacatataaccctgagtcaatgcttacagtcaatttacatactgtaagtttgaaacttggcagcatgacatcctcttgtggatcatattaaaatgcatccctgtatatagtatagaggatattaaaattcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccaccatgtgatctataagcgtactttaaaattcaaaatagaaaacgtaagctgcaattgttaaaatcagttttaaatttggtttctaagaggcttcaaatgcagcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggtggaagtggtagacttttgaaaggtggggatgctgttgaccagaggcagtgatgtgagagttaacgtgaaagatgaccgcctgatatggatagactaagaggatggggtggaggagtcaagtcatattgagaagatagaatcatcaatcttaattgatttgataaaggtggggttggaattaaagggagtcccaaatactgtttttctggcctggcctactgggcagatgatggtaccataaactgggctaaggagacataaggagaatgttcaaggtgggaaaagaatcatacttatcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgtaccttccagtagcatgtggagggaaaagtcctaagagcatgtctgggattatctgccttgaaccttatctctttcttggcaagccttgaaggaatcagattgtgttgtaggtgtggttattattagttacagtctgaaggcctcaatttatatagttgttaatctcagaacagccttacctggtaagtttcttcatctgtaaaatgacgtataagttctcacaaagttacttgtcgatgttcatactgcttttaaatagcaggcatttaaattcccatctgactctaaagcgttttcactgcagtaagttacaaaaacaggtagaatttttctggtgtctttgttagtctgtaacatttttttaaataaaaagcacattttgggttatttgtctgtgaaaaattaagggaagtaattgcttggtgtataggtcttttcttaaaacatttagactaacagtaccattatgtcttatacagtctatgttatcttaaaaacaaaattgaatttacatcgctgctacacaaatatgaaggcataaaagcaacatgtggtgtctctaacttgtttccattctccaatggaggtggatatcattacttttaaaagcatagcaagttctcttaaagtcacttcatttactcaacttttatggctgtttactcagaaataattaatgagatagctactaaatttagcactcactgaaaatagagaccatctcctatttatctctgtatcaccagtaccttactttgccgcagattatacctacacaaatgtttgtttaatgaataacctttataagactttagtattccccacctttggtagcattcgctttgtggctttatttcagttattttgttgaaatagaaaaacagagtagaacatcacgcacccatgtgtaagtttgtaaaaaagcaaatcttccaacaacagtcccagagaaagatgacctatatatatatttgccaaacgtagaaggctaaggagttaaagtcctttgcatataaagccatatgaaaataatcaaatgtcataaaccctgtatttattcttagtgatgatagaattcttaaagccccaggaaactagtttctttagactcatatctaagcaggccaatacatttttaatccctgtttcattcctcctccctgcaattattttttttctagtactggtgctgtaagtgctcgcaacattatgctgttgaaaaagaaacaagcccgctgtcagggagtagtttgtgccatgaaggtaagtgttaaatttgagaaacttgagttttctttggccacttgaaatgttgtacttcaaactccagcctttgtttttttttttcttttttatcttacccttttaaaatatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagtgcagtggcgcgatctcggctcactgcaacctccgcctcccgggtttaagcgattctcctgcctcagcctcccaagtagctgggactacaagggcatgccaccacacccagctaatttttgtattcttagtaaagacggggtttcaccctgttggcaaggatggtctcgatctcttgaccttgcgatctgtccaccttggcctcccaaagtgctgggattacaagtatgagccacctcgcccagccaaatatgtatttttttttactgggtgatgaaaaaaggccaaagaagaaaatgctaattaaattggaaagcacctgattggattagactgcagttcaggtgtacatttgttccctcctctgcccctgccctacccctccagtttgtggggaaggtgaggacacaagtggtgtcattcctggaaaaattccttaaataaaatcttttggtaccagagtgctgggtcttaattgcattgttgtaattttatggttgactcgtgtgaccatagaccatgaagctttcacattggacttatgttgtcaacaccttttttcgcttcagggaactaagttaaaaataacatgggtttactatgtgttcttcttgtttgacttagaactaggaaggatgagaaatctccagctaaaatcgtttttccttctcatcagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatggtaagtgttggatattactggatatgtatctaatatgcgaaagccaatgttatattcaagtttatactactaaattaaaatttttcttaagttaaatgaccctaatgggcatttaccttgttaaggtgattaagaatcatacacatttgagtcagtctgggttatctctggcagttatcttggaaatatatgtgaaaaaattttttgaatggaaatctggacaggattactaagatatttttagagtcagtgattctcaggcccttaatatgaagagtaagaaaattcaagttcatcattgtagaaagtagattttcccaaactatttcctaagacatttaattagtggtttctgtttttaggaaacacaattcttcctccagtgtggtccagggaagccaaaagattgaacacccatgatctagacactagatcacacataaaatacactaacagcaatgatagctgatgagcttttttaaaaaaaaaatcataggcacggtggctcacacctgtaatcccagcactttgggaggctgaggcgggtgatcacttgaggtcaggagttcaagaccagcctggccaacatggtaaaaccccgtctctactaaaaatagaaaaattagccaggtgtgacggtgggcacctgtaatcctaactactcaggaggctgagacaggagaatcgcttgaacctaggaggcagaggttgcagtaagccaataccatgccgttgccctgcaacctgggtgacagaggaagactgtctcaaaaaaataattgcaaaaacatctcatcatgttttaagaaggtttaacaatttgttgtgttgggccacattcagagctgtcctaggccatggtttggacaagcttgcaattaaaccagagtcaaaaaggttttgttttggcagaacttcacaaattgttttttaagagtttgtgtctgggagtggcataaaccaaccagattttttcccaaacatgttttatgaactcattttctcagacataatttgcatttagttacgtttgggatcatatcatctacactataactcagtgttgccagtggaactgggtacattgaatgaaaatttaagtttcttgagttttttttaatcctttgcctttgaagaactggttgtatttgacacagtgtatttaactttaaaagtttgtaagtctgaatgtgtgatttttttttttttttttacattttcaaaggcaagatctgttttgctttacggtatggaaaatataacttggctactgtcaggacttggcaaggattaaatgtcaaaatattgtttaggtcatatttaaaacttacagaatcacttctgcagtgagcagatatgtagtatgtaatacaatagcagattgataatttgtgttcattgtttcattaaacatgagtatctaccatgttccaggtactcttgatacagtaagccttacaaagctgataatttagtaagaaggaaaaaaaaaaaagagaaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggcagagcttttagtgagctgagatggcgccattgcactccatcctgggcgactgagtgagactccgtctccaaaaaaaaaatttagaccttgttctgtacttcaaggaaaagatttcttttggataatgacatcaggtatgtgctttgggagagtaatggcagcaatatgaagcctagatgggatggagaaagacaaaagatgaaaaggattactatgaaattacttggatagttaaggtagtccttgaactaggcacacagatagtgactatagacaagtgaaggtacatgagagatactggaaagtcatgttataatttaataattgctattagccagaaagagcaaggctagtatcttgcttatcacttactgtagcttgggaaattatttcacctctgagcttcagtttttaaatttcaaaaatgattgtgtaatagtttaaaaagccctcgaagtacctagctcataataggaatttcgcatgtgacagatgatactgttaacaaaaataaaaatacacttcagttgggcttatttttaataacttttaattcttggaatgctctgcttcccaaatgtgtctggcaaaactggcttgatgaagagagcctttgtgtgagactttccctgccattttttgtttttttttctttcttagtccaacagtaccctagtaaatcctctgtcatcatgcttcttacagtatataacatttacctgttaatgaatctgtctctgctgcactggactccctcagggcagggattctcctatctctatttaatatatttgatgtatagtatattgtcagctgttgatgttgaagttggtgagttaagagcaaaaggtgaacagtaagcttttgagtttggttgtggaaaagttgatgacattggagtcagacctgagttcactgacattgttcttaaccaaactcaaatcctctggattattttgcgctgggttttgtaaccttggtaaggtttacttaattcctcagatttccccaatttgtaaaatgagggaaaagagaaactatggagatgattttgtacaagattaatttgataatacataatacctggtaatgttgtaagtgttcaataaattattatatagcagttatggaaggaatgtgattggtagaagaggaaaatgaattggttttgaatatatcgtagtttgtaatgaggactggagtttaggaaggaagtcagggctagagtagggacatgggcattatcttcatagaaatgttgaaaccataaaatcagtataatttatgtagttgctgtacactgtcattacttaacggtgtgattcaatacgacacacctgaactttcttagacttttatttttttagtcaagtgcagtagtgagaaggggggaaagaggagaacaaggaagttcgatctgtaactgactgaacaatcgagataacccactaccttcagaccagcccttagattttttaagagttaatcattcttacacgtacgatgactgaaatgttgtttctccttgaagtctggtattaaaaaaaattgttgaaatactagtatgtcataatttttaatcatctactttatgtcaagtacttgaactgtgctagatcatacaccaaattatcctgcattgttaagtatattgattgacattatatattaaatactgtgcaaggtgctgtgtgctactaaaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggttgcagtaagctgagatcgcaccactgtactccagcctagccaacagagtgagactctgtctcaaaaaaaaaaatagaaagtaagggttcttagaaccagacagttcagtttttgaatccaggccctgccactttatacctgtgtaatttttaccaaataacttcttggtatcttagtttcattatcctgaagttagggataatgttacctcttcatggggcattcttgaggattaaatgagtcaatacatagaaattacttaaaatggtgtctaatgtaaataagcatgccatgccatgactgttactgtaaaataaagactgcctgttactgttgatgtttatggtaatgtttagttaaatgtcatttcctttctccttagtgagttctctggtgatgttgatagcctggaactgggggacatggtcgagtatagcttgtccaaaggcaaaggcaacaaagtcagtgcagaaaaagtgaacaaaacacactcaggtaataaattgtgacttcttattcagcctgtgcttttaagtgggagataaaggatggagtagtagagggagatgaggcctaattattctacatcagtcattctcatgtgcgattccatagaacagcagcatcacctggttgcttgttagaaatatacgttctctgaccctatcccatacccactgaaactctgtgagtgggcattcttttttaataaatcctttaggtgattctggtatacactgaagtttgagaaggattggcctagatattttaggaaatttgctttatattttcaattcattgtcttcttttgaaaaataaacccaggatagccagctgtggtagtggatgcctgtagtcacagttacttgggaggctgaggtgggagggccgcttgtgctggtaggttgagactgcagtgagccatgatgatcctaccactgcactccaacctgggtgacagagcaagactgtctgaaaaaaacaaaaataaccccaagatatgtatacatcaccatggagtagggaagagaggcatttccctagaagattgttttgaagaagaatgaatctaaatgtgaaaaataatgggaagttaaaaaaattaattgtaatttaggatcttggatctctgactttaaaagacctgcaacttatttttggctctcatctgaactcttaagtgtgtgttatgttttagacactggggatacagcagtgaagaaatcagatacatccctgtattcattgaccttattttttggtggaaaatatggggcagactagaggagtaaaatactgtatatgatgtttagaaagacaacaatacatgtaataaagatgaatcaggacagtatgtaagtattgtgatttacattttagagaccaggaaaggcttcttaaaaaatgacatatggtcacctggaaaaagtaagagatcaaggcatgttttatttatgaatacttattaattccttaaacaattttatttaaacaattctatttaggaaaagcaggcattttggtagtttagaagtatttaaagtccagcagctgttctaaaaatagaacttggcttcaggttccctaccccatttcaatagcagccagccaacctaccctgttaacatttgtgctgttattttttgcttacttgtctttctatgtagtagagatgaaataaaattgaaagatgtacctgcctttgttttgtagtgaatggcattactgaggaagctgatcccaccatttactctggcaaagtaattcgccccctgaggagtgttgatccaacacagactgagtaccaaggaatgattgagattgtggaggagggtaaggatcatcactatcaggctgtttgaaatttgccataacttcagatgagcacctataaagttttaaaatatggtgcttattgcagttgtttttaggtttaaaactgaattaaggaaaagtgacctctctcatgcttgctttttatttttataccccttgaaaatgaggtcagtctgggtttaaatagtgaaaacgtgactgctttgtgagcacatgactgatacatgagcaactatgagttatattgagatagacttaacaacaaactctgataaccaaagcttttactgttgagtgtatgataatcaaatattcagttccttcattagtatttaaatcagtaagcattcagttctgtatttttgcttcctgtaaaagtttactgtttttttcccccctacactacacatatgtacataatctgtttcttaatagctagagttctatgaggatcctatttctcgtttctagctcaggcttcctttcattctctactttcttcttcttttttccccatctatcttcaagaattcccagagttccagtgccgctgttcccccaacagtcaccatcagaaaggccaactttgtatgatctgtatgcataaaataaatacatgatagaaataggagagaactctgtagatgattaggatagcagaattacatgatgtggagtagatgagagggcttgagtattccaaccaaagatgatggcttggtaggccgggcgtggtggttcacgcctgtaatcccagcactttgggaggctgaggcgggcggatcacgaggccaggagttcgtgaccagcctggccagcatggtgaaaccccgtctctactattaaaaaaactaataataaaaaaattttaaaaagaaaagatgatggcttggtttacaaagagaataaagtccttgcatcatctaagagtcagcgaacataaagtgctgaatagcaggtcatttgggagaaggaaatgaaccttgataacctattcctttaccacatgggattcttagaatttctgttctacataaaaccactgttctcccacctctaaatatgaatttttaaacaaatgccatgacatcacacccctaaaaaggccatgggagtatggactactaactttaactcataatatgatatcaaattgcccttccatctcctaacgtgctgcttttacttccttttccatccccacttcccagtccactcattcttcagcactggctgtgggatatagtccaaagcaagggttttatttaggcatctctaagcctggtgggatatagtccaaagcaagggttttgtttaggcatctctaagcccgggactagacagattacattttcccacttggtaagaactagctcttttattcaggaacacaactgtaacttatactaagactttgaagttgggcagacctagatctggacaccgttctagcatataatcttggacaaataacttaaatctttgctagctcagtttcttcatctttaaaatggtaataccttcagccttagatggttctataaagtatgaatcagtatgtgcatcataaatggtaattattgatattgcatgaggtcagaccagcttcctctaatcactcttcccatgacttgatctctttggattatctcctcaaagttttttggttcctgtatttaaaattaaaagtcagctggggtcgagagtaggggctcacacctgtaatcccagcactttgggaagccaaggcaggcagatcacctgaaggtcaggagttcgagaccagcctggccaacatggcgaaaccctgtctctcctaaaaatacaaaaattagccaggtatcatggtgggtgcctataatcccagctacttcagaggctgaggcaggagaatcacttgaacctgggaggcggaagttgcagtgagctgaatcatgccactgaactccagcctggttaacagagcatgactccgtctcaaaaaaaaaaaaaaaagtcaggtgtggtggctcacacctgtaaacccaacacttcgggaggccaaggtgggcagatcacttgagcccaggagtttgagaccagcctgggcaacatggcaaaaccctgtctctacaaaaaatgcaaaaattagccagtcatggtgtgtgcctgtagtcccagcgactcaggagctgaggtgggaggatcacccgagcccaggaaatcaaggctgcagtgagccgttgatcgccactgcactccagcctgggtagcagagcgagaccctgtctcaacaataacaatgacaaaaattcttcacttaccctgtaatcatcaagaggatggttagaagcttctgcttcccacctgtttttctcatgttttccactattgttgactgagtacatttgcctggatgctgaaaattgttaggcagctgaattctttggcatagtttttatctgtagcctgcaccgggctccaggcaacttcatactgtagggcagggctcagcatatatggtggccttttcttgtgatcacagccacaaccatttgtttacatattgtttttcgttgctttctcactacaacagcagagttggttagacaggatgacttgcaaacctaaaataatactctccggccctttaggaaaatggtttttggtctctgatctggaaaaaggaacctatgtgagggagccagaattcgaacaaaaaaaaaggaggtggggtgtcaaatttatctaaattgtttttgcctgtgcccgcctagttgtttactggctcattgagtatgggacaaaagtatttttggttggctcatattgtgaacttgggaagaagatagtcctgtgaatattggcaacccatagtgcttaaaatttaggcaatgggattgtaaatgacagtattttttgttttaatttataaatgcagtttaaaattgttcatcagctaataaagtactgatgggagctgtgacattctcatttggttccatggtagtatttaacatttaggatttcatttaagctttaaggtgaaacttctgagtactgaaaatgtaaatatattttaagtaacataacacatttttagcagttatataaacttcctagggtcatcagcagaggactgttgtgaaatactagcttttagactttgtacctgttttacaggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagcttcttttgcatatcacacaaacacagaaaccacgttcaaaagtacttaaaaaataagcttagggcaaacaaacttagtcttactcctgagatctcagggaaatctgagtcctcagaatgtttttcatcagtacagagaataataacattttgtatggctgctactataacccagcttaattctagaggggatccaaacaatatatatgttgaagtaacagcttcctgatgagtttgcttaattcaaaaagcttagttcataatatacgaaggaacaaggcaagttttatttgtttggttcaagtttgtgatatagtgaatggcactttcagagatacatttcttccctgacaggttttgccacaggcagctggactggagtatcaacattaataccatgttttatacatccttttagataggggcaggcattgtgcttcattcagagtgaggtgtggcatgccctctcttttttacctacttttttttttcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctggtgagttttgttgttgtggtttgattagtaactaccctggagtgtctcaactttatagtctctgttttgtcacatcacttttctgtgccttgtcttctgccacttattatttcttgatacttcctacttctagttgaatacaaaaagattgtttagtacatgttttttaaaatttttgccaaattcttcttcttccattaagtcatttctaggttatatgctacttaaaattctaatagtttagccatgctgattcataatgccgctttgcttccccagagacagtctcacagtctgattcggttacccaggcgctatcacgactcactgcagactcaaccccctgggcctaagcaattctcccacgtcagcttccccagtagctgggactacaagcatgcgccaccacatgcagccaattttattttttgtagagacatggtcccactgttttgcccaggctgatctcgaacttctgggctcaagtgttcctcctgccctgtcctctcaaagcgctgggattacaggtgttagctaccacatctgctaccttgtttttttatgcatctgtggaactggtcactcttgattgcattcaagtctagggtctgcaaatgattccttccattcctattaagttgggaccttgagttggggataataatacataaacaaacttgtctgtcctgtctttctagctaggtatatgaggcaagagtcccatcataaaaagtgagtcatttgggcagttaggtggaaaacacactcctttgcaagtgcttgctgtctgcccaccaagtgtggtttcttctcatcttttgacttaattacagtgagggccccaaggctgttgcagctcctcgacctgatcggttggtcaatcgcttgaagaatatcactctggatgatgccagtgctcctcgcctaatggttcttcgtcagccaaggggaccagataactcaatggtatgagggcatacaaggcttgggggaggccaactgatagaccaacataaaatatgtggtcctatttaaacaataggtcaggaaacttaatgaagcagggagacttccatattgcttataactagttaggactttctacacattggttcagccccctaacctaatggttgcttacagtaagaagcacatttcttttcttgatgctttgaagacagtttaggtaatgaatgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacact
